United States Patent 10,696,975 (GENES AND USES FOR PLANT ENHANCEMENT) - sequence listing, part 18

SEQ ID NO: 80376 - protein, 98 aa, Zea mays
MAKPKPKRPAPPPRRWAACGLWRRPAFASGGLPLAAAAYVGVDYMQHLSPVWHGRLRPALWAALALATAARAPFYRRWGAEVRAAPRFFAAMAFMLAA

SEQ ID NO: 80377 - protein, 441 aa, Vibrio campbellii AND4
MSVYHTLCFLSAAAMVIAFVNSKIGKMQTTIAITAGSMILSLLILIAGQNDWFHLNEIATETVTSINFEDFLLKGILGFLLFAGGLGIKLPNLKDQKWEITVLALGATLFSTFFIGFVLYGFCQVIGIQFDLVYCLLFGALISPTDPIAVLAIVKKLNAPRRISTQIEGESLFNDGFGLVIFVTLFTIAFGTEAPTVGSVTHLFIQEAIGGIVYGFVLGLIFHYLISATDDHSMELLLTIGVPTAGYAFAEYLHVSGPLAMVVSGIMIGNWTRFIGFSKESEDHLDHFWELVDEFLNGVLFLLIGMSMLLFEFHKEDWIMMAISVPLVLAARYLSVFISYIGFKRYRKYNPWSVKILTWGGLRGGLALAMALSIPSGILVIPEKLIDVKEIIMVMTYSVVVFSILIQGSTITPMIEKAKQAEKEMEQEASSETQESKASQE

SEQ ID NO: 80378 - protein, 688 aa, Neurospora crassa
MASEEGPSRSASPTNVDNTFPQYPPRAELTVAGPPSLISSRMTDIGTEDGQGSDTTPRGGGPSSANPNRRSGFYSDTQSRPETSGTGLSSRGPWAQSVPLRQQLTGKRGSIAGSIGSAGGRPISAASRSHVPSLTSHGFFRPMSSQKLQAQRGAGRPPTMNRPYVITGEAGARNSVISTGSGRIGAQIAEDAELRMPSRGTEMTEQETMERMTANTSPINGFFPTSSVTDSVRPLQSPVDARNINVEMNKDYREESPTTPPRSPTRTSRSFRSSFLMPRMNESGITGSNREIEGGEKLQSAASSPNIPPQSYERQRARFKRRAKRQNRANLGKNYEYFEGNTVFCLGGRFQNTKQRPINIATGSLIVLPCILFFIFSAPWIWHNISPAIPVTFAYLAYICVSSFLHASASDPGVCYSLLPFILPRNLHKFPPPEMEDSPTGPPTTDWVLVHSAEASTAAMEVPIKYCKTCQLWRPPRAHHCRLCDNCVETQDHHCVWLNNCVGRRNYRYFFTFVSSATVLALYLIGACLAQILVYKNQHHISFGHAVNHFRVPFAMVFFGFLTFLYPAALTGYHIFLMARGETTREYLNSHKFPKSDRYRAFTQANWLKNWFVVLCRPRPPTYYGFKVKYNQGDQRLGSHRRWQQPAVSDSKEGMEMQNVSPQLPQTGFMGPTALRNSNNGSTAEVRA

SEQ ID NO: 80379 - protein, 554 aa, Cytophaga hutchinsonii ATCC 33406
MAELIKMPKMSDTMTEGVIAAWHKKVGDKVKSGDLLAEVETDKATMEMESYEDGTLLYIAAEAKSAVPIDGVIAVIGKDGENIDALIKEIKGGGAPAEAPKTEAKAEAEVPKAEKPAEAAKQAAPAVDLSSIKAEAILMPKMSDTMVEGTIVAWHKKVGDAVKSGELLAEVATDKATMEMESYEDGTLLHIEVKEGDAVQIDGLIAIIGEKGTDVTPIINAYKNGGKPSAAPAAASEPAKQETASAPASNNAPAAQASSSSDERAKISPLARKIASDKGIDIKQVKGSGDHGRVIKRDIENFKAAPAEAAPAKGSGAPAASLPNIVGQEGFDEVPVSQMRKVIVKRLSESLFTAPHFYLTMEINMDKAIEARASINEVATAKVSFNDMVIRASAAALRKHPMVNASWQGDKIRVNHHIHIGVAIAIEDGLVVPVVRFADSKSLSHISQEVKELGGKAKSKKIQPADMAGNTFTISNLGMFGIDEFTSIINSPDACILSVGGIKQTPIVKNGQIVVGNIMKVTLACDHRVVDGAVGSAFLQTLKSYLEDPVRILA

SEQ ID NO: 80380 - protein, 338 aa, Ustilago maydis 521
MSSLPKTYKAAVFEKTGQPLTFKDIELKHPEDGQILVKVEACGVCHSDAHVQAGAFGPLPRVPGHEIVGKVVEVGPHVTRWKSGDRVGGAWHGGHDGTCRQCNQGLFQMCDNGQINGVTRDGGYAEYCLLQAEAAVRLPSDGDAVQMAPLMCAGVTVHNGIRKMNITPGEVVAIQGLGGLGHLAVQYARKMGYRTVALSRGTDKKDFAMKLGATDYIDTSSQDAAEALQKMSGAALIVATAPNPEHISPLVGGCKPMGKLLILAPVGDVRVNSIAMITKGISVHGWPSGHALDSEDAVEFSQRFGVECMCETFPLAKANEAFEHMMANKARFRAVLTM

SEQ ID NO: 80381 - protein, 282 aa, Staphylococcus aureus subsp. aureus Mu50
MNHIEISKDVKIPVLGFGVFQIPQEQTAEAVKEAIKAGYRHIDTAQSYLNETEVGQGIEASGIDRSELFITTKVWIENVNYEDTIKSIERSLQRLNLDYLDLVLIHQPYNDVYGSWRALEELKENGKIKAIGVSNFGVDRIVDLGIHNQIQPQVNQIEINPFHQQEEQVAALQQENVVVEAWAPFAEGKNQLFQNQLLQAIADKYNKSIAQVILRWLVERDIVVLAKSVNPERMAQNLDIFDFELTEEDKQQIATLEESNSQFFSHADPEMIKALTSRELDV

SEQ ID NO: 80382 - protein, 323 aa, Chlamydomonas reinhardtii
VQEGKSAEVPIYDFAKHSRSEETHTTGPADVIVVEGILVLAMQEVREMCNMKIFVDTDDDLRLARRIQRDVAHRGRDVASVLKQYTEHVKPMFDMYVAPSRRHADVIIPWGNRDNNLVAIDLIVEHIRTKLQQPDLCRVFPNFQIIPSNFQIQGMHTIIRDRETSKEDFVFYADRLNRLVVEAGLGFLPFTERSVITPTGNAYSGVGFARKLCGVSIIRSGEAMEAALRACCKGIKLGKILVHRHRDSSDVIYEKLPSDIADRHVMLLDPLLTTGGTAVKAIQILKDRGVPEDRILFLTIIAAPEGVHRVCSSFPGVKLLTSE

SEQ ID NO: 80383 - protein, 477 aa, Pseudomonas aeruginosa PAO1
MTADKKAKILATLGPATRSRDDIRALVEAGANLLRLNFSHGDYADHAQRFAWVREVEAELNYPIGVLMDLQGPKLRVGRFAAGAVQLQRGQTFTLDLSDAPGDERRVNLPHPEIIHALEPGMSLLLDDGKIRLEVVNCHSDAIETRVAVGGELSDRKGVNVPEAVLQLSPLTDKDRRDLAFGLELGVDWVALSFVQRPEDIDEARGLIGDKAFLMAKIEKPSAVSAIEAIAERADAIMVARGDLGVEVPAESVPGIQKRIVQVCRQLGKPVVVATQMLESMRFSPAPTRAEVTDVATAVGAGADAVMLSAETASGQYPREAVEMMAKIVRQVEAEPDYHVQLEVNRPQPDATVSDAISCAIRRVSRILPVAVLVNYTESGNSTLRAARERPKAPILSLTPNLRTARRLTVAWGVYSVVNEQLAHVDEICSTALDIALAQRMARRGDTVVVTAGVPFGRPGSTNMLRIETVAPPLGDL

SEQ ID NO: 80384 - protein, 376 aa, Colwellia psychrerythraea 34H
MSDKFIKSKAAIAWGPNQPLSIEEVDVMLPREGEVLVKVVASGVCHTDAFTLSGDDPEGIFPVILGHEGGGIVEQIGAGVTSVKVGDHVIPLYTPECGECKFCLSGKTNLCQKIRETQGKGLMPDGTTRFYKDGQPIFHYMGCSTFSEYTVLPEISLAKVNKDAPLEEVCLLGCGVTTGMGAVMNTAKVEEGATVAIFGLGGIGLSAVIGATMAKASRIIAIDINESKFELAKKLGATDFINPKDYDKPIQDVIVEMTDGGVDYSFECIGNVNLMRSALECCHKGWGESVVIGVAGAGQEISTRPFQLVTGRVWRGSAFGGVKGRTELPDYVERYLAGEFKLSDFITHTMPLEDINESFELMHKGESIRSVIHFDK

SEQ ID NO: 80385 - protein, 53 aa, Populus trichocarpa
MEIDRDDGRSPSQLRPLSCSHNVLHRAHGSASWSQGDTKVLAAVMDLKLEKEE

SEQ ID NO: 80386 - protein, 788 aa, Glycine max
  misc_feature (140)..(140): Xaa can be any naturally occurring amino acid
  misc_feature (289)..(289): Xaa can be any naturally occurring amino acid
  misc_feature (515)..(515): Xaa can be any naturally occurring amino acid
  misc_feature (626)..(626): Xaa can be any naturally occurring amino acid
MGGSRVQVNKPHKSRFSSKSSRNLHKTSVKDRLAIAKSERNVGKGARAARIQRNKMIRDQKRAAVLKEKRELSGSRSPPRVIVLFALCASVDLESLADDLLSLLSKDTCVVLSGTVASSEYRTRITVLKAPHGDLLSCMXMAKVADLMVFVASARSSCEETDSYYIDSFGNQCLSVFRSLGLPSTAVFIRDLSTDLKQRNELKKMCTSSLASEFPEDCKFYPADTKDELHKFLWLFKEQRLKVPHWRTQRSYLLSQKVDAEYDGNSEKCTLFLTGYLRSRNLSVNQLVXGDFQLSKIEVLKDPCPLNSRKNQDLMDADEMHDAEVIGSLAPDPQNQEALVVENIPDPLAGEQTWPTEAEIAKADEDKKKKKIKKRSLPHGTSEYQAAWIVDDSDEEESDCDNENDDGMVLDEGEDGFPGQENRYSDFDGDGASLRLGDSDEETDIDSVMMEVDNLTREKIEDELKELKEAHAADEEFPDEVDTPLDVPARKRFAKYRGLKSFRTSSWDPKVCVFXRIFIVNIVVSNPHPRKKKKKKALELDHENREDCISVGSYARLHIMGVPSAVASKLSLLAKTIPVTACGLLKHESKVSVLHFSVKKHEAYDAPIKSKEELIFHVGFRQFVGXPIFSSEFINTDKNKMERFLHAGRFSVASIYAPISFPPLPTIILKRAGEDAAPAVAAVGSLKTVDADRIILKRVILTGYPQRVSKRKASVRHMFYNPEDVKWFKPVELYTKRGLRGRIKEPVGTHGTMKCLLNGVLEQRDTVCMNLFKRAYPKWPTHHFPLSE

SEQ ID NO: 80387 - protein, 356 aa, Saussurea medusa
MVAVSGNTRVESLATSGIHQIPKEYIRPQHELQTITNIFDEQNDQNAPQLPTIDLNDIHSHDPMTRQRCRDELTKAATEWGVMHLVNHGISGELIDRVKAAGESFFNQPVEEKERYCNDIGSGKIQGYGSKLANNACGQLEWEDYFFSSRLPRGERDLNVWPTTPDDYIPATTEYAKQLRALATKILSVLSLGLGLEEGRLEKEVGGMEELLLQLKINYYPKCPQPELALGVEAHTDVSALTFILHNMVPGLRLFYGGQWVTAKCVPDSIIVHIGDTIEILSNGKYKSILHRGLVNKEKVRISWAVFCEPPKEKIVLKPLPETVFEKEPPLFPPRTFHQHMEHKLFRKNNDIVDPK

SEQ ID NO: 80388 - protein, 132 aa, Zea mays
PSLFLLLQVSKSATTSEMSTVSRASLDQKLALAKRCSREATLAGAKAAAVATIASAIPTLASVRMLPWAKANINPTGQALIVSTVAGMAYFIAADKKILSLARRHSFEEAPEHLKNTSFQGTGRPHPAFFRP

SEQ ID NO: 80389 - protein, 449 aa, Vibrio campbellii AND4
MSAFNVAKFGGTSVANFEAMSRCSTIIKNNPNTRLVVSSACSGVTNLLVELANGVQDQEHRAEVLQKLADIHESILARLQDAAKTATEVYEILDTVTSLAEAASIQASSKLTDHLVACGELMSTHVLAQLMREKGLNAVRFDIRDILKTDGNFGCAEPNVETIAQRAQEKLVPLCQQYVVITQGFIGSDEEGNTTTLGRGGSDYSAALIAEGVKAAGLEIWTDVPGIYTTDPRIASKAAPIPEISFSEASEMANFGAKILHPSTLVPALRHDIPVFVGSSKEPEKGGTWIRHQVESSPLFRALTLRDNQTMVTLRSVNMFHAYGFLAKVFEILAKHKISVDLITTSEISVSLTLDQTDTSGGAPQLPQAVREELEELCKVEVEHDLCLVALIGNNMSECKGYAKQVFGTLEDFNLRMICYGASPHNLCFLVHESVSRQAIQKLHTELFE

SEQ ID NO: 80390 - protein, 752 aa, Guillardia theta
MNRLIVDEINQNADDNSVVYLNSNKIDNLKLFRGDTILIKTKKKKDTVCIIMSDDNCELEKIRINKTVRENLNIGIGDIVTIHHFTDLKFGKRIHVLPFKDSILGYNGNIFEDFLKPYFLDAYRPIKKGDVFNIKSGNNTFDFRVIEIDPVDYCIVGPDTIIFCEGEPLDRLDTVDYEKITYESIGGCQKQLSQIRELVELPLKHPQLFNTVGIKPPRGVLMYGPSGCGKTLIAKAVANETGAFLYSINGPEIMSKLAGESESNLKKAFDEAEKNSPSIIFIDEIDSIAPKRDKSQGEVERRIVSHLLTLLDGINLNSQVVVIACTNRPNSVDQALRRFGRFDREIDISVPDDKGRLEILQIHTKNMLIDNSVDLEAICKETYGFVGADLAQLCTEAALLCIKESIENFDLEEENIPLVVLNSLRVSQDHFKLALDQSNPSAFRETAVEIPNITWEDIGGLENVKRELQETVQYPVEHPEKFEKFGMQPSKGVLFYGPPGCGKTLLAKAIANECQANFISIKGPELLTMWFGESENNVREVFDKARQASPCVLFFDELDSIARARGSSGSDGGGAGDRVINQILTEIDGVGVRKNVFVIGATNRPDILDPAIMRPGRLDQLVYIPLPDRKSRIQIFRATLRKSPLSKEIDLEVLSRATSGFSGADITEICQRACKLAIRESIFKDIQFAKNSESIVSNNEKYIDPVPEITKEHFLEAMKYARRSVSDSDIRKYEMFAQKLQTSRGFSKEIKF

SEQ ID NO: 80391 - protein, 373 aa, Vibrio campbellii AND4
MAIQSFIPPHRILMGPGPSDISPQVLQALSRPTVGHLDPLFIVMMDELKQLLKYAFQTENEFTIAVSAPGSAGMETCFVNLIEKGDKVLVCRNGVFGERMRENVIRAGGEAIVVDDEWGTPVSLDKVEEALKQNPDTKILAFVHAETSTGAVSDAQALGKLAKQYGLLSIVDTVTSLGGVPLKVDEWQLDAVYSGSQKCLSCVPGLSPVTFSSAAIEKIQSRTTPVQSWFLDQSLVLGYWSGEGKRSYHHTAPVNSLYALHEALLMLKNEGLENAWARHQLMHEKLKVGLQKLGFEFVVEEDYRLPQLNAIYVPEGVDEAKVRSHLLETYNLEIGAGLGVLAGKAWRIGLMGYGARPENVALCLRALEESLTE

SEQ ID NO: 80392 - protein, 796 aa, Vibrio sp. Ex25
MFLEKDMQKNTLWFNGLSMDDVDKVGGKNASLGEMVSNLANAGVSVPNGFATTSYAFNQFLDHEGLDERIHQLLDELDVEDVEALRKTGATIRQWVLEAPFPADLEQEIRENYQELIEGNPELSVAVRSSATAEDLPDASFAGQQETFLNVKGIDAVLEATKHVYASLFNDRAISYRVHQGFDHRGISLSAGIQRMVRSDKASSGVMFTLDTESGFDQVVFITSSWGLGEMVVQGAVNPDEFYVHKPMLEAGEHPIVKKTFGSKLIKMIYSDNQEIGKQVDIVDTSDEERNTFSLNDEEIKELAKQAMIIEKHYQRPMDIEWAKDGIDGKLYIVQARPETVCSQTEQNVIERYELQNKADVLIEGRAIGQRIGKGAVRLVDSLDQMSLVQEGDVLVTDMTDPDWEPVMKKASAIVTNRGGRTCHAAIIARELGIPAIVGCGDATSKLTDGATVTVSCAEGETGYVYQGELEFDVKRSSVDELPLLPTKVMMNVGNPDRAFDFAQIPNEGVGLARLEFIINKMIGIHPKALLNFDAQSDELKAEIKQRIRGYKDPIDFYVSKLTEGIATIASAFWPKRVIVRMSDFKSNEYSNLVGGKAYEPHEENPMLGFRGASRYISPVFEDCFELETQAIKRVRNEMGLKNVEIMIPFVRTPSEAASVIDLLAKFDLRRGDQGLKVIMMCELPSNAVLADEFLKYFDGFSIGSNDMTQLTLGLDRDSGDVAHLFDERNAAVKIMLKMAIDAATKAGKYVGICGQGPSDHEDLAEWLMEQGISSVSLNPDTVIDTWLQLGKVSSK

SEQ ID NO: 80393 - protein, 221 aa, Gossypium robinsonii
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRSV

SEQ ID NO: 80394 - protein, 221 aa, Gossypium herbaceum
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVALFGLGAVGLAAAEGARVCGASRIIAVDVNPRRFEEAKRFGITEFVNPKDYDKPVQEVIVEMTGGGVDRSV

SEQ ID NO: 80395 - protein, 354 aa, Vibrio sp. Ex25
MTKNLFRLSTITLGLCISSFSFAQSDLPNIKILATGGTIAGAGQSATESNYTAGKVGVESLISAVPSMTNIADISGEQVVSIGSQDMNDEVWLKLAKRVNELLAQDDVDGIVITHGTDTLEETAYFLDLTVKSKKPVVIVGAMRPSTAMSADGPVNLYNAVVTATDEDSEGRGVLVAMNDTIFDARDVTKTNTTSVSTFQSPNFGPIGYIHNSDAKYQRSPERKHTTETPFDVSKLNTLPKVGIVYNYANASSLPVKAFVDAKFDGIVSAGVGNGNLYHTVFDELEKASKDGVVVVRSSRTPTGSTTLDAEIDDDKYGFVASGTLNPQKARILLMLSLTQTKNYQDIQKMFQYY

SEQ ID NO: 80396 - protein, 536 aa, Zea mays
MGTGGVALVVAALAVVLVTRLWTALAHLVWRPYAVARAFARQGIRGPPYRVLVGNGKEVQAMRAATSGDTLDLASHDYIARVMPQYRAWVSLYGKVFLTWSGSTPALFVGSHDMVKRVLFDKAGLYGKTDPGPTILSLMGRGLVFTDGDDWSRHRRVVHPAFAMDKLKSMTGAMAACAAEVIRGWEARAAASGEEGEPEVTVEVGQQFTELTADVISHTAFGSSYRQGKEVFLAQRELQFIAFASINSGMRVPGTQYAPTKANVRRWQLERTVRGTLMAIIDERLAAAKEAKGYGSDLLGLMLEANAGDGGGKRQQQAMSMDEIIDECKTFFFAGHDTTSHLLTWAMFLLGTHPEWQQRLREEVVRECGGAEVPLSGDALNKLKLVTMVLYETLRLYGAVPLIARRATAGADLCGVKVPKGTLLLIPIAMLHRDEEVWGADAGAFNPFRFRDGMGRAATHPNALLSFSLGPRSCIGQDFAMLEAKATLALILRRFTFRVAPEYVHAPADFLTLQPSKGLPVVLKLLEPAVLVTSSG

SEQ ID NO: 80397 - protein, 410 aa, Hyphomonas neptunium ATCC 15444
MFGSRQKSREKLAAAVRSALGSPEWLESVTVGDDGRAILVIRADSGDAAGAEARRIEAENAASRLAGIEKVTTVLTAEKAPGTGHSHTHSRTNPDTSGQNGTKPDIQMTPSPTAGLRRVTKGARLSDEAMNQGAPPPATAMRPIPGIARILVVASAKGGVGKSTVAVNLAAAMAKAGMKVGLLDADIYGPSIPTMLGTVNAEPGTSPAKKLIPVEAHGMKTLSIGYLSDPDAPMIWRGPIVMSAITQLLNDAEWGTKEDPLDLLIIDTPPGTGDAQLAIAQKVPVTAAIIVTTPQEVALADVRRGAAMFAKTHVPVIGIAETMSWFEDPAGNRHYLMGEGGGAKMAKALGLPLLAEIPMLQAIREAGDAGTPAALTKGPAADVFLKLARSVAIALDELVTKPAPEIVFEE

SEQ ID NO: 80398 - protein, 290 aa, Vibrio campbellii AND4
MIKKCLFPAAGYGTRFLPATKSMPKEMMPVVNKPLIEYGVEEAIQAGMNGMCIVTGRGKHSIMDHFDKNYELEHQISGTNKEELLVDIREIIDSANFTYIRQREMKGLGHAILTGRELIGDEPFAVVLADDLCVNEQDGVLAQMVALFKQFRCSIVAVQEVPEEETHKYGVISGEMIKDDIYRVDDMVEKPESGTAPSNLAIIGRYILTPDIFELIENTEPGKGGEIQITDALLKQAKAGCVLAYKFKGRRFDCGSVEGYIEATNYCFENLYLKDEKKSELGKHVTKKEA

SEQ ID NO: 80399 - protein, 310 aa, Hyphomonas neptunium ATCC 15444
MTAPLPLIIDCDPGIDDAVMLMMALGSPRFDVRAITTVAGNVPLRLTSRNARMMGELMGRPDIPVFAGCPRPMLRPPVTAEDFHGESGIYGIDVFEPKAPLQPSHAVDALIRLLKAAPHKGMTLVVTGPMTNLACALVMAPEIAAHIREIVIMGGADTEGGNITPFAEFNIFADPHAAAIVLETGLPATILSLDATHQVRATQARIDRLAQIPGPRAAMMASLLTAANNLETRARPGTKVPMHDPSTIAWLLAPEMFETVNARVTVTTRPGKEFGRTKVRPMKTGPHRWVTKANADAFFARIEDILRIAP

SEQ ID NO: 80400 - protein, 546 aa, Cytophaga hutchinsonii ATCC 33406
MISIDGLAVAFSGNTLFSDVTFNINDSDRIALMGKNGAGKSTMLKIIAGVDKPTRGKITAPNGAVIAYLPQHLLVKDDSTVFEETSKAFATVLALKKEIDELNHQLETRTDYESDAYMKIIERVSEVSEQYYSIEEVNFDAEVEKTLLGLGFLREDFTRPCAEFSGGWRMRIELAKILLQKPDLILLDEPTNHLDIESIQWLEDFLVNNAKAVMVISHDKAFVDNITNRTIEVTMGRIYDYKVNYSHYLELRKERRQHQQKAFDEQQRFIADTTEFIERFKGTYSKTLQVQSRVKMLEKLEPIEVDEVDTSALSLKFPPAPRSGNYPLIVTELTKKYGDHTVFQNASLTIERGEKVAFVGKNGEGKSTLIKAIMSQIDYEGGLELGHNSMIGYFAQNQASLLDEDLTVFQTVDNIAIGDIRTKIRDILGAFMFGGEASAKKVKVLSGGEKTRLAMIKLLLEPVNLLILDEPTNHLDIKTKDILKEALVAFDGTIILVSHDRDFLNGLATKVFEFGNKRIKEHFEDINGFLRNKKMDNLKEIERKAK

SEQ ID NO: 80401 - protein, 387 aa, Thermosynechococcus elongatus BP-1
MDWATRVMRVTPSVTLAIDAKAKAMRAAGEDVCSFSAGEPDFDTPAHIREAVKTALDQGKTRYGPAAGEPALRQAIATKLNRDNHLPYRAENILVTNGGKQALFNLMLALINPGDEVIIPAPYWVSYPEMVHLASGTPVIVATTPETGYRITPAQLEDAITPKTRLVVLNSPSNPTGMVYTPEEIRELAAVIVRHQLWVVSDEIYEKILYDGAEHLSIGAVSGAAFERTIVCSGFAKAYAMTGWRVGYLAGTTEIVKVATKIQSHSTSNVCTFAQYGALAALEGSQDCVAEMVAAFRERRAYMYAGICEIPRLRCLKPKGAFYLFVDIGDTGIGSVEFCDRLLEEEKVAAVPGKAFGMDDHIRLSYATDLATIEKGLTRLAKFVQRL

SEQ ID NO: 80402 - protein, 311 aa, Magnaporthe grisea 70-15
MATPPSPAPASASELARTTSALRPATPKPAQKKVDAIKYPFCISTSQVRLQTRTGDMPKSMSGTFVHVARHNGVTGLYAGLSASLLRQLTYSTTRFGVYEEVKSRLTERNGGRQPSFPTLVAISAASGFLGGISGNAADVLNVRMQHDAALPVKQRRNYKHAFDGMIRMLREEGGIRSWFRGVLPNSLRAAAMTASQLASYDTFKKLLINHTPLADNLSTHFTASFLAGVTAATVTSPVDVIKTRVMSSTSATSSIPKLVMDIYAAEGMGWMFKGWVPSFLRLGPQTICTFLFLEAHRKMYRRAKLIEEPL

SEQ ID NO: 80403 - protein, 332 aa, Bacillus sp. SG-1
MRGMNYDMKDNFWRELPRPFFILAPMEDVTDVVFRHVVSEAGRPDVFFTEFTNSESYCHPNGRQSVRGRLTFTEDEQPIVAHIWGDKPEFFREMSIGMAKEGFRGIDINMGCPVANVAGNGKGSGLIRRPEVAAELIQAAKAGGLPVSVKTRLGYSEVDEWRDWLTHLLKQDIVNLSIHLRTKKEMSKVDAHWELIPEIKKLRDEVAPDTLLTINGDIPDRQTGLELVEKYGVDGVMIGRGIFHNPFAFEKEKKEHSSKELLDLLRLHLDLYDKYSTEEEPRPFIALRRFFKIYVKGFRGASELRNQLMETQSTAEVRSLLNTFEAENEVLA

SEQ ID NO: 80404 - protein, 450 aa, Colwellia psychrerythraea 34H
MNSIIYPTTNFKHTATLIIERGDGAYVYDSNGKQYLEALAGLWCTSLGYNNHELIETASEQMSKLSFSHMFGGKTHQVGIDLAEKLSAMVPVENAKIFFGNSGSDANDTHIKMLRYYFNAIGKPQKYKIIARERSYHGVTVASASLTGLKPNHTHFNLPFDALGVLRTDAPHYYRNALPNESEAQFIDRIVNNLEQLILLEGADTIAAFIVEPITGASGVIVPPEGYYQKVQAVLQKYDILLWADEVITAFGRTGNDFGCKTVGIEKPAMMTLAKQLSSAYMPISASVIRGDMYDAMVEQSAQVGVFGHGYTYSGHPVSCAVALKTLEIYQRENIFDHAAKIGAYMQKRLHEFIHHPLVGEVRGKGMIGAIELVANKKTGQAFPDGTVGNFAMQACQNNGMICRAVAGSSLAFCPPLIVNKSQIDEMIEKTAKSLDQTLDFVVREGLLVR

SEQ ID NO: 80405 - protein, 222 aa, Vitis vinifera
MSDQVNKHEAQETHVQETQLQQHSVPRLNERILSSLSRRSVAAHPWHDLEIGPGAPQIFNCVVEITKGSKVKYELDKKTGLIKVDRILYSSVVYPHNYGFIPRTLCEDNDPMDVLILMQEPVLPGCFLRARAIGLMPMIDQGEKDDKIIAVCADDPEYRHYTDIKELAPHRLAEIRRFFEEYKKNENKEVAVNDFLPSTTAVEAIQYSMDLYAEYIMQTLRR

SEQ ID NO: 80406 - protein, 616 aa, Glycine max
  misc_feature (159)..(159): Xaa can be any naturally occurring amino acid
  misc_feature (182)..(182): Xaa can be any naturally occurring amino acid
MGMMNVSIAGLDSQMAAERAVDVIGQGYDLCSDIRFSACKNRLIEIEKTQSRDLVFPGGVVVKNVPNSIKCDKGERTRFHSDVLPFNQMSEHFNKQISLSGKIPSGQFNIMFNMKKCWPTDAASTKNLAYDGWFITLYNVELDRTNITLSESVKKNVLXSWNPATFGEFIEKFGPKLIVGCXMGGKDVVHIKQTKNSDLQQAELQKLLKQLADERFSEASNHSSNVDPADKSRKIKDNCAKMWGFKPVPAPGRPVVTSHSKNDDIVSISVRRGGIDNGQSYSQWLSTISQSPSVISMSFVPITSLLNSVPGNGFLSHAVNLYLRYKPAIEELHQFLEFQLPRQWAPMYDDLPLGFGHKYKKSMSPSLQFTLMGPKLYAKMGAPSISYVDSGNRPVTGIRLYLEGKKSDHLAIHLQHLSEVPGALEISEDHGYDPVDEPEERGYYEPVKWSMFSHVYTAPVQYSSSRMDESTAIVTKAWFEVKLVGMKKVLFLRLGFSTVASATIRRSEWDGPSTTSRKSGFFSALMSTRLSKELQSPDQKPNKVDINSAIYNVGPPVPTRVPKMLSFVDTKEMVRGPEDLPGYWVVTGAKLCVEGGRISIKAKYSLLTILSEGCLL

SEQ ID NO: 80407 - protein, 403 aa, Oryza sativa Japonica Group
MQHQQRMKQAAAAAQQQQMMQQIEPIVSGNLPPGFDSSTCRSVYVGNIHLQVTDSLLHEVFQSIGPVEGCKLIRKEKSSFGFVDYYDRRSAAIAIVSLNGRQLFGQPIKVNWAYASTQREDTSGHFNIFVGDLCPEVTDAALFAFFAGFTSCSDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVNSNDVHRFFHSLGVGSIEEVRVTRDKGFGFVRYSTHEEAALAIQTGNGQLIGGRQIKCSWGSKPTPPGTASAPLPPPAPAPFNPGMSATDLLAYERTLALSKMAANPALMSQHAALKQAAAMGMGAGASQAIYDGGYQSANAVFY

SEQ ID NO: 80408 - protein, 278 aa, Triticum aestivum
ISHSCKDLRKFEVSTASCLSDLTAPAPAEAATKITEVRLLSCGLLTSETAISLSSCTNLEVLDLSGCRSIADSGLSSISQLSKLTLLDLAGADITDAGLSALGNGSCPISSLCLRSCRRITNNGIASLLCGSGIINKTLVAFDIGNVPRISGRAVTLIAKNCERISSLCLRNCVLITDPCLETLGLDRHGSGKSTLRMLDLSYCTRLSRNFLRLFDPLVDPPLFRGLRWLGVGKNVLERRGGSPTVAEILERKPGLTICGSNCEMGCRNQCHPDVRTL

SEQ ID NO: 80409 - protein, 324 aa, Vibrio sp. Ex25
METQAIFAAKKAINGLVSRTPLLHSPLLSQQYQCEIWLKLETLQPIGAFKLRGATHAMNKLSEEQKQHGVVTCSTGNHGRAVAYAGQRLGVRTVICMSNLVPQNKVDAIKALGAEVRIVGQAQDDAEREALRLTEEESMTYLSPFEHPDIIAGQGTIGLEIIEDLPDVDVIFAGLSGGGLIGGIGLAAKSNSSKVNVYGVSMDKGAAMVESIKAGKPVQVEEHESFADSLGGGIGLDNRYTFKLVQEVMDKAFLVSEHNIAKGMADIFDAEKFAVEGAAAVGLAAIHQHQLDLRGKKVVLVLSGKNVSSDTFETALKIGRQVKE

SEQ ID NO: 80410 - protein, 468 aa, Vibrio sp. Ex25
MSNKTQQLLEIDRQRVFHASTHLKQYAAGELSGRIISSGSGIRITDSEGIELIDGFAGLYCVNIGYGRTEMADAIYEQAKELAYYHTYVGHTNEALVTLSDRIIKMAPEGMSKVYYGMSGSDANETQLKLVWYYNNARGLPEKKKIISRDRGYHGSSIASGSMTGLPLFHAHFDLPLERIKHTMAPYYYRREDDSMSELEFSQYCADQLEAMILEEGPETVAAMIAEPVLGTGGIVPPPEGYWQAIRKVLDKYDVLLIADEVVCGFGRLGSDFGSLHYDMKPDLITVAKGLTSAYQPLSGVIVGERVWSVLENGTDQWGAIGHGYTYSGHPMGAAAANCNLDIIEREGLVQNAAEVGAYLQQRMAETFNDHPLVGDTRGVGLLHALEFSSDKLRRAHFDPNLKVGPQIAAACLEQGLIARAMPHGDILGFAPPLIANRNDIDTIVDKAHQAVNKVMDNLVTSKQWQPK

SEQ ID NO: 80411 - protein, 421 aa, Colwellia psychrerythraea 34H
MSIDFILPDIGEGIVECELVEWLVKEGEVIVEDQPIADVMTDKALVQIPAMHSGVVEKLYYKQGEIAKVHSPLFAMTPEGDDSTNDIVAAEPEVNAQVDNVKTELVTKEISVPSVAPSSVKGEPAVSNTKTDGSKALASPAVRRVARELDINIHQVEGSGKKGRVYKDDVVAYSQNGSSVIPTVVNGGTSVEPIRGIKKIMATAMQNSVSTIPHFTYCEEIDLTELIALRTELKDVYAKQDIKLTMMPFFMKAMSLAIKEYPVVNSKVNDDCTELTYFNDHNIGMAVDSKVGLLVPNIKQVQTKSILDLANDIMRLTNDARSGRVASEDLKGGSITISNIGAIGGTVATPIINKPEVAIVALGKLQKLPRFNEQGDVEARSIMQVSWSGDHRVIDGGTIARFCNLWKSFLEKPSHMLVHMS

SEQ ID NO: 80412 - protein, 506 aa, Vibrio sp. Ex25
MTALHISHAEELKASHDMMAIMKDVRLVRGLAYVNGKWVSGDQFHPVDNPADGTVIGYITKLSQQQLYQAIDEADQAFRQWRKMQAEERAEILMRWHDLILESKQDLARLMVMEQGKTLGDALGEIDYGASFVRWFAEEARRSYGETIPSHIPNAQLSTVREPIGVAALITPWNFPNAMVTRKAAAALAIGCPVLIKPASETPFSALALAELADRAGFPPGVFNVITGDAVMVSQTLCHSDKVKALSFTGSTRVGKLLLRDAAQTVKKCSMELGGNAPFIVLPDMDVEQAAKAAVDAKFQTAGQDCLAANRIFVPDDKYEAFLEAFAKEMNHIVLGNGLDEKTTMGPLINRAAVDKAHDLVRDALDKGARLVAGYHQPVPGENFFAPTLLADVTPDMAVYREENFCPVAGVLPYQDLDTVIEMSNDTEYGLAAYVYGHDIHQIWRCMRGLEFGMVSVNSVKMTGHPIPFGGVKQSGLGREGSRHGFEEYSEIKYCCLGALPTVSGS

SEQ ID NO: 80413 - protein, 552 aa, Leptospira interrogans serovar Lai str. 56601
MNMPTNKKLSSLKTRSSGNSESSVYDLLVIGGGITGAHVLWDSTLRGMKSILLEKNDYASGTSQATSKMIHGGLRYLKNLELGLVRESLRERATLARITPQAVQTMGILVPLYSNLDRIVLKFGMILYDALSYDRNTNICKDRLIPRYDFLSKEQTLLESPTIEREKLKGAYLYYDYLNINPERHTCEFIFSARERGAEAKNYTEVVSITRSNNSLYTIIAKDRISGKEIVYKTRAVINAAGPWADFIESLVGVEIDKHLIRSKGIHVVTRKIGGDKILVTKKKDGTHLFVIPWRNKTIIGTTDTEYADHPDHFRVTKKDIEELLSEINNSFGYTNLTLKDVDFYYGGLRPLVEDSGEGGSTYNTSRKTEIIDHRDLGFPGFFTAMGGKYTTSRGVAEEVVNKVADYLPGNFRVCETSSVPPSSGNYSDLVSLIKDLQKKFAKFNGELIETLAFRYGSQSYRILEKSKPEEEFYILQNGEKFYESEVKFITNREDIRFATDFFFRRSGVGVPGLLEEQEMNRLFRSLGRHLGWNQNQIRQEIKTVKDRYKIY

SEQ ID NO: 80414 - protein, 172 aa, Malassezia sympodialis
MSATTGSQAPNTTFTYIPWAPELDSGKVCGVPQTFKAHDRWKGKKVVVVAIPGAFTPACHQNHIPGFVEKINELKAKGVDEVVVIAVNDAFVMSGWGVTVGGKDQIVYACDNDLAFSKALGGTLDLTSGGMGVRTARYAVVLDDLKITYFGMDEGNMGAPEKSSVDAVLAQL

SEQ ID NO: 80415 - protein, 162 aa, Malassezia sympodialis
MSNVFFDITKNGAPLGTIKFKLFDDVVPKTAANFRALCTGEKGFGYAGSHFHRVIPDFMLQGGDFTAGNGTGGKSIYGAKFADENFQLKHNKPGLLSMANAGPNTNGSQFFITTVVTSWLDGKHVVFGEVIDGMNVVKAIEAEGSGSGKPRSRIEIAKCGVC

SEQ ID NO: 80416 - protein, 302 aa, Clostridium thermocellum ATCC 27405
MIYDDMQQLIGNTPLVRLRHSGFPDGVRVYAKLELYNPSGSVKDRIGKYMIEDAEKRGVLVPGSTIVEGTAGNTGLGIAFAALNRGYRLIMVVPTKFSQEKQALLRALGAEVINTPREEGMLGAERKAEELRQSIPKAVSLEQFRNPANPLAHYETTGPEIWEDLGADIDYFVAGAGSGGTYAGIVRYLKEQKPDIKGILADPIGSTMGGGEHGDYDIEGIGNDFIPETMDMSLVDEVIKVSDDEAFTETRLLARNEGIIAGSSSGANLAAVRKLAMRIQRGTIVTVLPDRGERYLSKNLFL

SEQ ID NO: 80417 - protein, 263 aa, Xanthomonas campestris pv. campestris str. ATCC 33913
MLLSLFVVDAFTCVRFKGNPAAVVPLQAWLPVPVMQAIAAENNLSETTFFVRDHAGVFDIRWFSPLKEVGFCGHATLASAYVIARQQLAPFPLRLRAPAVGEIGVEQVDEATFEICFPNQLPTLVTQVPAPLLAALSIAPQAVYANAQAYIGVYADEQQVRAVVPDLAQMLALAPRDVAITAPGATHDLVSRYFWPANGGAEDPVTGSIHAALAPLWARTLGKTDLRALQASARGGELACRVTPAHVYVRGSAVHYLRGEITL

SEQ ID NO: 80418 - protein, 457 aa, Arabidopsis thaliana
MEEKSKYLSLVGAGALIGSISTVALLKLLSRSSLKQLNENPETNFLAGNGIESETRPDTVANGQDLLKDEIVSEHLTRNIQFFGLESQHKVTGSYVVVIGLGGVGSHAASMLLRSGVGKLLLVDFDQVSLSSLNRHAVATRADVGIPKAMCLKKHFSSIFPECHIEAKVMLYDSSSEEEILSGKPDFVLDCIDNIDTKVGLLAACVKRGLKVLSATGAGARADPTRIRVADIRESTIDPLSRSVRHRLRRKHGIEGGIPVVFSLEKPKAKLLPFEGTNGEDENPLDYQVVPGFRVRIIPVLGTIPAIFGQIMASYVITQLAGVQVQMEPIVNLDLDHYRLLHQRLIEHEETVYGTSAEVEVDVEEVMYIVKELWHGRSARDETAKDVGRGMWRAMNELMLVRWDAKKPATVSNLVLLKFKEADEHETKTLEEVKESETEFFERVSCVLKKAELDFYG

SEQ ID NO: 80419 - protein, 255 aa, Leptospira interrogans serovar Lai str. 56601
MLSEIKNDHILELYIETNEVNSLNVEFFKTFSAKLDLIAKDQSIKSVILTSKNEKFFSNGFNPEIFVDKSSEEIKNVMRIALETASKYLFLDRPVVCAMNGHSMGLGAVFAIFSDYRIMVEKKGRLGFPESQIGINFPAVAGFMLKEVVGITKARDLLYSGKALKAEEALEIGLIDEVASSSDDLITRARKYCDQFKNMAIGSVVGIKVSLRDPVRIFAEHNAERDVELISKAIFSKNGQEGMKSILEKRRPVFQ

SEQ ID NO: 80420 - protein, 231 aa, Thermosynechococcus elongatus BP-1
MSAKPVVIAPSILSADFSRLGEEIQAVDRAGADWIHVDVMDGRFVPNITIGPLIVEAIRPLTQKPLDVHLMIVEPEKYVADFAKAGADIISVHAEHNASPHLHRTLCQIRELGKQAGVVLNPSSPLELIEYVLEVCDLVLIMSVNPGFGGQKFIPAVLPKIRRLRQLCEERGLDPWIEVDGGLKVDNTWQVLEAGANAIVAGSAVFNAPDYAAAIAGIRNSKRPSPELVTA

SEQ ID NO: 80421 - protein, 369 aa, Xanthomonas campestris pv. campestris str. ATCC 33913
MKSRAAVAFGPGKPLEIVEIDVAPPQAGEVLVRITHTGVCHTDAFTLSGDDPEGIFPSVLGHEGGGIVEQIGEGVTGVKVGDHVIPLYTAECRKCKFCLSGKTNLCQAVRATQGKGLMPDGTTRFSYNGEPIFHYMGCSTFSEYTVVPEISLAVVNPEAPLEKVCLLGCGVTTGIGAVHNTAKVKPGESVAVFGLGGIGLAVIQGAVQAKAGRILAIDTNPGKFDLARSMGATDCINPKDYDKPIQEVIVELTDGGVDFSFECIGNVNVMRSALECCHKGWGESVIIGVAGAGQEISTRPFQLVTGRVWRGSAFGGVKGRTQLPGMVEQSMKGEIDLDPFITHTMPLEQINEAFDLMHEGKSIRTVIHF

SEQ ID NO: 80422 - protein, 135 aa, Oryza sativa Japonica Group
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNIHQHLLPKKAGSSKASHADDDDN

SEQ ID NO: 80423 - protein, 197 aa, Erwinia carotovora subsp. atroseptica SCRI1043
MQLKRVAEAKLPTPWGDFLMVGFEEIATGHDHLALVYGDISGSVPVLARVHSECLTGDALFSLRCDCGFQLEAALGHIAEEGRGVLLYHRQEGRNIGLLNKIRAYALQDLGADTVEANHQLGFAADERDFTLCADMFKLLDVDEVRLLTNNPQKVKILNEAGINIVERVPLIVGRNPKNEHYLATKAAKMGHILDMK

SEQ ID NO: 80424 - protein, 126 aa, Vitis vinifera
MAQKRENEQATETELKVPETLTLCVQTCGFSASDKPRSRSPSPPDDPDSTLENSDQGAVRRREVNRCSGCKRKLGLIGFRCRCGEMFCSKHRYSDRHECRFDYKAAGREMIAKENPVVRPAKILKV

SEQ ID NO: 80425 - protein, 719 aa, Neptuniibacter caesariensis
MLFDGQTIQVKPIEDGIYDVVFNRKEDAVNKLDQATLAELREAVTMLAGTEGIRGVIFSSAKDSFIVGADITEFMQMFSATEEEIVEGLLSIHQIFNAIEDLPCPTVAAINGLALGGGFEVCLATDYRVLANNAKVGLPEVKLGIFPGWGGTVRLPRLIGVDNGNEWVCGGVEKRADAALTDGAVDSVVAPDQVAAAALDLIKNCNAGKFDYAARREEKKSPIKLNQIEQMMAFESAKGVIGGKAGPHYPAPMAALKAIQKHANLPRDKAIEVEAKGFVKVAKTEVCASLVGLFMKDQYVKKVSKSFESKAEPVKKAAVLGAGIMGGGVAYQSASKGTPILMKDINDAALDLGLDEATKLLNKRVSRGRMDAMKMASVLNKITPTLNYGDFGSVDLVVEAVVENPNVKKAVLAEVEGELPEGAVLTSNTSTISITELATALKKPENFCGMHFFNPVHQMPLVEVIRGEKTSEEAVARTVAYAKAMGKTPIVVNDCPGFLVNRVLFPYFGGFSALVSDGANFQQIDKVMERFGWPMGPAYLLDVVGIDTAHHADAVMAEGFPDRMTHEGENAIDRMYKLERFGQKNSKGFYRYELDRKGKPKKLADEEVPALLADVVAEPREFSDEEIIARMMIPLCIETVRCLEDGIVATPAEADMGLIYGIGFPPFRGGALHYLDQMGLDKFCEMAKQYEALGPLYQPTEKMKQMAASGEKYFSGEKA

SEQ ID NO: 80426 - protein, 253 aa, Bradyrhizobium sp. ORS278
MDQTDQTTHFGFRDVPLGEKQTLVNDVFHSVASRYDLMNDLMSGGLHRVWKDIMINTLNPPKSDAPFALLDVAGGTGDISFRAAKKAGAGFHATVCDINGDMLEVGRQRALKQYLDDRVSFVEGNAESLAFPDRSFDAYTIAFGIRNVPQIDLALAEAYRVLKHGGRFLCLEFSTVEVPGLDKLYDLFSFNVIPQLGRAVTGDAESYRYLVESIRQFPRPNAFAEMISAAGFSRVSWQTLSGGIVALHSGWRL

SEQ ID NO: 80427 - protein, 314 aa, Erwinia carotovora subsp. atroseptica SCRI1043
MSSAEHLATVMVEQFIKAVEQGIDLVPVLADSTSTAKISPFIQRFPDRIVNVGIAEQTMVGTAVGLSIGGKIAVTCNAAPFLISRANEQLKVDVCYNNSNVKLFGLNAGCSYGPLASTHHSIDDIAVLRGFGNIEIYAPSSPEECRQIIDYAFAHQGPVYIRLDGKPLPALHDEHYRFVPGQIDVLRKGCDITLVGLGSTVHEIVTAAELLAEKGLAATVVNLSSIRPCNTQQLLEILSETPRVITVEEHNVNGGAGSLVAEVLAEAGSGIPLVRLGIPDGQYAIAADRSAMRAHHGLDAMGIVNAALRLCPGG

SEQ ID NO: 80428 - protein, 480 aa, Cryptococcus neoformans var. neoformans JEC21
MTEDIYKDDLYGDLDLEDLDASQLEELVEPPELDTAPTSTPAASNAAAAPSQPAITASSSTSAPVEPGSQQYDHQPSYDAATPYQQGQQDNNFGQQQDGQDRIKPSDMPDEGKMFIGGLNWETTEAGLSEYMGQFGEIDACTIMRDPSGRSRGFAFLTYRDPASVTKVMAQTHHLDGKQIDPKRAIPRAEHERTAKVFVGGLAPSVTGESLKSFLCQFGQVMDATVMFDKETGRSKGFAFATFQDEESVGRAMAASGVELEGKQIEIKKAQPRGTAQGSKFGGNMNPRFNQGTGFSGGMGSFGGGFDPSSVAMMYQNMMKTGGNMMGGFDPSAMAMMYQNMMKSMGNAPAINPSLAMRNNAGGTTAGAAAGGAMPMGMGMGAMGGMGGMGGMGGMGGMGMGGMGMGGMGMGGMGGMGGMGMGGGMNRMGNTRQIPNAPRGPAAMRGPGQQPMGGAGNAPQGGGPGAQRYSTQGNARARPY

SEQ ID NO: 80429 - protein, 172 aa, Sulfolobus tokodaii
MKLSPGKKAPDEVNVLIEIPLGSNIKYEYDEEEEVVKVDRILYTSMVYPFNYGFIPGTLEEDGDPLDVLVISNYPLLPGTAIEVRPIGILYMRDEEGEDAKIIAVPKDKVDPTFSNIKDIIDLPQAIKDKINHFFEHYKELEPGKWVKISGWGGVSEAKTRINEAIKRANSK

SEQ ID NO: 80430 - protein, 505 aa, marine gamma proteobacterium HTCC2080
MVYANPGSEGAVVQFKPQYENYIGGQWVAPVDGSYFDNVSPVNGEPFCKIPRSSEADINLALDAAHSAKDAWGATPATERSNLLLKIADRIEANLEMLAVAETWDNGKAVRETLAADLPLCVDHFRYFAGCIRAQEGSMAEIDPTTVSYHVYEPLGVVGQIIPWNFPLLMACWKLAPALAAGNCTVMKPAEQTPASICILMELIGDLLPPGVVNIVNGYGTEAGQALATSTRIAKIAFTGSTAIGHHILRCAAETMIPSTVELGGKSPNVFFADVMDQGEDFISKAVEGLVLGFLNQGEVCTCPSRALIHEDMYEPFMEMVIERAKKITRGNPLDVNTMVGAQASREQFDKIMSYLQIGREEGAEILIGGDIEQVEGLGGGFYIQPTFFKGDNKMRVFQEEIFGPVIGITTFKTEEEALAIANDTEYGLGAGVWTRDTNKAYRMARGIQAGRIWMNCYHAYPSHAAFGGYKKSGIGREGHKVTLDHYQQKKNLLVSYGDSPLGFF

SEQ ID NO: 80431 - protein, 415 aa, Cytophaga hutchinsonii ATCC 33406
MDILTVITVLIIISALFSYINERFFKMPAMIGVMTISVMVSLAVLIIGKIGDERFNVITRLAYNIDFSKVLLDVMLGFLLFAAALQLDNKKLNVLKRPVFILSTLGVLVSAGTFGAMFYGLSLLLNIHIPLIYCFTFGAIISPTDPIAVGSILKKTKIPARLETIISGESLFNDALGLILFVTLLGVAKQTGPDISFTETLQVFVKEVLGGILLGLTFGVVGYQLIKPIRDYQTIFLISVAVVLGISLVGSRLHASIPLAAVVAGLMIGNDKFSKEHEGSEFFNSIWHLMDEVLNTILFVMIGLQLLVLPFLADYWLIGACSIIIILLARMMSVTLNAFFELRRINLTSLSILTWAGLRGGISIALALSLPNSAYKEIILSCCYCIVIFSVLVQGLTLNKVVNTVVGPKEENEHL

SEQ ID NO: 80432 - protein, 154 aa, Oryza sativa Japonica Group
MACAFSVSSAAAPLASPKGDLPLVGNKAPDFEAEAMFDQGFIKSKCMFVSSAEITAFSDRYEEFEKINTEVLGVSIDSVGIALRGLFIIDKEGVIQHSTINNLAIGRSVDETLRTLQALQYVQENPDEVCPAGWKPGEKSMKPDPKDSKEEQEC

SEQ ID NO: 80433 - protein, 421 aa, Arabidopsis thaliana
MEEENVTSSPSTPVHRLRHRRRSNEVVTDGDKVNASPLLVNDRNKYKSFMVRTYSTLWMIGGFVLVVYMGHLYITAMVVVIQIFMAKELFNLLRKAPEDKCLPYIKQLNWHFFFTAMLFVYGRILSQRLANTMTADQFFYRLVSGLIKYHMAICYLLYIIGFMWFILTLKKKMYKYQFGQYAWTHMILIVVFTQSSFTVANIFEGIFWFLLPASLIIINDIFAYIFGFFFGRTPLIKLSPKKTWEGFIGASVTTIISAFVLANILGRFPWLTCPRQDLSTGWLQCDADPLFKPEPFALPAWIPEWFPWKEMTILPVQWHALCLGLFASIIAPFGGFFASGFKRAFKIKDFGDSIPGHGGITDRMDCQMVMAVFAYIYLQSFIVSQSVSVDKILDQILTNLTFEEQQALFVKLGQMLKDKLS

SEQ ID NO: 80434 - protein, 346 aa, Arabidopsis thaliana
MEIDSATNGNSDTVMTESAATITPSPVVVSSSRSNQFTESLKLEHQLLRVPFEHYKKTIRTNHRSFEKEVSTIVNGVGELADSDWSKDDTVSRLTCLVTRLQGLKRKLEEGSNVENLQAQRCRARIDHLDSVDVENITEWNNTKLKRILVDYMLRMSYFETATKLSESSNIMDLVDIDIFREAKKVIDALKNREVASALTWCADNKTRLKKSKSKFEFQLRLQEFIELVRVDTAESYKKAIQYARKHLASWGTTHMKELQHVLATLAFKSTTECSKYKVLFELRQWDVLVDQFKQEFCKLVCAENSIWFRRRLYQRGPSLTRELSEASFAFTVLQAAPFKACLLYF

SEQ ID NO: 80435 - protein, 445 aa, Solanum tuberosum
MFGRAPKKSDNTKYYEILGVPKTAAPEDLKKAYRKAAIKNHPDKGGDPEKFKELAQAYEVLSDPEKREIYDQYGEDALKEGMGGGGGGHDPFDIFSSFFGGSPFGGGGGSSRGRRQRRGEDVVHPLKVSLEDLYNGTSKKLSLSRNVLCSKCKGKGSKSGASMKCSGCQGSGMKVTIRQLGPSMIQQMQHPCNECMGTGEMINDKDRCGQCKGEKVVQEKKVLEVVVEKGMQNGQKITFPGEADEAPDTVTGDIVFVLQQKEHPKFKRKGDDLFVEHTLKLKPRPCVGFQFIFLTHLDYRQLIIKPQPGEVVKPDQFKAINDEGMPMYQRPFMRGKLYIHFTVEFPDTLSPEQCKNLEAVLPPKPKTQMTDMELDECEETTLHDVNIEEEMRRKQQQAQEAYDEDDEDMHGGAQRVSMCTTVIWHHGSCTKELTSRFNSCFHVFV

SEQ ID NO: 80436 - protein, 207 aa, Xanthomonas campestris pv. campestris str. ATCC 33913
MSLLIEQARYHLSAHNARQLPDDGGYEVAFAGRSNAGKSSALNALTRQNSLARVSKTPGRTQQLVFFQIQPERYLVDLPGYGYAKVPQDLQAHWQAFIDRYFRTREALRGLVVVMDIRHPLKDYDLQMLGYAAERGLPAHGLLTKADKLGRGQQMQTLQKVKKEVSSRFGDSVTVQTYSGESRQGVDELRGIVGGWLGLDVEPPADA

SEQ ID NO: 80437 - protein, 159 aa, Bacillus sp. SG-1
MNISIVTVGKLKEKYLKQGIDEYLKRLSAYAKVEIIEVSDEKAPEELSETEMAQVKGKEGERILSKISPDAHVIALAIEGKMRTSEDLADNLDKLATYGKSKVTFVIGGSLGLSDEVMKRANETLSFSKMTFPHQLMRLFLVEQVYRAFRINRNEPYHK

SEQ ID NO: 80438 - protein, 288 aa, Thermosynechococcus elongatus BP-1
MRVLILGCGYTGTWLARSLHAQGIDVVMTNRRGEPPPELSTLPCFPFKWEQQGEQLPLAPAALEGVTHVLNGIPPDRQGEDAVALALLPQLEKLNLHWFGYLSTTGVYGDRQGGWVDETTPVNPQNLRSQHRVRIEQVFLNANLPTHIFRLPGIYGPGEGRNPIARILKGDVQLIDKPGHYFCRIHVADIVQTLERSLAQPTPQEIYNLSDDQPSESLPVLLEAYRLLGRPAPPAIPLEAANLSPMAQSFWRESRRVRNDKIKQALGVQLRYPSYREGLRAIARELGL

SEQ ID NO: 80439 - protein, 415 aa, Colwellia maris
MTNKIIIPTTGDKITFIDGKLSVPNNPIIPYIEGDGIGVDVTPPMLKVVNAAVAKAYGGDRKIEWLEVYAGEKATKMYDSETWLPEETLNILQEYKVSIKGPLTTPVGGGMSSLNVAIRQMLDLYVCQRPVQWFTGVPSPVKRPSEVDMVIFRENTEDIYAGIEYKAGSDKAKSVIKFLIEEMGASNIRFTENCGIGIKPVSKEGSQRLVRQAIQYAIDNNKDSVTLVHKGNIMKFTEGAFKDWGYELAIEEFGASLLHGGPWCSLKNPNTGKEIIIKDVIADAMLQQVLLRPAEYSVIATLNLNGDYLSDALAAQVGGIGIAPGANLGDEVAVFEATHGTAPKYAGKNKVNPGSVILSAEMMLRHMGWLEADLLLKGMSGAIQAKTVTYDFERLMDDATLVSCSAFGDCIIDHM

SEQ ID NO: 80440 - protein, 313 aa, Carboxydothermus hydrogenoformans Z-2901
MSRYDLKIFSGNANPDLAREIASFLGVEVGDARVSRFSDGEIQVKINESVRGADVFIIQPTCTPVNENLMELLILIDAIRRASARRITAVLPYFGYARQDRKTRARDPITAKLVSNLITVSGARRVIAMDLHAGQIQGFFDIPVDHLVGVPILAKYFNEKGLENKVVVSPDLGGVTRARDLAERIGAPIAIIDKRRPEPNVAEIMNIIGEIEGKTVIMIDDIIDTAGTITQGAQALMERGAKEVYVCCTHPILSGPAVDRLANAPIKEVVVTNTIPLPPEKKLPKIKVLSVAPLMGEAIRRIHEDLSVSELFV

SEQ ID NO: 80441 - protein, 496 aa, Legionella pneumophila str. Paris
MLLKAESKYPCDLILFGTLGDLSCRKLLPALYQLELANLLHEKTRIIGCAREELDFSAYADLIKNKIQQFLFDEIDEAVWLRFIKKLAYCKLDLNQSDDYQKLTGYVNPSERVVISYLAIPPSLYSQTCRSLARLNLTQKPSRVVLEKPIGHDLPSSVATNEQVACFFSEDQIYRIDHYLGKETVLNLLVLRFANSIFSTNWDNRVIDRVEISVAEEIGVEGRWEYYDKSGQVRDMLQNHLLQILSLVAMEPPLSLSAESIRSEKLKVLKSLRFINKSNAHDHTVRAQYVANNLANGKKIPGYLEEVGANQASTTETFVAIKAYVDNWRWSGVPFYMLTGKRLPKKQSEVVIYFKPQPYNIFHPLNEELYPNQLIIRLQPDEGVEVRIMNKIPGLGERMMLHDSKLDLNFHHSFKTQRIADAYERLLLEVMLGNQYLFVSREEIEQAWQWIDSIVSAWEEDNIPLYTYPACTWGPKEVIRLFNGQAHVWGDHNAVS

SEQ ID NO: 80442 - protein, 232 aa, Triticum aestivum
  misc_feature (202)..(202): Xaa can be any naturally occurring amino acid
  misc_feature (225)..(225): Xaa can be any naturally occurring amino acid
MAFSSLSTPSSSSPSSSFTLPTKPSPGAGSLSFSRASAGRFRMAAVRAQAEAVDTSISPRVSALRPSKTMAITDMASALRQAGVPVIGLAAGEPDFDTPAVIAEAGINAIRDGSTRYTPNAGTMELRKAICNKLQEENGLTYSPDQVLVSNGAKQCITQAVLAVCSPGDEVLIPAPFWVSYPEMARLAGATPVILPTSISNXFLLKPESLASVITEKSRLLILCXSSNPTGS

SEQ ID NO: 80443 - protein, 312 aa, Rhodococcus sp. RHA1
MTQHRITSPFGAASTAAEVLEGIDLRGKRSIVTGASSGIGLETARALATAGADVTIAVRNPDAGRGVADDINTALGQERVAVRTLDLADLSSVHRFAEQWGSTALDVLINNAGIMATPLGRTRSGWESQFATNHLGHFALANALHDALAHANGARIVSLSSRGHLSSDIVFDDINFDNREYDPWLAYGQSKTANVLFAVEATRRRAHDGITANALHPGGIWTNLTRHLPENVYNSLRADPTAEYKSPQQGAATSVFVATSPLLRGIGGRYFEDSNQAVRYVGGPERVGVADYALNPESAQRLWTLSLAAVDG

SEQ ID NO: 80444 - protein, 162 aa, Zea mays
MKEGGEKKNILSKTLQRCRTSLAQRRRPPPPAAPKRAASSPSLGVPPPPPVPAAGYFTVLVGPEKERFGVRARCANHPLFRALLDAAEAEYGFAGCDGPLELPCAVDDFMEVMWEMELGDPSASPGCGRFAAGSTRGYHHVHQLAGYQLVVSPPARFLVAGR

SEQ ID NO: 80445 - protein, 364 aa, Psychrobacter arcticus 273-4
MSMMKSLIFIEPGKIEVAEKKIPDVGPNDALIKITTTTICGTDIHIFKGEYPVAKGLTIGHEPVGIIEKLGSAVMGYQEGQRVIAGAICPSFTSYASQDGFPSQDGGYIQPDGTCACHGYKATGGWRFGNIIDGTQAEYVLVPDAQANLAPVPDGLTDEQVLMCPDIMSTGFKGAENANIKIGDIVAIFAQGPIGLCATAGAKLRGASTIIAIDGNNERLAMSKKLGADITLNFKEVDVVDEIMKITGGRGVDSSIEALGLQSTFEQGIKVLKPGGTLSSLGVYSADLKIPMAYFASGLGDHTIRTALCPGGKERMRRLLNVVESGRVDFSEMVTHTYALDDIVEAYDLFMHQRDGVLKIAIKP

SEQ ID NO: 80446 - protein, 170 aa, Triticum aestivum
AYLGDFQNKVVQKSSLVPVRNSRDIVDPRVRNPATQNLCQNCFLASSSSPSPSAASPQSPSSSPAAFPLFDKPRPAAAASPLQAAPVYMAVDRPAAGPADPKASKSSVNRCHNCRKRVGLTGFRCRCGEMFCGAHRYSDRHDCSYDYKSAARDAIARENPVVRAAKIVRF

SEQ ID NO: 80447 - protein, 522 aa, Vibrio sp. Ex25
MGFTSLGLSAPILKAIQEKGYDTPSPIQAKAIPAILEGKDVMAAAQTGTGKTAGFTLPILERLSNGSRVRANQVRALILTPTRELAAQVQENVFMYGRHLPLSSAVVFGGVKINPQMQRLRKGADVLVATPGRLMDLYNQNAVKFDQLEVLVLDEADRMLDMGFIRDIRKILALLPKQRQNLLFSATFSDEIRDLAKGLVNNPVEISVNPANSTARTVEQSIYPADVKKKAPMLVKLIKDGDWKQVLVFTKTKHGANRLAKFLIEQNLPAAAIHGNKSQGARTKALADFKSGEIRVLVATDIAARGIDIPQLPQVVNFELPKVAEDYVHRIGRTGRAGEVGKAISLVCALEASELFAIERLIQEVLPRKELEGFAPTNVVPESKLDTRPIKPKKPKKPKKPKAPNAAGENAPATEKKAGNGANKPKRRFNGGNNGNKNSTNQGGAGKPKSNSEGQGRTNSKPDDRKPNGNKPNGNKPNGNKPNGSKSGNAGKPSGNRKPNNAKPAGNKPSGQRRKPRPQTAN

SEQ ID NO: 80448 - protein, 174 aa, Thermus thermophilus
ANLKSLPVGDKAPEVVHMVIEVPRGSGNKYEYDPDLGAIKLDRVLPGAQFYPGDYGFIPSTLAEDGDPLDGLVLSTYPLLPGVVVEVRVVGLLLMEDEKGGDAKVIGVVAEDQRLDHIQDIGDVPEGVKQEIQHFFETYKALEAKKGKWVKVTGWRDRKAALEEVRACIARYKG

SEQ ID NO: 80449 - protein, 490 aa, Xanthomonas campestris pv. campestris str. ATCC 33913
MPRFPDQLLYIGGRYVPARGGHTFEVVNPATGEVLANVHNADADDLDAAVDSAKAGQRHWAALTVVERSRILLRAVALLRERNDALAELETLNTGKPLSETRSVDIVTGADVLEYYAGVAQALQGVQVPLREGSFFYTRHEPLGVVGAIGAWNYPIQIALWKAAPALAAGNAMIFKPSEVTPLTALKLAEIFTEAGLPDGVFNVLPGDGASVGHALTEHPEIEKISFTGGTATGRKVMASASSSSLKDVTMELGGKSPLIVCADADLDLAADIAMMANFYSSGQVCTNGTRVFVPRALRTAFEARLLARVQRIHIGDPLDERTTFGPMVSAAHMQRVLEHIEQGKAEGARLLFGGERLRDGALAQGCYVAPTIFSDCTDVMTIVREEIFGPVLSLLTYDDEDEAITRANATSYGLAAGVVTPDLSRAHRLIHRLEAGICWINTWGESPAPMPVGGYKQSGVGRENGLATLQAYTRTKSVQVELERYASVF

SEQ ID NO: 80450 - protein, 385 aa, Brevibacterium linens
MRLPGLSALGWSNTSLSSSRSLPNTSSKLKTMTDSATPIGDIAFSFEDRLAQVLAEARKRSRTVSAQYGQLWDSLTHMATGGKLIRPRMLLDAHAALGGRDEHAAVDAACAMQLLHIALVIHDDVIDNDTIRRGEATISGEFASEAMSRGALRRDANAWGIATSILGGDLILTLSHSLLARLDIEDTKRRAILDIFDDTVVESAAGEHSDVWLSLHLEGANSPDVLAMVDQKTAVYSFQAPLLIAAVLAGADSGLIDDLANISRQIGVIYQLRDDVLGLFGDERETGKSNVSDLREGKETLLITFARSDPSWPEVHTLFGDRMLSNADGDRLRKVIEESGALVFVESMITQRCENLYRLIGEAALPPALSNQLIQLTSDASSRTA

SEQ ID NO: 80451 - protein, 286 aa, Arabidopsis thaliana
MEGKEEDVRVGANKFPERQPIGTSAQSDKDYKEPPPAPFFEPGELSSWSFWRAGIAEFIATFLFLYITVLTVMGVKRSPNMCASVGIQGIAWAFGGMIFALVYCTAGISGGHINPAVTFGLFLARKLSLTRALYYIVMQCLGAICGAGVVKGFQPKQYQALGGGANTVAHGYTKGSGLGAEIIGTFVLVYTVFSATDAKRNARDSHVPILAPLPIGFAVFLVHLATIPITATGINPARSLGAAIIYNKDHSWDDHWVFWVGPFIGAALAALYHVVVIRAIPFKSRS

SEQ ID NO: 80452 - protein, 156 aa, Zea mays
RQCVIVSPDAGGAKRVTSIADRLNVDFALIHKERKKANEVASMVLVGDVKDRTAILVDDMADTCGTIVHAVTKLKESGASKVYAILTHGIFSGPAIPRVNSACFEALVVTNTIPQESNMLQCPKIQCIDVSMILAEAIRRTHNGESVSYLFSHVPM

SEQ ID NO: 80453 - protein, 286 aa, Arabidopsis thaliana
MEGKEEDVRVGANKFPERQPIGTSAQTDKDYKEPPPAPFFEPGELSSWSFYRAGIAEFIATFLFLYITVLTVMGVKRAPNMCASVGIQGIAWAFGGMIFALVYCTAGISGGHINPAVTFGLFLARKLSLTRAVFYIVMQCFGAICGAGVVKGFQPNPYQTLGGGANTVAHGYTKGSGLGAEIIGTFVLIYTVFSATDAKRSARDSHVPILAPLPIGFAVFLVHLASIPITGTGINPARSLGAAIIYNKDHAWDDHWIFWVGPFIGAALAALYHQLVIRAIPFKSRS

SEQ ID NO: 80454 - protein, 495 aa, Triticum aestivum
MGRLPAASRRLAAVAVAILLLVIASAAGAAEERGQRGVAVLQGEGRGSHHRHAYAAMMYMGTARDYEFYVAVRVMMRSLSRVGADADRVLIASSDVPLDWVRAMREEDGMRVVVVENLKNPYEGNLGGMNRRFKLTLNKLYAWSLVDYERVIMIDSDNIFLQNTDELFQCGQFCAVFINPCYFHTGLFVLQPSMDVFNGMLHDLEIGRDNSDGADQGFLVGCFPDLLDKPLFHPPENGTKLNGTYRLPLGYQMDASYYYLKLHWHVPCGPNSVITFPSAPWFKPWYWWSWPILPLGLSWHKQRWDDLGYAAEIPVVLMELLMYITIIAVTRLARPQMTKLCYNRRPEKQGALLQWLIKLAGIVAMVAAYAIPFFVIPCTVHPIMGWSMYLFGVLAFSTVVINAFLLPPLAVLTAWLGIVGMLFVMAFPWYQDGIARILVVVAYAFCSAPFLWASIVRVMDSLQTMLERDPHFPRLGDPAPETEFSKSVPDSFVKV

SEQ ID NO: 80455 - protein, 382 aa, Carboxydothermus hydrogenoformans Z-2901
MQKKYLMIPGPTPIPPEVTLAMSRPMIGHRSGDFAKLHERVVAKLKQVFKTQNDIFILTNSGTGGMEMAVANVVNPGDEVLALSTGNFGERFAKIAKEYGAKVDMVDFGWGNAVDLAVVEEKLRQNPNYKAVLATHNETSTGVKNDIAGIAALTKNHRAVLIVDAVSSLGGMEFDTDGWGVDVVVTGSQKALMLPPGLAFISFSQKALEAAQDNKNPKFYFSLPAAKKALAEWNTAYTPAVSLFFGLEAALDLILEEGLDKVIKRHKLLAKACREGVKALGLKLFPAEENASDTVTAVAGDDRYDPEQLRKVLRTKYGVTFAGGQKDLKGKIFRIGHMGYVDKLDIIVAIGALEMALKEIGYPVELGAGVKKAMEVITGGEA

SEQ ID NO: 80456 - protein, 244 aa, Neptuniibacter caesariensis
MLQNSEGKNIPQVTFHTRQGNDWVDVTSEQLFKGKTVIVFALPGAFTPTCSSTHLPRYNELAPVFAANGVDEIICLSVNDTFVMNAWAEDQKAENVTFLPDGNGEFSEAMGMLVDKDELGFGKRSWRYSMLVKDGVIDKMYIEPDLPGDPFQVSDADTMLDYINPQAEQPKRVTIISKPGCPHCTRAKNVLTENGYKYEEIELGTNGVSFSSLQAVTGRGTTPQIFVDGELVGSADELEAWVAK

SEQ ID NO: 80457 - protein, 285 aa, Arabidopsis thaliana
MAKDVEGPEGFQTRDYEDPPPTPFFDADELTKWSLYRAVIAEFVATLLFLYITVLTVIGYKIQSDTKAGGVDCGGVGILGIAWAFGGMIFILVYCTAGISGGHINPAVTFGLFLARKVSLIRAVLYMVAQCLGAICGVGFRQSFQSSYYDRYGGGANSLADGYNTGTGLAAEIIGTFVLVYTVFSATDPKRNARDSHVPVLAPLPIGFAVFMVHLATIPITGTGINPARSFGASVIYNKSKPWDDHWIFWVGPFIGAAIAAFYHQFVLRASGSKSLGSFRSAANV

SEQ ID NO: 80458 - protein, 116 aa, Oryza sativa Japonica Group
MATTVTRAHLDQRLALAKRCSREANLAGVKAAAVATIASAVPTLASVRMVPWAKANINPTGQALIICTAAGMAYFVAADKKILSLARRHSFENAPEHLKNTSFQGTGRPHPAFFRP

SEQ ID NO: 80459 - protein, 478 aa, Nocardia farcinica IFM 10152
MLDPGAYSANNLINGELVAAESGRLLDVLEPATGEVLARVPASGKEDVDAAVTAATQAFRSFRRTTPGERAEMLLTLAAKIEEHAEHIAMLESRNVGKPLPVARDEVAFAVDNLRFFAGAARTMEGRAGGEYLRGYESYIRREPIGVVAGIAPWNYPLLMATWKIGPALAAGNCSILKPSRQTPLTALYIAALAQDVFPAGAFNVLSGSAADIGDHLVADRRIGLVSLTGDTSTGRHIAEVAAAHVAQTHLELGGKAPVIVLDDADLGAVVAGIATAGFANSGQDCTAACRVIATPGIYDRLLEALVPAVQAIRVGDPQAGDDIDMGPLISAAHRQSILDVLAKTDGTILAGGKALPGNGFFLEPTVVANPSQADVLVQTEQFGPVVTVQRADDIDQAFEWANDVEFGLASSIWTQNLNHAARAVRDLDFGCVWVNDHMPVLSEMPHGGFKQSGYGKDMSIYALEEYTRIKHVMTKTN

SEQ ID NO: 80460 - protein, 365 aa, Nocardia farcinica IFM 10152
MRAALFTDENTSVEITDIDLAAPLRNEVRVRIAAAGVCHSELHLVRGEWPVPAPLVPGHEGSGVITEVGPDVTHLAVGDHVVLSWNPYCGECRECLAGRETRCHQVATVINTTGSLLDGTSRLSRGGQRVNHYLGVSSWAEEVVVPATGAIKVRDDAPLESIALVGCAAATGVGAVVNTAQVKAGSTVAVIGCGGVGLNIVQGARLQGAERIVAVDLSPERAALAKTFGATDAIGLDGADAVEALRDLMPDGVDFAFDAIGHVTTTEAAIRALALGGAAVVVGLPAAGATASFEPLALAEMDARILGSNYGSIRPQFDIPKLVDLYMTGELLLDELITARRPLDEAAQALSDLASGAQLRQLLIP

SEQ ID NO: 80461 - protein, 199 aa, Haemophilus parasuis
EAGDIIIDGGNSNYPDTNRRVKALAEKGIRFIGSGVSGGEEGARHGPSIMPGGNEEAWQYVKPIFQAISAKTDKGEPCCDWVGKEGAGHFVKMVHNGIEYGDMQLICEAYQFLKDGLGLSYNEMQAIFAEWKKTELDSYLIDITTDILGYKDTNGTPLVEKILDTAGQKGTGKWTGINALDFGIPLTLITESVFARCVS

SEQ ID NO: 80462 - protein, 357 aa, Nocardia farcinica IFM 10152
MTVTAQAPAPAQAPAALSVAERLQRAAFTALGSIPGGLLRRIAPRVVNADGDVLAPEIALLLKATASAPDFSDGTPEQARAIVANDSRVFADKAPAGVRVEPEIVLPTGLRATMYRPAVPSNALVLFLHGGGFVLSSRQDYDVPVRLIADGAGVNVLSVEYGLAPESPFPGPVDDAVTAWRFAVEHCAQWGIDPARIVLLGDSAGGNLCAVLANIVAGEQVRPFLQVLMYPVVDAVGNYASRKEFADNAALSAKQIDWLTDLYLPDRTYALDPRVSPILAEDLSGAPPTLITVAGFDPLRDEALAYAARLEEAGIPVRVFRESGLVHGYVSMTRISPTARAALDRVTDAVRTALEES

SEQ ID NO: 80463 - protein, 314 aa, Rhodococcus sp. RHA1
MALDAHAAELIAGLQAQGLKAFEHSTVEEARAVVATFAGLQAPPEPVARVEDAHYESGGAQIALRVYVPEGRAPHPVVLYFHGGGFVAGDIDVVDEPARAVANGAGAIVVAATYRRAPEHRFPAAADDAAAALQWVADNVASYGGDPGNVVVMGDSAGGNLAAVTALRARDEGGPRLRGQVLIYPVIDPNADLPSRQEFAEGYVIGAGDLDWFWSNYLSSPEDAKHPYAVPSRAAGFEGLPPALVLTTENEVARDEAEAYAESLRQAGVDTEAIRFDGLIHGSFWMSGVVPRSAEMRSAVVEFVKRVTATAPVV

SEQ ID NO: 80464 - protein, 197 aa, Triticum aestivum
  misc_feature (17)..(17): Xaa can be any naturally occurring amino acid
  misc_feature (31)..(31): Xaa can be any naturally occurring amino acid
RSKDDLPDELISHINYXGTDQPTFTLNFSKXASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIVAELDAHAVHAIKLSNAAAAEGASKSTMNPVTEAFKGLAGNKKAGVC

SEQ ID NO: 80465 - protein, 1380 aa, Burkholderia thailandensis E264
MSKHRQAPGPRGSLVMGNLAAYKRNPITMLLRLHQQYGDVARNRLGPFVTHALAHPDHIQYVLQENHRNYVRGRFYDNFKMFFGDGLLTTDGEFWRRHRRAVQPLFHKKQVDAHTAAVGDAALALAHRWSALPPGKAVDVVEEMMHLSLRMLGLMVFNTDVSSHAEAVGPAVRFGIEAMMPQGNMNDFIPRWAPTRFNRRIAHARRAIDTIIAKIIADHREARCEPSDVISLLLNARDPDTGAPMTQQEVHDEVMTVFLAGHETTGAGLAWALYALAQHPAVLRQLRDELDARLGGRAPTVQDFEQLPYLSQVVDEVLRVYPPIWGFTRDLVEDDEIGGYRIPARSSVFMSPYVTHRHPAFWRNPDAFDPENFASDAPARHRFVYFPFGGGMRKCIGFQTALLQMRVLVAVVAQHFDLNALPGHPIELGAAISLRPVHGIRLIVKPRERQQSHLARVREHESARALRPLGDTAEAAGAVCPMTDAAHEICVSADAAMVEAGAPGDANAGGAAAAVERAAARQHEPAAAAPLPFATSAATGAPPAASPVAAAAAGASARSVPAWRFTWRPVPVDPVPDEPSPALSGKRIALVNGRGGTIERVAAALARTCAKVSVFAPAANADHAEAARAFVNEAGPLDGIVDLGLEAPFALDDASAWEAPMRRTVELLKACYGDWAAEDDTSRLFYVALTWMDGQMGYGDDAGAQPLGGLWAGLAKTLPQELPNCNVRVLDIAPDETGRVDRLVVNELYRWGLFEVGYRNGVRYTLHAKRDELPPLAVDARAALGPGDTVLFSGGARGIGLLCARALAERHGCTVLVTGRETPPDGGEPWMALDEAGFKRYGLEQLRAATPERPPKAIRASLQRLKHRRELKAALDEMAALGLPVHYRVCDVTDRAAVRALCDELGDSLRIVIHNAGVDQPVRLIQKRADDFAHTVRTKVLGFANLCDAVRARPRLAQFCNVGSLTGRWGGMTGETDYAAANEALARLGLWAAKHALPPACGVKTLVWPTWEGVGMITNFAVTQRYVSPMNVEEGVRHWLRELASPGGGEVMFMGAVGRAPTPVQIKGFQPIRELPNIGELVTRRHHVGEPVRFRPFKRFEGRYAIDPAVAPYARAFRFNGRAVLPASLVLEHACAVGDWVMPPTGEPRELSEMTNVVLRLDALPDVPAGDAPVEIASEAAGYMIGDVWCVDVRCSDARTQAELLSMTLVYRPQPEQIGAAYARAPDTKPEPAPLTSAPHAAWDGELLPAGDWSVPDDASAGIVRIGRVPPAAVLSLWTLPFPLELRLPVNHVEHVLRVLLAEWGAAQTDAPSVWRIGAAKLARLPAASADGVVEYATGRFAVLDARGYVLLRVDDTRVDSDAAHAAPAETVALADPLTA

SEQ ID NO: 80466 - protein, 477 aa, Psychrobacter arcticus 273-4
MSSGRIVQIIGAVLDVEFNRNEVPRIYDALQVDGTETTLEVQQQLGDGIVRTIAMGSTEGLKRNLSVTNTGGPISVPVGVGTLGRIMDVLGRPIDEEGPVEADERWSIHREAPSYAEQSNSTELLETGIKVIDLLCPFAKGGKVGLFGGAGVGKTVNMMELINNIALKHEGLSVFAGVGERTREGNDFYHEMQEAGVVNTEDFSKSKVAMVYGQMNEPPGNRLRVALSGLTMAEYFRDTKDPATGKGRDVLLFVDNIYRYTLAGTEVSALLGRMPSAVGYQPTLAEEMGMLQERITSTQSGSITSVQAVYVPADDLTDPSPATTFAHLDATVVLSRDIASQGIYPAVDPLDSTSRQLDPLVIGEEHYNVARGVQEVLQRYKELKDIIAILGMDELSEEDKLVVYRARKIQRFLSQPFHVAEVFTGAPGKYVPLRDTIASFKAIIAGEYDSLPEQAFYMAGGIDEVVAKAEKMKSSAA

SEQ ID NO: 80467 - protein, 327 aa, Saccharomyces cerevisiae
MNSESREDMAINSIKLLAGNSHPDLAEQISKKLGIPLSKVGVYQYSNKETSVTIGESLRDEDVYIIQTGIGEQEINDFLMELLILIHACQIASARKITTVIPNFPYARQDKKDKSRAPITAKLVANLLQTAGADHVITMDLHASQIQGFFHIPVDNLYAEPSVLNYIRARKTDFDNAILVSPDAGGAKRVAALADKLDLNFALIHKERQKANEVSKMVLVGDVTNKSCLLVDDMADTCGTLVKACDTLMEHGAKEVIAIVTHGIFSGSAREKLRNSRLSRIVCTNTVPVDLDLPIADQIDISPTFAEAIRRLHNGESVSYLFTHAPV

SEQ ID NO: 80468 - protein, 537 aa, Oryza sativa Japonica Group
MADAATTPLLTSHEAKPAKAPSIDDAIETYIGATGAGQLFKAILLAFAWAFDAQQVFISVFTDAEPRWHCTAGADPSCSPGAASPCALPPGAWAWDRPAETSVVSEWALKCGGGGPALVSLPASSFFAGNLAGGFLLTTLADTHLGRRKMLVLSLATMSVAGVLTAFSPNVWVYAALRFVSGFGRSMVGTSAMVLSTELVGKWWRNTVSVAGFVLFSVGFMSLPALAYTLREASWRTMYVWTSLPSLCYAVLLYFLVQESPRWLLVRGRNQEAIEALRQIASLNGGEGVTTSSFSMLDACAVEVGDGVAGGDGMFASLRLIWERRWAFQRLAAMMTASFGVGVVYYGLPLSVGSLSSDLYLSVAYNAAAELPSSVLSWLLMGRFNRRSSLVALTAASGLCSLACVVIPDEEAGTGGLRLAAELASFFASCAAFDVMLMYSIELFPTSVRNSAVGLVRKAAVLGGVVAPMLVALGRERSYWSFGVFGLAVGCLGLFVTWLPETKGRRLSDTMEEEEEAAAAILSCAGASDMNNNGELV

SEQ ID NO: 80469 - protein, 159 aa, Erythrobacter sp. NAP1
MTISVGDKIPEVTMVKATAEGPQQVSSSEYFAGKKVALFSVPGAFTPTCSAKHLPGFVEKADDLKAKGVDEIVGTAVNDAFVMGAWNSAAGSDDITMLADGNADFAEAVGLTMDGSGFGMGKRGQRFSMVIEDGTVTQLNIEEPGDFKVSSAEHMLGQL

SEQ ID NO: 80470 - protein, 402 aa, Buchnera aphidicola (Schizaphis graminum)
MPDIGLEEVEVTEILVKIGEEIKLDQGLITVEGDKASMEIPSPISGIVKDITIKIGEKVKTSSIIMIFKVNNLNSIKNEKDLNYIKTEKKLNENFLEEKKDIKKIVLVHATPVVRRLARHLNVDLKNITPSGPKNRILKEDIELYIRNNTSNKSSFNIEKNNTTNFHKDLFNEIPITNIQQIIGKNLHQNWVNIPHVTQFDEVNITLLEEFRHKYNTEKKQKNNMCSKITILPFIIKSVAYGLLEFPIFNSSLSVNKKTIFLKKYVNVGIAVDVQNALFVPVLKNVDKKNIANLSSELIFLSKKAHENKLDASDMKDGCFTISNLGGIGGSWFSPIINSPEVAILGVSKALIKPLWNGKEFIPSLMLPLSLSYDHRVINGADAARFLTFIGKMLSDIRFLIM

SEQ ID NO: 80471 - protein, 534 aa, Oryza sativa Japonica Group
MADAATTPLLTSHEAKPAKALSIDDAIETYIGATGARQLLTAMLLAFAWAFEAQQVFMSVFTDAEPTWHCTGVAAGDPGSFCSLAAASASASACALPPGTWEWDRPAETSVVSEWALKCGGGGPALVSLPASSFFAGNLAGGFLLTTLADTLLGRRKMLVLSLVTMSVAGVLTVFSPNVWVYAALRFVCGFCRSTAGTSAMVLSTELVGKWWRNTVSVAAFVFFSVGFMSLPALAYTLREASWRNMYVWTSLPSLCYAVLLYFLVQESPRWLLVRGRKQEAIAALRQIASLNGGEGITTSSFTKLETCAGEVGDGVAGGEGMFSTLRSICERRWALRRLAAITTATFGVGVVYYGMPLSVGSLSSDLYLSVAYNAAAELPSSVLSWLLMGRFNRRSSLVALTAASGLCSLACVVIPDPEAGAGGSHLRLAAELASFFASCAAYDVLLMYSIELFPTSVRNSAVGLVRQAGVLGGVVAPMLVALGRERSYWSFGVFGLTVGCLGLFVTFLPETKGRRLSDTMEDEEEAAAVLSGG

SEQ ID NO: 80472 - protein, 382 aa, Vibrio sp. Ex25
MEMKAHYINGAMYNGCSDEHFTTYNPANGEPLANIKQANQDDLEAAIESAKKGFAAWSAMTAIERSRILHKAVAILRERNDELASLEVADTGKPIQEAIAVDITTGADVLEYYAGLAPSLQGEQQPLSEDQFFYTRREPLGICAGIGAWNYPIQIAMWKSAPALAAGNAMIFKPSEETPLTALKLAEIYSEAGMPDGVFNVVQGDYRVGQMLTAHPDIAKVSFTGESGTGKVVMSDSAKTLKQVTMELGGKSPLIIFDDAKLNDAVSAAMVANFYTQGEVCTHGTRVFVHEGIYDDFIAQLKARTELLVVGDPLDENTQIGALISKDHESKVLGAIEAAKASGATLLTGGYKVTENGLANGNFVAPTVFVDCDDDMSHVQQE

SEQ ID NO: 80473 - protein, 187 aa, Bacillus sp. SG-1
MSLIGSEVKPFTAQAYKDGEFIEVTEESLKGQWSIFCFYPADFTFVCPTELEDLQNNYDELKSLGVEVYSVSTDTHFTHKGWHDSSETIGKIKYAMIGDPSQKITRNFEVLNEEEGLADRGTFIIDPDGVIQTVEINAGGIGRDADILVSKIKAAQYVRKNPGEVCPAKWQEGSETLKPSLDLVGKI

SEQ ID NO: 80474 - protein, 1499 aa, Candida albicans
MSTANTSLSQQLDENPWVDASDNSSVQEYQGFDATASHNIQDLARKLTHGSTNGDHHSANDLARYLSHMSDIPGVSPFNGNISHEQLDPDSENFNAKYWVKNLKKLFESDSDYYKPSKLGVAYRNLRAYGIANDSDYQPTVTNALWKFTTEAINKLKKPDDSKYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSATILDTTPLIAIYQCSQDAYELFDNVVVLYEGYQIFFGKASKAKEYFENMGWKCPQRQTTADFLTSLTNPAEREPLPGYEDKVPRTAQEFETFWKNSPEYAELTKEIDEYFVECERSNTGETYRESHVGKQSNNTRPSSPYTVSFFMQVRYVIARNFLRMKGDPSIPLISILSQLVMGLILASVFFNLRKSTDTFYFRGGALFFSVLFNAFSSLLEILSLYEARPIVEKHRKYALYRPSADALASIISELPVKLLMTMSFNIVYYFMVNLRRTAGNFFFYWLMCASCTLVMSHMFRSIGAVTTTIATAMSLSTVFLLAMIIYAGFVLPIPYILGWSRWIRYINPVTYIFESLMVNEFHGREFECGQYIPSGPGFENLPVENKVCTTVGSTPGSTVVQGTEYIKLAYQFYSSHKWRNFGITVAFAVFFLGVYVALTEFNKGASQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDKLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISLNELIDNAANLATTLFTLCLMFCGVLAGPNVIPGFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIGINIILTIFFYWLARVPKGNREKKMKK

SEQ ID NO: 80475 - protein, 390 aa, Thermosynechococcus elongatus BP-1
MLNPDLSTIQLTKDDYERYSRHLILPEVGVEGQKRLKAASVLCIGTGGLGSPLLLYLAAAGVGRLGIVDFDVVDSSNLQRQVIHGTSWVGKPKIESAKHRILEINPYCQVDLYDTRLSAANALEIMADYDIVVDGTDNFPTRYLVNDACVLLNKPNVYGSIFRFEGQATVFNYEGGPNYRDLYPEPPPPGLVPSCAEGGVLGILPGIIGVIQATETIKIILGKGTTLSGRLLLFNALEMKFRELKLRPNPERPVIDKLIDYEEFCGIRQAKAQEAAQMAEIPEMTVQELKALMDSGAQDYVLVDVRNPNEYEIARIPGSVLVPLSEIENGPGVEKIRSLLNGHRLLVHCKMGGRSAKALGILKEAGIEGINIKGGINAWSQEVDPSVPTY

SEQ ID NO: 80476 - protein, 354 aa, Glycine max
LKMESDVEESMRKRPRKYPFSADSSSRKQFEQYSGRTFAIMGEVNFMQDDDNRLEITRTKFGSLLKRHGDLTERLARDSDKIIFERLQKEFEAARASQTEEICLDGEEWNDGLLATIRERVHMEADRKAMQGDADILACPLEKITYKIGNKVICCLEGARIGVQYETSFAGEPCEFYHCVLESKSFLEKMTVLEHTVPFFLPIREIENDLHSSNAMKLIDHVGDLLQAFVDRREQVRLIKELYGNQIRELYHSLPYHMVEFVLDDSDCKVTVSLRYADLISVLPTRISVLAWPMFNKNTMSRKEDGLSGSHSSPIRLTYAEDALRTMSLPEAYAEIVLNLPQAIRQTYHQKATA

SEQ ID NO: 80477 - protein, 490 aa, Bacillus sp. SG-1
MEELLVNSDYFILLTALLLCAGVITTKFSTRLGVPALVLFILVGMITGSDGLGFIYFDNARLTQMIGVLALIIILFEGGLQTKISTVKAVAKPALSLATAGVLITTTVVAVAAKLILGVSWLEGFLFGSIVGSTDAAAVFAVLKGKNVKGKLGSILEVESGTNDPMAVFLTIFFIELLTVDKPVYFLLAGSFFWQMGIGLLLGIIIGKAGSFFINRINLDSSGLYPVFTMAFALLAYSITDLLNASGLLAVYVAAMVIGNKELTYRHSIFKFNEGFAWMMQILMFVILGLLVFPAQLFTWEVVGKGLLLSAILIFVARPIAVFVSMIKMNYQLNEKIFLSWAGLRGAVPIVLATFPLIAGLENSQMIFNVVFFVVLTSALIQGSTISKFAAKLGLTGSTKAEPAHSLELISIGKADAEILEAEVNEEMPIVGKSLADISFPKDVLINAVIRGADLVTPYGETVIQKGDILYILVSRNSKRELKEMLHINE

SEQ ID NO: 80478 - protein, 188 aa, Brassica napus
MGAEKKWLFTLFSVVFISVFLLLLLYSISAFTSNPFPSPLRHGPHYPPSFAYYITGGRGDKDRIFRLLLAVYHPRNRYLLHLGGADATEAERVALLSDVKSVPAVSAFGNVDVLGKVDRLSENGASKTANTLHAVSILLKLDGSWSWFIELSALDYPLITQDDLSHVFASVNRSLNFIDHTSDLAWKE

SEQ ID NO: 80479 - protein, 115 aa, Oryza sativa Japonica Group
MSTVTRAYLDQKLALAKRCSREATLAGAKAAAVATVASAVPTLASVRMLPWAKANINPTGQALIICTAAGMAYFVAADKKILSLARKHSFEGAPEHLKNTSFQGTGRPHPAFFRP

SEQ ID NO: 80480 - protein, 151 aa, Deinococcus radiodurans R1
MTLVGQPAPDFTLPASTGQDITLSSYRGQSHVVLVFYPLDFSPVCSMQLPEYSGSQDDFTEAGAVVLGINRDSVYAHRAWAAEYGIEVPLLADMQLEVARQYGVAIDERGISGRAVFVIDREGVVRYQHVEEQTGQYTVRPGAVLEQLRGL

SEQ ID NO: 80481 - protein, 63 aa, Oryza sativa
APRSVEKKIYGEFLVNAHAEDVGAGFNNSNRRLDAIRDHLPEPYEQLGENCRVLESHYREMMD

SEQ ID NO: 80482 - protein, 526 aa, Lentisphaera araneosa HTCC2155
MKNSKSYALLQELSANSYDLTQDKALKGRFESMKSSALGIDYVYACQRLNEEVVDALQGLADETDAVTQFSRMMGGENMNKIDGFECEDRQVLHTAMRDVFDDLPEGFLSDQEAVNGAKAEIAKLKTFCDEIENGTILNAKGEKFNEMILVGIGGSDLGPRAVYLALKAYAVEGRKVHFISNVDPDDAAAVLIDADLERSLVCVISKSGSTLETLTNETLVASNFEAAGLNPKDHFVCVTGKGSPMDNPDKYLRSFYMFDYVGGRYSVTSMVGAVMLSFGLGYDNFINFLRGARKIDLNSQNRDVRKNLPLLMALIGIWNRNFLDHETLAVLPYSQALSRFAAHLQQCDMESNGKRVNRQGETVDFATGPIVWGEPGTNGQHAFYQLIHQSETVVPCDFIGFAKSQYQKDLDVKGTSSQQKLLANLIAQSIGLATGKTSDNPNKVFPGNRPNSMLFAEQLTPEIMGALLALYENKIAFQGFVWNINSFDQEGVQLGKVLANEIIDIFTGQDVEAENAKEYLKTLGL

SEQ ID NO: 80483 - protein, 356 aa, Zea mays
  misc_feature (251)..(251): Xaa can be any naturally occurring amino acid
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAEYTVRTXLQRTVPAAVPAVVFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 80484 - protein, 1605 aa, Arabidopsis thaliana
MSVIRPSPIPIPRCRSQVLHRRLYSIQLIQRRRRRWNPRSEVEDTAIESTARSPEAAGGKMVVELVGAFNEVTERMNSVWLSTSSSRLLFKALKLSIPILQSLPLASDGRSPLSKALSLSIILADLQMDAEVISASILSEVVDANAISIYEVRDHIGTGTAHLLHEIFRVKNIPFKVDVLDDETAASLRKFYLTYYDIRAVIMDLVSKLDEMRHLDHLPRYRQQILSLEVLKIYSPLAHAVGANHLSLELEDISFRYLFPCSYIYLDSWLRGHENGSKPLIDVYKEQLHRSLKDDLVLAEMVNDVYIKGRYKSRYSMMKKLLRDGRKPEEVNDVLGLRVILMPNSVVNDVEVGEKACYRTSEIIRSLWKEIPHRTKDYIARPKENGYRSLHMAVDVSDSDQIRPLMEIQIRTMDMDGSANAGTASHSLYKGGLTDPKEAKRLKAIMLAAADLAAIRLKDISSNKHQSFKTTTNQRDRVFCLLDKNGDGMISIEELMEVMEELGAPGEDAEEMMQLLDSNSDGSLSSDEFDTFQKQVEFMRKWEDRDNEYKSLLDEKLHDLPHQDTTALVRSFFIPCEIAMMTLQSSPMSVLTEDLVEDILSRVPATSLVRLRSTCKQWNAILNDRRFIKKHFDTAEKEYLDMLLRSLRVSSMSVNLHGLHDNIDPSIELKRELNLKGLLCNSGKVESFEVFHCNGLLLFTNTSTIVVWNPCTGQTKWIQTESANTRYHKYALGYENKNLCRDYKILRFLDDGTNFELEIYEFNSSSWRVLDSVEIDFELDIGSQGMSVKGNTYWIVIDDHEVDGELVNCFLTSFDFTRERFGPHVCLPFQTSWYSDVISLSSVREERLSVLFHEEDSLTMEIWVTNDITDTIVTSWSKFLRVDLYTHRFYNGVTFFIDEENKAAVFSEDVPDDSDDIHSIVYIIGQDRLRIVDLEDGPFWPQMFCYVPKDLVEEILSRVPAISLKRLRYTCKQWNALFNDQRFSKKHRDKAPKTYLGLTLKDFRIYSMSSNLHGLLHNNNIDLLMEFKDSWFGTPVPVKPGGSNAGIVGCVIPLLLDMTTARQQFEYEIFEFSSNSWRVLDVNPNCIIEETFQKLPLPFHIFDYNDSRALSAFREEQLSVLHQSFDTEKMDIWVTNKIDETTDWSWSKFFTVRLINSRFLLLPRDKMMSNLPLDLVEEILSRVPATSLKRLRSTCKSWNNCYKDQRFTEKHSVIAAKQFLVLMLKDCRVSSVSVNLNEIHNNIAAPSIELKGVVGPQMQISGIFHCDGLLLCTTKDDRLEVWNPCTGQTRRVQHSIHYKTNSEFVLGYVNNNSRHSYKILRYWNFYMSNYRVSEFEIYDFSSDSWRFIDEVNPYCLTEGEVSLKGNTYWLASDEKRDIDLILRFDFSIERYQRLNLPILKSDYETEALSVVREKQLSVLLKRNDTLEREIWVTTNDKIDHTTKNLLWIKFLAIDQRTCYHWSCVSFFIDEEKKMAVFCDGYIGGINETSRRMFYIIGEDKYYRELYVGDSPIRSHRPFVFNYVPSLVQIPQATVIPKRRRQQLSLVLQRCRASKVDVWITDKIDTKEVQWSKFFTVDVDIGGRAMLSYDSFFIDKEKGMALLCGL

SEQ ID NO: 80485 - protein, 218 aa, Neptuniibacter caesariensis
MSSDQRIVHYNSARFNKSAAKLHQCPEDIGAEVAFAGRSNAGKSSAINTLTNNGKLARTSKTPGRTQLINFFDLNLEGVRLVDLPGYGYAKVPVEMKVHWQKHLGEYLEKRQCLQGVVLVMDIRHPMKEFDQMMVEWCENSQMPLHVLLTKADKLKKGPAQSTMLKLRKELQAVLGDLVTVQTFSALKKQGVDQLRNRLDHWLLPEETDFESEVITEE

SEQ ID NO: 80486 - protein, 302 aa, Triticum aestivum
MSMSSPVHARKALHLVAMKAKLQSFLGLRLLVVAALAAFLLLFSARTLFSSSSSPGSAASSHLHLSGDGSCSKLPAPVADALVHYATSNSTPQQTAAEIGVSLRVLQRRSPCNFLVFGLGLDSPMWAALNHGGRTVFLEEDASWIASVRAKHPGLESYHVVYDTRLTEADDLIALRDHPGCTAQPDLAAAAEASCRLALRGLPAAFHEVEWDLVMVDAPTGWVPEAPGRMGAIYTAGMVARARRPGDGATDVFVHDVDRTVEDRFSKAFLCEAYLAEQVGRIRHFVIPSHREKPGTPFCPLS

SEQ ID NO: 80487 - protein, 405 aa, Arabidopsis thaliana
MDSVFSNVARAPEDPILGVTVAYNNDPSPVKINLGVGAYRTEEGKPLVLDVVRKAEQQLVNDPSRVKEYIPIVGISDFNKLSAKLILGADSPAITESRVTTVQCLSGTGSLRVGAEFLKTHYHQSVIYIPKPTWGNHPKVFNLAGLSVEYFRYYDPATRGLDFKGLLEDLGAAPSGAIVLLHACAHNPTGVDPTSEQWEQIRQLMRSKSLLPFFDSAYQGFASGSLDTDAQSVRTFVADGGECLIAQSYAKNMGLYGERVGALSIVCKSADVASKVESQVKLVVRPMYSSPPIHGASIVATILKSSDMYNNWTIELKEMADRIKSMRQQLFEAIQARGTPGDWSHIIKQIGMFTFTGLNKEQVEFMTKEFHIYMTSDGRISMAGLSSKTVPHLADAMHAAVTRLG

SEQ ID NO: 80488 - protein, 356 aa, Cryptococcus neoformans var. neoformans JEC21
MKAQENSQRANRWDKGIKIGEGTFANVYKGTEKATGRKVAIKKIKVGEMKHGLDMTALREVKFLQELKHPNIISLLDVFSVKQNINLVLEFLDTDLEAVIRDKALIFQNADIKSWMAMSLRGLEYIHRNGVLHRDLKPNNLLIAANGELKIADFGLAREFGDAGNKMTCQVITRWYRPPELLFGSRYYSPTVDIWSMGTIFVELILRVPFLAGETDIDQLKKTFHAMGTPTEQDWPGYTKLPDYHEVGSFPKNPWWNMISSIGREGQDLARELLRFDPAQRPSAKKALLHSFFTSYPPPTPPIALPKPLAELRPRELAPDETQGKPLLTSGAGQSLKRKAESPRTSQSVPRKLIFT

SEQ ID NO: 80489 - protein, 254 aa, Zea mays
MTSSRSKSKSRSRSRSRSRSRSRSPRRRDRLRSERAPHRSRSRSRSPYRRRERRGHRDFACKNCRRPGHFAKECPSAPMCNNCNLPGHFAAECTLQTVCWNCKESGHIASECKNEALCHACNKTGHLARDCPTSGANVKLCNKCFKSGHIAVDCTNERACNNCRQPGHIARECKNDPVCNLCNVSGHVARVCPKTTLASVIQGGPFRDILCRICGQPGHISRNCMATIICDTCGGRGHMSYECPSARIFGLRRL

SEQ ID NO: 80490 - protein, 262 aa, Brassica napus
  misc_feature (122)..(122): Xaa can be any naturally occurring amino acid
  misc_feature (226)..(226): Xaa can be any naturally occurring amino acid
  misc_feature (228)..(228): Xaa can be any naturally occurring amino acid
MENLEDLKMMAEQWSNQGIEYLQKIPQDQLYAAVGVLLFTTILLLLSIRLVRRTKSNTVLLSGLGGSGKTVLFYQLQDGSSHQGTVTSMEPNEGTFVLHSDNTKKGKVKPVHLVDVPGHSRXLRPQARKSFLPQAAAIVFVVDALEFLPNCRAASEYLYDILTNANVVKKKIPVLLCCNKTDKLTAHTKEFIRKQMEKEIKKLRASRSAVSTADIANDYTIGIEGXVXSFSHCCNKVTVAEASGLNGETVQVQDFIREYIKP

SEQ ID NO: 80491 - protein, 807 aa, Oryza sativa Japonica Group
MTILLVILGLHLCSLHLPAISAAADTLSPGQSIAGDDRLVSSNGKFALGFFNTGSKSSGNDTLSYWYLGIWFNKVPNKTHVWIANRGSPVTDATSSHLTISPDGNLAIVSRADSSIVWSSQANITSNNTVAVLLDTGNLVLQSSSNSSHILWESFDHPTDVFLPSAKIGLNKITGLNRRIFSRRDLVDQSPSVYSMEFGPKGGYQLVWNSSVEYWSSGEWNGRYFSRIPEMVVKSPHYTPFIFQIEYVNNDQEVYFTYRIHDETIPLYTVLEVTGQRKALAWLNDTQGWQAVFTHPNDQCEVAATCGPFTICNDNTFPSCSCMEGFSIESPDSWELGDRTGGCRRNIPLDCVSSRSDIFNAVPATRLPYNAHAVESVTTAGECESICLGKCSCTAYSFGNYNGCSIWHGKLVNVKQQTDDSTSANGETLHIRLAARELQARKSNKGLVVGVVVSASLSALGILTLVLLLIMIRRHRKKLHCQALNSIYAGTGVIPFRYSDLQRATKNFSEQIGAGGFGSVFKGLLNGSTAIAVKRLVSYCQVEKQFRAEVSSIGVIHHTNLVKLIGFSCKGDERLLVYEYMSNGSLDTHLFRSNNSVTLNWSTRYQIALGVARGLAYLHESCRDCIIHCDIKPQNILLDDLFVPKIADFGMAKLLGRDFSRVMTTARGTIGYLAPEWFSGVAVTPKVDVYAYGMVLLEIISGKMNSHRESNSYADHIVCFPLEVAHKLLEGDVLSLVDGKLNGDVNVEEAERACKLACWCIQENELDRPTMGKVVQILEGLLELDLPPMPRLLQSIVQSSWKTETQH

SEQ ID NO: 80492 - protein, 781 aa, Oryza sativa Japonica Group
PTLDAISPGQELAAGDKLVSSNGRFALGFFQTDSNKSSSNSTPNIYLGIWFNTVPKFTPVWVANGENPVADLASCKLLVSSDGNLAIVATTHAKNSSMVWSSKANIPTNTTHAVLLDDGNLVLRSTSTTNASSTILWQSFDHPTDTVLQGGKIGWNNATGVNRRLVSRKNTVDQAPGMYSFELLGHNGPTSMVSTFNSSNPYWSSGDWNGRYFSNIPETVGQTWLSLNFTSNEQEKYIEYAIADPTVLSRTILDVSGQLKALVWFEGSRDWQTIFTAPKSQCDVYAFCGPFTVCNDITFPSCTCMKGFSVQSPEDWELDDRTGGCVRNTPLLCNSNKTAAGTADKFYPMTSVQLPDKAQSIGAATSADECAAACLSSCSCTAYSYGEGGCSVWHDKLLNVRQQGNGVLYLRLSAKEVLESRRNNRWGVILGASIGASTAALGLIFLLMIWIRKGKRYNLTMDNVQGGMGIIAFRYVDLQHATKNFSEKLGAGSFGSVFKGSLSDSTIIAVKRLDGARQGEKQFRAEVSSIGIIQHVNLVKLIGFCCEGDRRLLVYEHMPKSSLDAHLFPSSGAVLSWTIRYQIALGVARGLAYLHSSCRDCIIHCDIKPENILLDSSFTPKVADFGMAKFLGRDFSHVVTTMRGTIGYLAPEWISGTAITSKVDVYSYGMVLLEIISGSRNSSKQSSRDGVHEACFPVQVARNLLNRDIDSLVDANLHGEVKLEQVERVCKVACWCIQDNEFDRPTMSEVLQFLEGLSEVETPPMPRLLHTLAGGLDSKIM

SEQ ID NO: 80493 - protein, 448 aa, Arabidopsis thaliana
MGSVSPDAQKDDLELEDSLNIDENLSGGNGLLKSGNLLSQKRQQCSLVSNSGKWLQIVKNGPKGSFSRATSFFDNKIPRQLVSVDEKYLRRCLDLINIISQGTLQFTMKDNKTPHFVFSLDDQKEIYVASLSTTSVGSGFDRSSLDYSYLIHLKKGRGSEPQHLVGKLKVSTLFSVSSTNEKTVERQFVLFSSGGNPQLPCHKDIRKNRGLPKKVVDALKSTKRTSRQRSISRFSRTSSIPDFCSWEPFQEHDSDLEPISLLDNDLPPNLETSAVVVREQFPVEEEEEEEVEKVGGWGMKFLKKIPLARTKDASKCSKHSTSIDVVIPLGIHGGPRNRNGGPSSLIQRWKSGGCCDCSGWDLGCPLTVLKGQARKDQSEGQCNLFELFTEGLMQGSPGLRIMNVRDGLYFVQSQAKISVLQSFSIALAYIHSQSQRLRPWSSKKCTEA

SEQ ID NO: 80494 - protein, 497 aa, Vibrio sp. Ex25
MTEQVKQYIGGEFAISDSKQWLDVTNPATNEVIAQVPCATESEMNAAIASATETFKRWKEVAAPERARLMLRYQHLLKEQHDELAILLSSETGKTLADAKGDIWRGIEVVEQAANICSSMMGETVENVATNIDGYSYIQPLGVCAGITPFNFPAMIPLWMFPMAIACGNTFVLKPSEQVPLTAMKLAELFEQAGAPKGVLQVVHGTKEQVDRILTDPVVRAISFVGSVPVGEYIYKTGTDNLKRVQSFAGAKNHMVIMPDANKQQVINNLVGASVGAAGQRCMAISVAVFVGESKEWIPELKEALAQVQPGAWDDETAGYGPLISPQAKQRVVNLINEGKASGANCVLDGTDCQVPGFPNGNWVGPTLFTNVTTDMSIYQEEIFGPVLLTMEVDDLDEAIELINANRFGNGTSIFTANGAAARKYQHNIEVGNVGINVPIPVPLPFFSFTGWKGSFYGDLHAYGKQAVRFYTETKTVTARWFEDDIPSGPNMTIQLS

SEQ ID NO: 80495 - protein, 535 aa, Vibrio sp. Ex25
MACLTTNINTHSEQYQENYRSMASLVDQLYTVTAQIEDGGGEKAREHQHKKGKLPVRERILALLDSGSSFLEIGQFAGWDVYPDYVPCAGVVAGVGVIDGTECMIVANDVTVKGGSYYPLTVKKHLRAQEIAEKCQLPCVYLVDSGGANLPRQDEVFPDKDHFGRIFYNQARMSAKGIPQIAVVMGLCTAGGAYVPAMCDVSIIVKEQGTIFLAGPPLVKAATGEEVSAEDLGGADVHCRTSGVADYYAENDHHALELARQAVSQINHLKPVQLKQKAPQEPRFSAQELYGIVGTDLKKPFDVKEVIARIVDDSQFDEFKALFGETLVCGFAHIHGMPIGIVANNGILFSESAQKGAHFIELCAQRKIPLLFLQNITGFMVGQKYEAEGIAKHGAKMVTAVACADVPKFTVVIGGSYGAGNYGMCGRAYDPTMMWMWPNARISVMGGEQAAGVMAHVTRDIKTRKGESWSTEEEEAFKRPIAQQYQTQSHAYYASARLWDDGIIDPAKTRDVVGIALSAALNAPIPDSKFGIFRM

SEQ ID NO: 80496 - protein, 423 aa, Cuscuta reflexa
FQFLSCICIAFFFVPAIGSTVLFQGFNWESNKQQGGWYNSLINLIPDLANAGITHVWLPPSSHSVSPQGYMPGRLYDLDASKYGNKQQLQSLVQALHAKGIKAVADIVINHRCADYKDSRGIYCLFEGGTSDGRLDWGPSHICKDDTQYSDGTGNPDTGMDFAAAPDIDHLNSRVQKELSEWMNWLKSEIGFDGWRFDFVRGYAPSITKIYMGNTSPDFAVGEFWNSLAYGSDGKPNYNQDNHRNELSQWVQNGGGSVTAFDFTTKGILQAAVQGELWRLKDSNGKPPGLIGISPKNAVTFVDNHDTGSTQKLWPFPNDKVMQGYAYIITHPGVPSVFYDHFFDWGLKAQILLISSRNRNGITETSSVNILAADHDLYVAKVDDKVIVKIGTRMDLGNLIPPGFKVVASGQDYAVWEKKAYIY

SEQ ID NO: 80497 - protein, 349 aa, Solanum tuberosum
MKTIQGQSATTALTMEVARVQAISSITKCMDTIPSEYIRSENEQPAATTLQGVVLEVPVIDISNVDDDEEKLVKEIVEASKEWGIFQVINHGIPDEVIENLQKVGKEFFEEVPQEEKELIAKKPGAQSLEGYGTSLQKEIEGKKGWVDHLFHKIWPPSAINYRYWPKNPPSYREANEEYAKWLRKVADGIFRSLSLGLGLEGHEMMEAAGSEDIVYMLKINYYPPCPRPDLALGVVAHTDMSYITLLVPNEVQVFKDGHWYDVNYIPNAIIVHIGDQVEILSNGKYKSVYHRTTVNKYKTRMSWPVFLEPSSEHEVGPIPNLINEANPPKFKTKKYKDYVYCKLNKLPQ

SEQ ID NO: 80498 - protein, 514 aa, Magnaporthe grisea 70-15
MFKSGLSPIARAARPASRLAARPSLRLPKYSLGARFASTQGVGDGKIHQVIGAVVDVKFDTAKLPPILNALETTNNNQKLVLEVSQHLGENVVRCIAMDGTEGLTRGAKAKDTGAPITIPVGSGTLGRIMNVTGDPIDERGPIKTDKYLPIHAEAPEFVEQSTTAEILVTGIKVVDLLAPYARGGKIGLFGGAGVGKTVFIQELINNIAKAHGGYSVFTGVGERTREGNDLYHEMQETSVIQLDGESKVSLVFGQMNEPPGARARVALTGLTVAEQFRNEGQDVLLFIDNIFRFTQAGSEVSALLGRIPSAVGYQPTLAVDMGGMQERITTTQKGSITSVQAVYVPADDLTDPAPATTFAHLDATTVLSRGISELGIYPAVDPLDSKSRMLDPRIVGQEHYEVATRVQQILQEYKSLQDIIAILGMDELSEADKLTVERARKIQRFLSQPFTVAQVFTGIEGKLVDLKDTIASFKAILAGEGDSLPEGAFYMVGDLASAREKGEKILAELEKDA

SEQ ID NO: 80499 - protein, 263 aa, Haemophilus influenzae R2866
MARRPLVMGNWKLNGSKAFTKELIEGLKAELHDVTGCDVAIAPPVMYLGTAEAALSGCGCSCGGKSVIQLGAQNVDINVKGAFTGDISSEMLKDFGAKYIIIGHSERRTYHKESDEFVAKKFGALKEAGLVPVLCIGESEAENEAGKTEEVCARQIDAVINALGVEAFNGAVIAYEPIWAIGTGKSATPAQAQAVHAFIRGHIAAKSQAVAEQVIIQYGGSVNDANAAELFTQPDIDGALVGGASLKAPAFAVIVKAAAAAKN

SEQ ID NO: 80500 - protein, 565 aa, Corynebacterium glutamicum
MADVNQDTVLKGTGVVGGVRYASAVWITPRPELPQAGEVVAEENREAEQERFDAAAATVSSRLLERSEAAEGPAAEVLKATAGMVNDRGWRKAVIKGVKGGHPAEYAVVAATTKFISMFEAAGGLIAERTTDLRDIRDRVIAELRGDEEPGLPAVSGQVILFADDLSPADTAALDTDLFVGLVTELGGPTSHTAIIARQLNVPCIVATGAGIKDIKSGEKVLIDGSLGTIDRNADEAEATKLVSESLERAARIAEWKGPAQTKDGYRVQLLANVQDGNSAQQAAQTEAEGIGLFRTELCFLSATEEPSVDEQAAVYSKVLEAFQESKVVVRSLDAGSDKPVPFASMADEMNPALGVRGLRIARGQVDLLTRQLDAIAKASEELGRGDDAPTLGMAPMVATAYEAKWFADMCRERGLIAGAMIEVPAASLMADKIMPHLDFVSIGTNDLTQYTMAADRMSPELAYLTDPWQPAVLRLIKHTCDEGARFNTPVGVCGEAAADPLLATVLTGLGVNSLSAASTALAAVGAKLSEVTLETCKKAAEAALDAEGATEARDAVRAVIDAAV

SEQ ID NO: 80501 - protein, 216 aa, Burkholderia vietnamiensis G4
MMSSRPQSPVPGNGQADECVTLVATATLPTRYGTFTSYAFRVSGSDAEHLALVMGDVGGAQSVLTRLHSECLTGDVFGSYRCDCGEQLDLALRYIAAEDRGVLLYLRGHEGRGIGLSNKIRAYALQEQGRDTVEANLDLGLPDDAREYDSAAAILRILGVTSVRLMSNNPKKFDTLVKHGIPVCERVALAVPMREENERYIRTKQVKFGHYFEENE

SEQ ID NO: 80502 - protein, 153 aa, Burkholderia vietnamiensis G4
MSTTVAQILKAKPDSGRTIYTVTKADFVYDAVKLMAEKGIGALLVMEGDEIAGIVTERDYARKVVLQDRSSKATRVDEIMTSKVRYVEPSQSSDECMALMTEHRMRHLPVLDGGKLIGLISIGDLVKSVIADQQFTISQLEHYIHGTPVITSA

SEQ ID NO: 80503 - protein, 169 aa, Oryza sativa Japonica Group
MAATADNGEKMILLISSDGERFELSEAAASQSKTLSHMIEDDCTDNGVPLPNVTAVVLAKVVEYFKKHAAVTPKPATEAVAADKAKREEELKSFDAEFVDVDRTMVFELILAANFLNAQDLLDLTCQHAADLIKDMSVEEVREVFNITNDFTPEEEAEVRKENAWAFDN

SEQ ID NO: 80504 - protein, 423 aa, Arabidopsis thaliana
MQKEIAGDAPSAPTTRVRHRKRNSDVGAGAGKPNGNHLLVNDSKKYKSFLIRAYSTFWMIGGFALIVYLGHLYITAMVVVIQIFMARELFNLLRKTHEDKQLPGFRLLNWHFFFTAMLFVYGRILSQRLVNTVTPDKVLYRLVTSLIKYHMAICYSLYISGFVWFILTLKKKMYKYQFSQYAWTHMILIVVFTQSSFTVANIFEGIFWFLLPASLIVINDIFAYICGFFFGRTPLIKLSPKKTWEGFIGASITTVISAFLLANIMGRFLWLTCPREDLSTGWLLCDPGPLFKQETHALPGWISDWLPWKEISILPVQWHALCLGLFASIIAPFGGFFASGFKRAFKIKDFGDSIPGHGGITDRMDCQMVMAVFAYIYHQSFVVPEVLSVDKLLDQIITSLTLEEQQALLVKLGQMLQEKVIGS

SEQ ID NO: 80505 - protein, 358 aa, Cryptococcus neoformans var. neoformans JEC21
MDLASQENSQRANRWDKGIKIGEGTFANVYKGTEKATGRKVAIKKIKVGEMKHGLDMTALREVKFLQELKHPNIISLLDVFSVKQNINLVLEFLDTDLEAVIRDKALIFQNADIKSWMAMSLRGLEYIHRNGVLHRDLKPNNLLIAANGELKIADFGLAREFGDAGNKMTCQVITRWYRPPELLFGSRYYSPTVDIWSMGTIFVELILRVPFLAGETDIDQLKKTFHAMGTPTEQDWPGYTKLPDYHEVGSFPKNPWWNMISSIGREGQDLARELLRFDPAQRPSAKKALLHSFFTSYPPPTPPIALPKPLAELRPRELAPDETQGKPLLTSGAGQSLKRKAESPRTSQSVPRKLIFT

SEQ ID NO: 80506 - protein, 94 aa, Triticum aestivum
  misc_feature (17)..(17): Xaa can be any naturally occurring amino acid
  misc_feature (50)..(50): Xaa can be any naturally occurring amino acid
  misc_feature (55)..(55): Xaa can be any naturally occurring amino acid
PAGGGPLLETVTFCRRXEDAPEFAKKLASVADLYVHDAFGAAHRAHASAXGVARXLMPSVAGFLLPKELDSLVGAAANPQTPFAALVGGSGASS

SEQ ID NO: 80507 - protein, 400 aa, Arabidopsis thaliana
MNNLDEIKIESKTCLNDQEQEVKIDNMHMSDQDKNKIEIKNKSGLGEKWPEPIVRVQSLAESNLTSLPDRYIKPPSQRSQTTIIDHQPEVADINIPIIDLDSLFSGNEDDKKRISEACREWGFFQVINHGVKPELMDAARETWKSFFNLPVEAKEVYSNSPRTYEGYGSRLGVEKGAILDWNDYYYLHFLPLALKDFNKWPSLPSNIREMNDEYGKELVKLGGRLMTILSSNLGLRAEQLQEAFGGEDVGACLRVNYYPKCPQPELALGLSPHSDPGGMTILLPDDQVVGLQVRHGDTWITVNPLRHAFIVNIGDQIQILSNSKYKSVEHRVIVNSEKERVSLAFFYNPKSDIPIQPMQQLVTSTMPPLYPPMTFDQYRLFIRTQGPRGKSHVESHISPR

SEQ ID NO: 80508 - protein, 1430 aa, Cryptococcus neoformans var. neoformans JEC21
MVPPARAHTHNTTNTKQAQLSSAYHELANELGTDNISVVGNYTLGRVIGQGTYGSVHLATHRLTGTRAAVKKVPKSFTPHLTRELHHHRRLHHPHIVHLHEIIATESHIWLVTELCSGGELFDYLVERGRILEGEARRLFGELTLAVGWLHMHGVVHRDLKLENVLLDGELRIKLGDLGFAREWQKGRLMDTYCGTTGYASPEMLACQKYLGVETDIWSLGIILYTLLCGGLPFDDDDERVMKELIQKGEYEEPDWLSQEARDLIRGMLQHDPSKRLSIREILTHPWFKMTIVDKVYPNGDVPSIPPSPNPTSPTAAGDDFFAESALRQQQQQQSRLTPHVAGRSPLSTHLPTTPRQNSGSSEAENGDSRTERKASNMQRLNSAEFSTTEKELEQLHLCTSRPAATATGSGAISPRSISSPSMRGKTLRTLPEGQVDVDETPAGLPPPLSLIDEHPHLPVALHSRTPSRTKRRSVSSTLSLERRLSHHSSHNSYITFPPEDYLSKLDPSLLPNPDSSSSSTTTPPARSFTTPSETRLLRQLDDLGLDVGQLKHSVETDACDASAGLWWLLRQKQEERGETDEVVRRREKEVVRREEKVAEYAKEERRKAREAERERERIPTSPMGILGTRPGKRDSIEKSSEGLRFKEEQPPSIPTTPSYTSVIDLGPPVLPVDVDVDVERTAVGRDAPREAAGEEMKSWKRVESPQSVAISSQSSLDPAPTLPPPAAAGGGGAAGAKTQKEDGRDQAGLDPVAVATPMSNANSSTGASTVAKPEPNVNASANANTSANPRLKAKSPSMNMLQRATSVLGGVGKKGDDKDKDKNGMNEKREESTNDSLHPKRGGSSSPNKLKKPMPAGMKGLTSTLSRSESESEGLLAGGGGGGGGGDSPAVSASGSKTVTPGSSPRRKGLTPQGTPRGGLRDAGAKDSSGERASGNGNGNAGGGNEKGKGGKKDSLWTTFRHLFYEDRRRRKRESVTPSASSPLLLPPSDIKLPAGAVVLSRGANSRTSQFKRSNVGYAPSTGSRRTSLDGNRPVYSRRSSSVHTTSRRSSVGSLHFQDHQAMISDLSRRASQRSHGSQTPTSDREYLDYPSAAAPISRPGSSHSIRGGVGGGSRRSSFSVRSPSLHPETFSASAGGPTSTRFKSSVPPPASPLLGYRRRPAGGNDSSRVRHIKVIPESQIMRSSSVASSIRSNASSRASSMDRDRDRDRESEYESGRDDVSLRSGKRQKRRSGSQRSLAQQIHRTRSPLALSLENTYGSNSVANVGLGIGGASRIPKKPLRDVFQKKGKRKDGGDDDWVSEDEDGFACGLGQGRGIAKSFSNANANGTVWMNVNAKTNPARSAAAFPTSKMVAQPTAQGGTSRRRERGRRSSLEEERGRPQEGKGKAKGETAAQGLMGIESLSGRSRRNLPDRSTAPGIIEEEEEDEE

SEQ ID NO: 80509 - protein, 318 aa, Oryza sativa Japonica Group
MADNAAAAADSAARTRYARGQLEALRAAPSEEAQARLWAEVSAALAAAGFSGENGDSGVRYEHYVDEPRSVLQVIEEPFVQGGNAEYEDADSDDDYDGILKPAFAVDGDPDFESGEPLDGFEYLRRVRWEANQIPRVKVAKIDLNTARNEQTPYMPEIPDIAKCSPDLCASKPWEDTFITYFSETRLAFSELDSSDGPSVSGGTKNLLKPSNRSEPQTDPTLTMIRNMDAVSRAATLRNYIDMIQSLDKLSRNDCLWLFSLCVAVDTPLDAETCASLRSLLRKCANVLAAKLEMDDEVAMLNILITISGRFFGQYDNH

SEQ ID NO: 80510 - protein, 327 aa, Streptomyces lavendulae
MRIAITGSIATDHLTTFPGRFAEQLIPDRLDTISLSFLVDDLEVRRGGVAANIAFGLGRLGFSPLLVGAAGTDFPEYDSWLREHGVDTGSVRVSATRHTARFMCTTDADQNQIASFYTGAMVEAREIDLADVVRRSGPLDRVVVAPDDPEAMLRHSAKTRELGIPLAADPSQQLARLNGDETRRLVDGAELLFTNEYEAALLQECTGWTAHQVLQRVGTWIITCGGDGVTIHNTDTPSVSVPAVPAKNVADPTGVGDGFRAGYLAGIGQGLSQERAAQLGCALATTVLESVGTQEYRLDRSSLTARIADAYGDGPAAEITPHLQAKP

SEQ ID NO: 80511 - protein, 638 aa, Pseudoalteromonas tunicata D2
MIQISQLELLRGGKALLKDANATLFPNHKVGLVGANGCGKSSLFALLKGELHLDSGNCSVPKDWTISSVKQETPALSISALEYVLQGHKAYYELRIQLQQAELSHDGEAQAKVHLQLEAINGYSIESKAGELLHGLGFNNEQISLPVSSFSGGWRMRLNLAQALIFESDLLLLDEPTNHLDLDAVYWLERFLNAYTGTLVLISHDREFLDAVVDEIWHIENQKINIYKGHYSQFERQKAERLSQQQASFEKQQDQIAHLEKFIARFKAKASKAKQAQSRVKALERMEKLAPAHVDSPFDFEFAEPLALPNPLMTLDQAKAGYGEVTILDSIKFNLVPGSRIALLGRNGAGKSTLIKLLAGELAPQSGEVFQHKGLNIGYFAQHQLESLDLSASAVLHIQRLDPQAPEQRIRDFLGGFAFFGDKALEPVAPFSGGEKARLVLAMLVYQKPNLLLLDEPTNHLDLEMRHALVMALQGFEGAMVTVSHDRHMLKNTADEYYLVDQGQVTPFGYDLDAYYQWLLAANKADNVVEDKADKTHSAVNRKDQKRREAEFRQAVQPLKKKITQLETKLDKVTAQLQEVENALADNSLYDAQNKAILTELLAKQAKLVPEQNDLEELLLELLEELEQHENEFNAQLD

SEQ ID NO: 80512 - protein, 516 aa, Leptospira interrogans serovar Lai str. 56601
MKLLGGVVERSGTGEYGPASLQLHGTNGNSILKNFVGGEQVWMNHADEVVKLPEGFSKIAFSKDCGYAVVANSSKKIFGIQFHAEVSHSEKGSVLLDNFIQICGVSKTWGIDQFLKEKIKEIQETVKQEQKIFMLVSGGVDSTVSYLLLCKALGAERVLGFLIDTGFMRKDEVVSLQKKLTFQNIHLTVRDESSLFYKSLKDKSDPEEKRKIVGNLFLEARDRAVKDLDLEYGDWLLGQGTIYPDTIESGGTKHSHTIKTHHNRVEAIQKLIEQGKVIEPIRDLYKDEVRDLGVLLGLESEWVGRHPFPGPGLVVRMLAVEKKGTDKDQLEIDSYLSTQDGLSGKILPIASVGVKGDRRSYANCVVLNDIETDWNTLDRVATHLSNRFSFINRVVLLPFESDLKKWNFQFTGMQLDKKCSDLLREADFTVESVIRKLGLYNKIWQMPVVLLPIGEKENEKSIVLRPVESQEAMTANFFRMERSVLQEIKIEVLKIPEIRYLFFDLTNKPPGTIEWE

SEQ ID NO: 80513 - protein, 521 aa, Nicotiana tabacum
MESGSMEMKVQQPYLAVPVLPPRWKIVMVASIAAGVQFGWALQLSLLTPYLQLLGIPHRYASIIWLCGPISGMIVQPAVGYLSDNLSSTFGRRRPFIAAGSSLVAVAVIFIGFAADIGHAFGDPLDTKTKPLGIITFIVGFWYLDVANNMLQGPCRAFLADLSGGKACRIRTGQSCYAFFMAVGSILGNAAGSYSHLYTIFPFTKTEACGVQCANLKSCFLISVVLLLTLTTLALTAVDEKVLPQKDHFINSEYLGSSGKKGGLLFFGEMFEALKHLPRSVWILLMVTAVNWIAWFPFTLYGTDWMGKEVYGGRVRDGNLYNKGVHAGVFGLLLSSVVLCLMSLGVECVGKWLGGAKRLWGIVNFILAICLAMTVFVTKMADKSRRYDGDGELLPPDQGVKISALLLNAVTGIPLAVLYSIPFAMASIYSSNVGAGQGLSQGVINLAIVVPQTLVSISGRPFDALFGGGNLPAFVAGAVAAAVSGILALTLLPSPTEPCQTYPHFRRCFPMTKYWTSQNKF

SEQ ID NO: 80514 - protein, 340 aa, Saccharomyces cerevisiae
MTVSKIPIWLDCDPGHDDAIAILLGCFHPAFNLLGISTCFGNAPPENTDYNARSLLTAMGKAQAIPVYKGAQRPWKREPHYAPDIHGISGLDGTSLLPKPTFEARTDKTYIEAIEEAILANNGEISFVSTGALTTLATVFRCKPYLKKSVKYISIMGGGLHGLGNCNPNLSAEFNVWIDPDAANYIFRDPDVKDKCIVVPLNLTHKAIATYKVNEMIYNEKNNSKLRELFLELFQFFAHTYKDMQGFESGPPIHDPVALMPLLEFYGWDPSSAVGFRYKRMDISCIDDVFNENSGKIIIEKEYPNDSDVGTIIGLDLNIQYFWDQIFEALNRADKMSTIG

SEQ ID NO: 80515 - protein, 798 aa, Oryza sativa Japonica Group
MALPITVLFLLFTLHIPASCKVTDTISAGETLAGNDILVSSNGKFALGFFPTSSKSSHNASNWYLGIWFNQVPKLTPAWVANGDEPVTGPTSPEATISGDGNLVILDQATKSIIWSTQADITANTTMVKLLDNGNLVLQNTSNSSVVLWQSFDYPTNTHLAGAKLGRNKVTGLNRRLVSRKNSVDPASGMYSYELTDNNGSTRFILAALNSSIPYWSSGEWNGHYFGSIPEMTGQRLIDFTFVNNDEEVYFTYTLLDNATIMRFMLDISGQTKIFLWVEHVQDWVPTYTNPKQCDVYGICGAFTVCEESKLPICKCMKGFSVRSPNDWELDDRTGGCVRNTPLDCGINRNTSMQDRFHPMPCVGLPSNGQIIEDVTSAGGCAQICLSNCTCTAYYYGNTGCSVWNDELINVKQLQCGDIANTDGAILYLRLAAKEVQSIKSSGRSIFIGVAITASVASFALALFLIAKIPRNKSWLLGHRRKNFHSGSGVIAFRYADLQHATKNFSDKLGAGGFGSVFKGLLNESTVIAVKRLDGARQGEKQFRAEVGSIGIIQHINLVKLIGFCCEGDRRLLVYEHMPNLSLDTHLFHNDATVLKWSIRYQIALGVARGLAYLHDSCQDCIIHCDIKPENILLDASFVPKIADFGMAKFLGREFTQVLTTMRGTIGYLAPEWISGTVITSKVDVYSYGMVLLEIISGTRNSSKEFATRDDYEYFPLLVAHKLLDGNAGSLVDQNLHGDVDLEQVERAFRVACWCIQDNELDRPTMSEVVQYLEGLLEVGIPPVPRLLQAIAGNPYSK

SEQ ID NO: 80516 - protein, 805 aa, Oryza sativa Japonica Group
MLLPCHVLLGLLLLSLHTPASSAAATDTVSPGHSLAGSDRLVSNNSKFALGFFKPGNESSYTNHNSYLGIWFNKVSKLTPLWTANGENPVVDPTSPELAISGDGNLAILDHATKSIIWSTRANITTNDTIAVLLNNGNLVLRSSSNSSNIFWQSFDYPTDTLFAGAKIGWDKVTGMNRRLVSRKSSVDQAPGIFSLELGLNGEGHLLWNSTVAYWSSGDWNGRYFGLAPEMIGDVMPNFTFVHNDKEAYFTYTLYDDTAIVHAGLDVFGIGFVGMWLEGNQEWFKNYRQPVVHCDVYAVCGPFTICDDNKDLFCDCMKGFSVRSPKDWELDDQTGGCIRNTPLSCGSSKDRTSLTDKFYPMQSIRLPHNAENVQAATSGDECSQVCLSNCSCTAYSYGKDGCSIWHDELYNVKQLSDASSDRNGGVLYIRLAAKELPGSEKKKNRNISGFAIGASTATLFLMILLLILWRRKGKWFTRTLQKPEGGIGVVAFRYINLQRATKAFSEKLGGGSFGSVFKGYLGNSTIAVKRLDGAYQGEKQFRAEVNSIGIIQHINLVKLIGFCCEGDNRLLVYEYMPNRSLDVCLFEANDIVLDWTTRYQVATGVARGLAYLHNSCRDCIIHCDIKPENILLDASYVPKIADFGMAKILGREFSRAMTTMRGTIGYMAPEWISGTVVTSKVDVYSYGMVLFEIISGRRNSSHECFRDGDYSFFFPMQVARKLLNGDIGSLVDASLKGDMNLVEVERACKIACWCIQDNEFDRPTMAEVVQALEGLLELDMPPLPRLLSAITGDSHSVTPQYFDSV

SEQ ID NO: 80517 - protein, 325 aa, Brassica napus
MRCLTTVALPLSLFLVGLVGPIQGQLQMNFHANTCPNAEKIVQDFVSNHISNAPLAAALLRMHFHDCFVRGCDGSVLINSTSGNTEKDAAPNLTVRGFGFIEAIKAVLEAQCPGIVSCADIIALASRDAIVFTGGPNWSVPTGRRDGRISNASEALANIPPPTSNFTNLQTLFANQGLDLKDLVLLSGAHTIGVSHCSSFTNRLYNFTGRGDQDPALDSQYAANLKSRKCPSLNDNTTIVEMDPGSRKTFDLSYYQLVLKRRGLFQSDSALTTNPTTLSNINQILKGSVESFFSEFAKSMEKMGRINVKTGSAGVVRRQCSVANS

SEQ ID NO: 80518 - protein, 535 aa, Thermosynechococcus elongatus BP-1
MTHSTLHQPDTATGQGLQRQLIVILDFGSQYSELIARRIRETQVYSEVISYRTTAEQLAQLAPKGIILSGGPNSVYDENAPQCDPEIWNLGIPILGVCYGMQLMVQQLGGTVERAIAGEYGKAALFIDDPTDLLTNVEQETIMWMSHGDSVTELPPGFRVLAHTDNTPIAAIAHPERKLYGVQFHPEVVHSVGGIALIRNFVYHICDCEPTWTTAAFVEEAIREVRAKVGDKRVLLALSGGVDSSTLAFLLHRAIGDQLTCMFIDQGFMRKGEPERLLKLFQEQFHIKVEYVNARDRFLAQLVGVTDPEEKRKRIGHEFIRVFEEESQRLGPFDYLAQGTLYPDVIESANTNIDPQTGERVAVKIKSHHNVGGLPENLRFKLVEPLRKLFKDEVRQVGRSLGLPEEIVQRHPFPGPGLAIRILGEVTPERLEILRDADLIVRQEINRAQMYHELWQAFAVLLPIRTVGVMGDQRTYAYPVVLRFVTSEDGMTADWARVPYDLLERISNRIVNEVPGVNRVVYDITSKPPGTIEWE

SEQ ID NO: 80519 - protein, 600 aa, Synechococcus sp. WH 8102
MALLVQKFGGTSVGSVERIQAVAERISRSREEGHDVVVVVSAMGHTTDELTGLAAAITDTPQQREMDMLLASGEQVSIALLAMALNQQGVAAVSMTGPQVGIVTESTHGRARILEIRTDRIRGHLADGRVVVVAGFQGTSSGIGGVAEITTLGRGGSDTSAVALAAALNADACEIYTDVPGVLSTDPRKVADAQLMDEISCDEMLELASLGASVLHPRAVEIARNYGVLMVVRSSWSEAPGTRLTSRRGRPLNQTGLELGSPVDGVEQMDHQAVIALSHIPDQPGIAARLFETLSGAGINVDLIIQSTHEGSSNDITFTVAEADLEAARSVSQTVLDSLGGELAAEGGMTKLSISGAGIMGRPGIAAGLFHCLSQQGINLRLIATSEVKVSCVIDADSGRKALQAVQEAFDVADAQVELNPDLSISDVPEVRGVALDRDQAQLSVRHVPDRPGTAAALCSALAERGISLDAIVQSERQHTDGSRDISFILRKEDRSRADVALAPLLAQWPGAALEEGESIARVSAVGAGMPATPGTAGRMFRALADAGINIALIATSEIRTSCVVAEQDGVAALQAVHAGFGLGGQEQHTAQGSASPLDS

SEQ ID NO: 80520 - protein, 203 aa, Yarrowia lipolytica CLIB122
MASHLASIYGTENDKVNCSFYYKIGACRHGEKCSRKHVKPTYSNTVLCSNLYQNPANGESDPLNEDGSKMTKADLDKHFALFYEDIYMEAAKLGRLEEMIVCENGNDHLTGNTYLRFRNQEDAQRACDLFNTRWYAGRPVWCELSPVNDFTESCCRQHDTNECSRGNMCNFMHAKRPPRQLAKDLDASQRKFYNRQRDRKSKR

SEQ ID NO: 80521 - protein, 338 aa, Nocardioides sp. JS614
MRATTIHGLRDIRVSEVPDPAITAPTDAIVKVVAGCICGSDLWPYRGENDIRPGATIGHECVGVVEEVGAEVRSVRPGDFVIVPFDHCDNTCPHCLAGAQSACVNLGFTVSGQAEYARVTQADGSLVATQGTPDAGLVPSLLTLSDVLPTGWHAAVSAGVREGGTAVVVGDGAVGLCGVLAASVLGAETIVAMSRHEPRQELARRFGATHIVAERGDEGTAAIMEITGGVGADAVLECVGTDQAMRTAFSTARPGSTVGFVGVPHGVELPVREMFQRNIGLAGGMAPTRRYIPELLELVLADRIEPGLVFDSTLPLDQVAEGYRAMDERQAIKVLIEP

SEQ ID NO: 80522 - protein, 583 aa, Burkholderia vietnamiensis G4
MRRLVVLTLLSAVGACAFAASEPAVEATHGMVVSSQHFASQIGVDILKAGGNAVDAAVAVGYAQAVTNPCCGNIGGGGFMTVHLADGRDRFINFRETAPAAASANMYLDANGNVIPNQSLYGYRAVGVPGTVAGLDLAQRKYGKLTRRQVMEPAIRLARDGFVLTRGDTDILDTTIERFRKDPEAARIFLRADGTPLQPGDRLVQKDLARTLERIAERGPDALYHGEIPKLVEAASTRGGGVITAADFASYRAQDIAPLTCTYRGYEFVSAPPPSSGGVTMCETLNVLEGYDLRKMGYQSAAVVHYMTEAMRHAYEDRNTLLGDPNFIDNPVAKLTSKQYAAEIRKQISDDAATASVDVQPGIGVHEKPETTHYSIVDRDGNAVSTTYTVNGRFGAVVIAPGTGFFLNDEMDDFTVKVGAQNLFGLVQGTRNSIAPGKRPLSSMAPTIVKKDGKVFMVVGSPGGSRIITITLQTVLNVIDYGMTPQDAVGAPRIHHQWLPDEVYYETRGLSPDTLSILRKMGYKMVEQTPWGAAELILLGLPGTEVASRQSSGNDASVSGNVRVGYLYGVNDPRRPAGAAIGY

SEQ ID NO: 80523 - protein, 391 aa, Streptococcus agalactiae NEM316
MTLEKRFNKYLDRIEVSLIRQFDQSISDIPGMVKLTLGEPDFTTPDHVKEAAKSAIDANQSYYTGMSGLLALRQAAADFAKDKYNLTYNPDCEILVTIGATEALSASLIAILEAGDVVLLPAPAYPGYEPIVNLVGADIVEIDTRENDFRLTPEMLETAIIQQGEKLKAVLLNYPTNPTGITYSRQEIASLAEVLKKYDIFVISDEVYSELTYTGQQHVSIAEYLPNQTILINGLSKSHAMTGWRVGLVYAPEAFIAQIIKSHQYMVTAASTISQFAGVEALSVGKNDTLPMRQGYIKRRDYIIDKMSKLGFKIIKPSGAFYIFAKIPDSYPQDSFKFCQDFAYQQAVAIIPGVAFGKYGEGYIRLSYAASMEVIETAMARLKVFMESYEG

SEQ ID NO: 80524 - protein, 189 aa, Campylobacter lari RM2100
MPKQKDPAYRSCVELVFNYPGVWAVVNYRFAHFFYIKNYKRIARMISGISQFLTGVDLHPGAKLGRRIFIDHAIGVVVGETAIIGNDVIIYQGVTLGGTSLDKNTKRHPTIEDGVIIGSGAKILGNITIGKNAKIGSNAVVLKDVEANLTAIGIPAYIKEHGKIDYEEKIAKLEARLAILEEKLNKEDK

SEQ ID NO: 80525 - protein, 151 aa, Pyrobaculum aerophilum str. IM2
MAVTIDPKTFYANPPPGKPFYVRFEVPNDVAEKALEILSIARQTGKIKKGTNETTKAVERGLAKLVLIAEDVDPPEVVAHLPLLCEEKKVPYVYVPSKEKLGKAAGINVSAAAAVVIEPGQAAGELEALVSKINEVRAKHGLNAIPVPAKR

SEQ ID NO: 80526 - protein, 558 aa, Nocardia farcinica IFM 10152
MAEFIYQMKKVRKAHGDKVVLDDVTLNFLPGAKIGVVGPNGAGKSSVLKIMAGLDQPNNGEAFLAPGATVGILQQEPPLNEEKTVRGNVEEGLGEVKVKLDRFNEIAELMATDYSDELMEEMGKLQEYLDHADAWDVDSQLEQAMDALRCPPPDEPVTNLSGGERRRVALCKLLLSKPDLLLLDEPTNHLDAESVLWLEQHLAQYQGAVLAVTHDRYFLDNVAGWILELDRGRAYPYEGNYSTYLEKKAERLEVQGKKDQKLQKRLKEELAWVRSGAKARQAKNKARLGRYEEMAAEAEKMRKLDFEEIQIPAGPRLGNVVVEVEHLDKGFGDRQLIKDLSFTLPRNGIVGVIGPNGVGKTTLFKTIVGLEQPDSGTVRIGETVKLSYVDQNRAGIDPNKTVWQVVSDGLDYIEVGQQEMPSRAYVSAFGFKGPDQQKPAGVLSGGERNRLNLALTLKQGGNLILLDEPTNDLDVETLSSLENALENFPGCAVVISHDRWFLDRTCTHILAWEGDADNEAKWFWFEGNFEAYEANKIERLGPEAARPHRVTHRKLTRD

SEQ ID NO: 80527 - protein, 382 aa, Deinococcus radiodurans R1
MWASQRASSVPGSVFSLMDAAKMRARGRGLNVTDLSIGSSDQHPPLSVLDELRAATHDPATYRYPLFSDTQPLRDAAAAYLARRFGVRLNADTEVLPLIGAQEGLAHLLLAVTDPGDTLLLPDPCYPPYWGAAAVAGLNVVTLPLLPERGFLPDLSRVPANVRPRVLLLNYPNNPTSAIASAEFFREAAAWCRERGTLLVHDHPYAELTFGDYRAPSALEAGMEGVVELHSLSKTHHLGGFRVGFAAGDAGAVAALARVKGAIDFHPYLGIQRAAAHALGLPDEVGRVGARIFEERRDALLSALRDLGWEVQTPQASMYAWAQVPGLRDSVAFAVRAAEETGVVVSPGQAFGERGEGFVRFALVQPPEVLRGAAAKLGEVGV

SEQ ID NO: 80528 - protein, 128 aa, Arabidopsis thaliana
  misc_feature (29)..(29): Xaa can be any naturally occurring amino acid
  misc_feature (54)..(54): Xaa can be any naturally occurring amino acid
  misc_feature (68)..(68): Xaa can be any naturally occurring amino acid
  misc_feature (105)..(105): Xaa can be any naturally occurring amino acid
RVQKGSSMHSSATMVASPAHAIMVAHFNXLKSSAAFTSTRIANNNITSIRSNGXRVNCIQVWPPIWKXRTFLTHSYLRDIEESKMDMEFDDLNRLKFIPCVEIYXSTGFYNVTMVNHPGTITDCTASC

SEQ ID NO: 80529 - protein, 589 aa, Shewanella sp. MR-7
MEESSLLTSVLLFLLAAVIFVPLGKRFGAGPILSYLAAGVILGPGGMALVSDPAAVLHFAELGVVLMLFVLGLELNPSKLWELRSAIFGLGSGQLLLSWAAIGGLAWGFGLSIEAALVVGAALSLSSTAFAVQLMSEHRLLTTPLGRDAFGVLLMQDLAVIPMLLLTAYLAPNSAQIEHHAVPWYWTCVALVGFVLVGKYLLPRLLKLVASSGVREVLTAFALLLVMGSAELMEWLGLSAGMGAFLAGIMLANSSYRHQLETDIEPFKGLLLGLFFMAVGMSMDLKLFLTDPLLILAILLGMLLIKTTVLMLLGRLRHHTWRPSIALGLILAEGGEFAFVLLSQAQLSSIVDDKIAQILVLAIGLSMAVTPMIFTLFRATKPKVVDTRLPDTINVTESEVVIAGFGRVGQITGRILASSGIPFVALDKDASHVDVIRKYGGEVYFGDARRLDMLMSAGIARSRLLLLAVDNVEDSIEIAQQVKTHFPHINIVARARDRNHAYRLMSLGVTDVFRETFGSALSASEKILQGLGLSQVQANERVKIFAEHDKKLVIASAAHQHDLAKLIDLSTKGKAELESLMRGDRENVS

SEQ ID NO: 80530 - protein, 158 aa, Solibacter usitatus Ellin6076
MPKVFEGQLSAAGLRFAIVVSRFNSFITDRLLGGAMDALTRAGADPELIDIVKVPGSWEVPLVTGELARQHRYDALICLSAVIRGETPHFDYVAGEAAKGIAHVSSETGVPVAFGVLTTNTLEQAIDRAGAKGGNKGFDAAMTAIEMANLLRTLRQAT

SEQ ID NO: 80531 - protein, 517 aa, marine gamma proteobacterium HTCC2080
MTWKTETDEIERRRELALNQGGEAAIAKQHSQNRLTIRERIEKLIDPGSLEEVGPAAGTPVYDENGVLTGLDPANFVLGFGKVGGRRIVVGGEDFTLRGGSPSAAGLRKSVYAEELAVQYRLPLVRLHEGSGGSVGGTGGKGPSLPGPVNAPARFRSVAQALGTVPVASAALGAVAGLPAGRLVASHFSVMSKSTAQILTAGPAVVARAMGEQKTKDELGGWKVHTKNGTVDNGAEDEASCIAEIRRFLSYMPDNIYQLAPVINCDDPVDRCDEHLIEVVPRNRRQAFDMRSIIASVVDRESFFEMGRGYGRSQITGLARLNGQTVGVWANDGKFLAGSMTADGAHKARRFMELCETFSFPIVSLVDEPGFMIGSQAEREATIRHGASAVLTAALTTVPWVSVMIRRSFGVAQAAHYGPDGYVIAWPSAESGPLPVEGGVAVAFRREIEAAPDPDARRRELEEQLAAKQSPFPRAEALGVHDLIDPRQTRPELCRWLDRVQPLLPSLLGPTAFSIRP

SEQ ID NO: 80532 - protein, 215 aa, Pseudomonas aeruginosa UCBPP-PA14
MSEKNPIVGLCQKASFLISAAQVDQCPPDEGLEVAFAGRSNAGKSSALNTLTHANLARTSKTPGRTQLLNFFALDDSRRLVDLPGYGYAKVPIPLKQHWQRHLEAYLSSRASLAGVFLMMDIRHPLTDFDRLMLDWAQASQLPIHVLMTKADKLAFGAAKNALLKVRREVQQGWGDVATLQLFSAPKRQGVDEAQMVLAQWLGLLDEDQEAFEEA

SEQ ID NO: 80533 - protein, 511 aa, Zea mays
  misc_feature (54)..(54): Xaa can be any naturally occurring amino acid
  misc_feature (74)..(74): Xaa can be any naturally occurring amino acid
  misc_feature (88)..(88): Xaa can be any naturally occurring amino acid
  misc_feature (99)..(99): Xaa can be any naturally occurring amino acid
  misc_feature (287)..(287): Xaa can be any naturally occurring amino acid
MDATPPSSRDLSPQPRRPASSAGPAKRVGLLLGRYELGRLLGHGTFAKVYHARXADTGETVAIKVLDKEKALRXGLVPHIKREIAILXRRVRHPNIVRXLFEVMATKSKIYFVMEFVRGGELFARVAKGRLKEDTARRYFQQLISAVGFCHARGVFHRDLKPENLLVDERGDLKVSDFGLSAVADQFHPDGLLHTFCGTPSYVAPEVLARRGYDGAKADIWSCGVILFVLMAGYLPFHDQNLMAMYRKIYRGEFRCPRWFSKDLSCLMNQLLDTNPETRITVAQIMXESRWFKKGFRPVRFYVEDDQVHSLADSEAEALEELGPSDSEPSPPPPPPPPPPPPQKEDDGDDSGWESDSSVASCPATLSSEERRRPVGSLPRPVSLNAFDIISFSRGFNLSGLFEERGNEVRFVSAHPMQTIITKLEEIAKVKSFAVRRKDWRVSLQGTREGEKGPLTIGAEVFELTPSLVVVEVRMKAGDREEYEEFCEGELKPGMLHLVHRTASVPDIPSA

SEQ ID NO: 80534 - protein, 383 aa, Triticum aestivum
MGSSCSRPHSVNEAEAADNTRSADIDRRILQETKADQHVHKLLLLGAGESGKSTIFKQIKLLFRTGFDEAELKGYTPVIHANVFQTIKILYDGAKELAQLETESSKNVISPDNQEIGEKLSEIGGRLDYPLLNKELVQDVRKLWEDPAIQETYSCGSVLQVPDCAHYFMENLDRLAEPDYIPTKEDVLHARVRTNGVVEIQFSPLGESKRGGEVYRLYDVGGQRNERRKWIHLFEGVDAAIFCAAISEYDQLLFEDGTQNRMMETKELFDWVLKQRCFEKTSFMLFLNKFDIFEREIQKVPLTVCEWFKDYEPIAPGKVQDVEHAYEFVKKKFEEVYFQSSKPERVDRVFKIYRTTALDQKLVKKTFKLIDESMRRSREGTGT

SEQ ID NO: 80535 - protein, 335 aa, Parvularcula bermudensis HTCC2503
MSPKDGHHSHRFCVAPMIDWTDRYCRWVHRLLSAKARLYTEMVVDEAILHGDRDRLLGFDSAEHPVALQIGGSDPRKLAEVAAIGAQAGYDEINLNVGCPSDRVQSGRFGACLMAEPETVAEGVRAMAAAVPCEVTVKCRIGIDDQSPEEALPRFLDAVEAAGVRTVIVHARKAWLEGLSPKENRTIPPLDYDLVVREAQRRPALSFILNGGLAGGAAAERWLTTFPGVMLGRAAYEQPFLLSEVDQRLFGAPPAARSRLEIVEAVADRAAAEAVPIWRYARHMLGLYHGQPGAKTWRRQLSEEGRSAKACPAWLVDVAETVSAKAEAPDRAPVA

SEQ ID NO: 80536 - protein, 278 aa, Oryza sativa Japonica Group
MAAASVLLLLPSPFLRPSSPAHRARCGIATTTTTSTSGRRGLFLFASRCRPGPRRRAASAAVPPEHGLSQPQPQARAVGSYEAALGDAKDALYAALEGMNRGIFGMTSEKRSEIHALVELLESKNPTPEPTDKLQDKVDGCWRLVYSTISILGKKRTKLGLRDFISLGDFFQMIDVKEEKAVNVIKFSARALKILSGQLTIEASYKITTKTKVDITLDSSTITPDQLMNIFQKNYDMLLAIFNPEGWLEITYVDESLRIGRDDKANIFVLERADPSEV

SEQ ID NO: 80537 - protein, 250 aa, Triticum aestivum
  misc_feature (207)..(207): Xaa can be any naturally occurring amino acid
  misc_feature (214)..(214): Xaa can be any naturally occurring amino acid
  misc_feature (230)..(231): Xaa can be any naturally occurring amino acid
  misc_feature (234)..(234): Xaa can be any naturally occurring amino acid
  misc_feature (237)..(237): Xaa can be any naturally occurring amino acid
  misc_feature (241)..(241): Xaa can be any naturally occurring amino acid
  misc_feature (244)..(247): Xaa can be any naturally occurring amino acid
  misc_feature (249)..(249): Xaa can be any naturally occurring amino acid
SATILVVAACLAAATAALILRRPRNGKPPGGVALLPPVASGVSAIAALGTLVTKGLPAVIHDLHGELGSVFTVSLLGLKKVTFLVGPEVTTHFFKGSESEIRQSDIYKITVPIFGRGVLFDVDLPTRSRQISFLSDAIKPVNLRGHVDSMVREVEDYFGKWGEHGTVDLKQELGLVLMRIANRCLLGEQIGDNMFDEVTHLLHELFXNGLHMTXLFFPYLPIPPHRRRDXXRAXLGXIFHXAVXXXXAXG

SEQ ID NO: 80538 - protein, 569 aa, Pseudoalteromonas tunicata D2
MSKPNSKQDPNAKFADNERLKTQSNFLRGTIEQDLKDEITGGFTADNFQLIRFHGMYQQDDRDIRAERAKQKLEPLHNVMLRARMPGGIITPAQWLAIDAFAEERTSYGSIRLTTRQTFQFHGVLKPNIKDMHQMLDSVGIDSIATAGDVNRNVLCTTNPVESELHQEAYQWAIKISEHLLPHTKAYAEIWLNGEKSETTEEPILGSTYLPRKFKTTVTIPPNNEVDVHANDLNFVAIAEDGKLVGFNVLVGGGLAMTHGDTDTYPRKADDFGYIPLEHTLKIAEHVVSVQRDWGNRVNRKNAKTKYTLDTFGSDEFKAEVEARAGIKFETSRPYEFTTRGDRIGWVEGIDGKFHLTLFIQNGRILDYPNQPLKTGCRKIAEIHQGDFRMTANQNLIVAGVPADQKAAIEQIARQHGLIDDGHTAQRFNSMACVSLPTCPLAMAEAERYLPSLIEKVELLLAKHHIAQDSIILRVVGCPNGCGRAMLAEVGLVGKGPGKYNFHLGGNLAGTRIPKLYKENVAEDVILAELDQLIGRWATERLDNEGFGDFVIRTGVIAEVKVSKTDFYA

SEQ ID NO: 80539 - protein, 390 aa, Triticum aestivum
MGSSCSRPHSVNEAEAADNTRSADIDRRILQETKADQHVHKLLLLGAGESGKSTIFKQIKLLFRTGFDEAELKGYTPVIHANVFQTIKVCQYWERILYDGAKELAQLETESLKHVISPDNQEIGEKLSEIGGRLDYPLLNKELVQDVRKLWEDPAIQETYSCGSVLQVPDCAHYFMENLDRLAEPDYIPTKEDVLHARVRTNGVVEIQFSPLGESKRGGEVYRLYDVGGQRNERRKWIHLFEGVDAVIFCAAISEYDQLLFEDETQNRMMETKELFDLVLKQRCFEKTSFMLFLNKFDIFERKIQKVPLTVCEWFKDYEPIAPGKVQDVEHAYEFVKKKFEEVYFQSSKPERVDRVFKIYRTTALDQKLVKKTFKLIDESMRRSREGTGT

SEQ ID NO: 80540 - protein, 708 aa, Saccharomyces cerevisiae
MPSTLTINGKAPIVAYAELIAARIVNALAPNSIAIKLVDDKKAPAAKLDDATEDVFNKITSKFAAIFDNGDKEQVAKWVNLAQKELVIKNFAKLSQSLETLDSQLNLRTFILGGLKYSAADVACWGALRSNGMCGSIIKNKVDVNVSRWYTLLEMDPIFGEAHDFLSKSLLELKKSANVGKKKETHKANFEIDLPDAKMGEVVTRFPPEPSGYLHIGHAKAALLNQYFAQAYKGKLIIRFDDTNPSKEKEEFQDSILEDLDLLGIKGDRITYSSDYFQEMYDYCVQMIKDGKAYCDDTPTEKMREERMDGVASARRDRSVEENLRIFTEEMKNGTEEGLKNCVRAKIDYKALNKTLRDPVIYRCNLTPHHRTGSTWKIYPTYDFCVPIVDAIEGVTHALRTIEYRDRNAQYDWMLQALRLRKVHIWDFARINFVRTLLSKRKLQWMVDKDLVGNWDDPRFPTVRGVRRRGMTVEGLRNFVLSQGPSRNVINLEWNLIWAFNKKVIDPIAPRHTAIVNPVKIHLEGSEAPQEPKIEMKPKHKKNPAVGEKKVIYYKDIVVDKDDADVINVDEEVTLMDWGNVIITKKNDDGSMVAKLNLEGDFKKTKHKLTWLADTKDVVPVDLVDFDHLITKDRLEEDESFEDFLTPQTEFHTDAIADLNVKDMKIGDIIQFERKGYYRLDALPKDGKPYVFFTIPDGKSVNKYGAKK

SEQ ID NO: 80541 - protein, 275 aa, Brassica napus
MSSLAASLVTGVGLRPERPILYQRTSFPSSRRNTHGVVKASARVDKFSKSDIIVSPSILSANFSKLGEQVKAVELAGCDWIHVDVMDGRFVPNITIGPLVVDALRPVTDLPLDVHLMIVEPEQRVPDFIKAGADIVSVHCEQSSTIHLHRTVNQIKSLGAKAGVVLNPGTPLSAIECVLDSVDLVLIMSVNPGFGGQSFIESQVKKIADLRRMCVELGVNPWIEVDGGVTPKNAYKVIEAGANALVAGSAVFGAKDYAEAIKGIKTSKRPETVAV

SEQ ID NO: 80542 - protein, 187 aa, Amphibacillus xylanus
SLIGTEVQPFRAQAFQSGKDFFEVTEADLKGKWSIVVFYPADFSFVCPTELEDVQKEYAELKKLGVEVYSVSTDTHFVHKAWHENSPAVGSIEYIMIGDPSQTISRQFDVLNEETGLADRGTFIIDPDGVIQAIEINADGIGRDASTLINKVKAAQYVRENPGEVCPAKWEEGGETLKPSLDIVGKI

SEQ ID NO: 80543 - protein, 160 aa, Synechococcus sp. WH 8102
MTTFEGRFTDTADLRIAVVVARFNDLVTSKLLSGCLDCLSRHGIDTAETSSQLDVAWVPGSFELPIVAQNLAQSGRYQVVITLGAVIRGDTPHFDVVVAEASKGIATVARESGVPVIFGVLTTDTMQQALERAGIKSNLGWSYGLQALEMGSLMAALAQS

SEQ ID NO: 80544 - protein, 206 aa, Actinobacillus pleuropneumoniae serovar 1 str. 4074
MLKLNYHKTHFLTSAPDIRHLPEDNGVEIAFAGRSNAGKSTALNALTNQKNLARTSKTPGRTQLINLFEVEPNCKLVDLPGYGYAAVPEQMKIQWQKALGEYLQKRECLRGVVILMDIRHPLKDLDQQMIEWAVSAQLPVLLLLTKADKLSQSARSKTVKMVREAILPFQGDIQVEAYSALNKVGIDKLSGKLDSWFAEQFLNQGA

SEQ ID NO: 80545 - protein, 205 aa, Campylobacter lari RM2100
MNLESIFEKTIKQNVRLIAASKYVQDEQIRELFKQGIFEFGENQVQALALKKEKLQDLEIKWHFIGNLQSNKINLLIKQKPVLWQSCNGIKIAKAVDKRLEYKLDTLLEINTANENSKSGIEQNKAIEEYLQIQEECENLNLVGIMCIGAMNEEKVQEGFEQTFKIYENLQKHGAKICSMGMSGDFELAIKCGSNMVRLGSILFK

SEQ ID NO: 80546 - protein, 235 aa, Deinococcus radiodurans R1
MTLTREELRRVSRPLLVPEWAEAGAQEKLRAARVLVVGAGGLGGPVIRQLAGAGVGALTVADGDTVSVTNLHRQQLYRTADVGRSKAETACAVAQGVNPFVQIQAAPALTPETAPTLIAAHDLTVDATDNFETRYLIADTCRELGREWVWGAASGVSGLCSVFGPHLGLRDVFPTPEDDSSCDELGVLGPVPNLVGDLMALQALLVLGGVGEPLRGKLWTFDALTGRVRVLKMGG

SEQ ID NO: 80547 - protein, 299 aa, Citrus junos
MGEEKKPQSAGVWPTVKPFVNGGASGMLATCVIQPIDMIKVRIQLGQGSAGTVTKTMLKNEGFGAFYKGLSAGLLRQATYTTARLGSFRILTNKAIEANDGKPLPLYQKALCGLTAGAIGASVGSPADLALIRMQADATLPAAQRRHYTNAFQALYRIVTDEGVLALWKGAGPTVVRAMALNMGMLASYDQSVEFFRDACGLSELPTVIGASTVSGFFASACSLPFDYVKTQIQKMQPDAQGKYPYTGSMDCAMKTLKAGGPFKFYTGFPVYCVRIAPHVMMTWIFLNQIQKLEKKVGL

SEQ ID NO: 80548 - protein, 173 aa, Brassica napus
MVDSPRASSSSSSLPPPRSYLIFMRIMSKRRTWVCLFVAVYAILLSSSWNFLRSVLSWYKLQYTSSPSPPSRIPAVYASVVLGAVFGAMSMVAAAAVAVPAVMVIWISVVVLLAFFGKSRRDLVVEARKITREVFGFVFKVLLKEGNAVAAVCAVLGYFLLIRKDFDPGSGFI

SEQ ID NO: 80549 - protein, 392 aa, Synechococcus elongatus PCC 7942
MPNFRLSQRLAPLQRNVFADMDRAKAVAIAAGREVIDLSLGSSDLPAPDHVVAVIAASLQDPSTHGYLLHQGTLPFRQVAAAWYERKFGLGVDPETEVLLLIGSQEGTAHLPLAVMEPGEIALLQDPGYPSHAGGVYLAGGEIYRLPTTADRGFLPDFSTIPTEILSRSRLLVLSYPHNPTTAIAPLAFFEEAVAFCRHHQLVLAHDFPYPDLGFDGVEVPSIFQADRQKQQAIEFFSLSKSYNMGGFRVGFAIGNAELIGALRRLKAVVDFNQYQGILAGAIAALTGPQACVEATRQRFRDRRDIFINALAATGWTIPKPVSTMYLWAPLPEPWQTRSLEFCEKLVAETGVAASPGIGFGDCGEGFVRFALVHDRDRLEEAARRITQFLAR

SEQ ID NO: 80550 - protein, 86 aa, Silene latifolia
PAGLFFRHAGHRDKVVDFHWNSIDPWTLVSVSDDCSSSAGGGTLQIWRIIDLLYRPEEEVLAELDKFRSHVAACSPTPTKDVNHSA

SEQ ID NO: 80551 - protein, 639 aa, Arabidopsis thaliana
MEAVISFDFQNCFIFILIFLLTFLCFFFFFKKPKDSRVNFDLPPSPPSLPIIGHVHLLLSTLTHKSLQKLSSRYGPLLYLRIFNVPIILVSSASVAYEIFRTQDVNISSRGVAAIDESLVFGSSSFVYAPYGDYLKFMKKLIATKLLGPQALERSRDIRADELDRFYKTLLDKARKKESVEIGEEAAKLMNNIICKMIMGRSCSEENGEAEKFRHLVIESMALTKQIFFGMIFHKPLKKLGISLFQKDILSLSRKFDELLEKILFEHEEKKAEHNQANDMMDFLLEAYGDENAEYKITRNHIKSLFVDLVIAGTDTSVQATQWTMGELINNPKILQRLREEIESVVGNTRLIQENDLPNLPYLQAVVKEGLRLHPPGSISVRMFQERCELKGFYIPEKTLLVVNTYAIMRDPNFWEDPEEFKPERFIASSRSEQEDEVREEVLKYIPFSAGRRGCPGSNLAYISLGIVIGVMVQCFDWRIEGEKVNMNEAAETTALSMAQPLKCTPVSRTKNPLPSNFSFAFCCFCLMIARDSCLLVTFGLNCFFNKLCCSCVPCVLHTTRLCLSQHIGILHSTKPENLHFNFPIILVSSASVAGEIFRAHDMNVSSRGAAAIDESLVFGSSGVVYAPYGDNLKFVKKK

SEQ ID NO: 80552 - protein, 760 aa, Oryza sativa Japonica Group
MGGARAQVNKPHKTRFASKASRHAHKIDKVRTGKPEGSHRAAVKGARAARVQRSKAIRDQKRAALLKEKRSSVGSSSAPRVVVLFGLSSSANVRSLAKDLLTIASGDEEKPTSSTVASPTYKLRTTVLEAPYGDLTSCMELAKVADLLAFVLSANSLYDCDSSSPIDDFGSQCLSVFRAMGLPSTAVFIRDLPSENKSRQELKKTAISFVSPELPEDCKFYAADTKDDLHKFMWLFKEQHLSCPHWRNQRPYVMSEEVHLSGVGDFQLGQIDILKDPFPINERKNSNAMVSEDSGIQIVDTFVPDPSSQEPLLVENTPDPLEGEQTWPTEAEMEEAYLNNKQRKLKRKLPRGTSEYQAAWIVDDTDDEDGDSENDNQDGAGMVIDEQDHSDNGGDGSDMDVVSHFTEKFDEETIGGTEMADDENLTKEQIEAEIKKIKEANAEDEEFPDEVETPLDVPAKRRFAKYRGLKSFRTSSWDPKESLPQDYARIFAFDNFTRTQKHVLAKMAERDEGTLKDCAQRGSFVRLHLKNVPTEIASKLVHPSRRLPVVVSGLLQHESKISVLHFSIKKHDSYEAPIKSKDSLIFNVGFRQFTARPLFSTDNINCNKHKMERFLHHGRFSVASVYAPICFPPLPLIVLKSRDGEQPAIAAVGSLKSVDPDRIILKKIVLTGCLPVVCVGELMKRENLGLRTSACALYPQRVSKLKAVVRYMFYNPEDVKWFKASAMKCIFNSSVQQHDTVCMSLYKRAYPKWPEQLYQI

SEQ ID NO: 80553 - protein, 274 aa, Triticum aestivum
  misc_feature (139)..(139): Xaa can be any naturally occurring amino acid
  misc_feature (216)..(216): Xaa can be any naturally occurring amino acid
  misc_feature (238)..(238): Xaa can be any naturally occurring amino acid
MAAAEPSGSSQPGAPGRWSLHGKTALVTGGTRGIGRAVVEELAALGAAVHTCSRKEAELGERLKEWEARGFRVTTSVCDLSVREQRERLIGDVAERFGGKLNILVNNVGTNIRKPTTEFSAEDYSFLMATNLESAYHLXCQLAHPLLKASGLGSIVFISSVCGLVAVFSGTLYAMTKGAINQLTKNLACEWAKDGIRTNSVAPWYITTSLTEGLLXANKEFEASVVSRTPLGRVGEPXEVSSLVAFLCMPGSTYITGQTISVDGGMSVNGFYPA

SEQ ID NO: 80554 - protein, 438 aa, Aspergillus fumigatus
MPISKIHARSVYDSRGNPTVEVDVATETGLHRAIVPSGASTGQHEAHELRDGDKTQWGGKGVLKAVKNVNETIGPALIKENIDVKDQSKVDEFLNKLDGTANKSNLGANAILGVSLAVAKAGAAEKGVPLYAHISDLAGTKKPYVLPVPFQNVLNGGSHAGGRLAFQEFMIVPDSAPSFSEALRQGAEVYQKLKALAKKKYGQSAGNVGDEGGVAPDIQTAEEALDLITEAIEQAGYTGKIKIAMDVASSEFYKADVKKYDLDFKNPESDPSKWLTYEQLADLYKSLAAKYPIVSIEDPFAEDDWEAWSYFYKTSDFQIVGDDLTVTNPGRIKKAIELKSCNALLLKVNQIGTLTESIQAAKDSYADNWGVMVSHRSGETEDVTIADIAVGLRSGQIKTGAPCRSERLAKLNQILRIEEELGENTVYAGSKFRTAVNL

SEQ ID NO: 80555 - protein, 338 aa, Salmonella typhi
MRVLVTGGSGYIGSHTCVQLLQNGHDVVILDNLCNSKRSVLPVIERLGGKHPTFVEGDIRNEALITEILHDHAIDTVIHFAGLKAVGESVAKPLEYYDNNVNGTLRLVSAMRAANVKNLIFSSSATVYGDQPKIPYVESFPTGTPQSPYGKSKLMVEQILTDLQKAQPEWSIALLRYFNPVGAHPSGDMGEDPQGIPNNLMPYIAQVAVGRRESLAVFGNDYPTEDGTGVRDYIHVMDLADGHVVAMEKLADKSGVHIYNLGAGVGSSVLDVVNAFSKACGKPINYHFAPRRDGDLPAYWADASKADRELNWRVTRTLDEMAQDTWHWQSRHPQAYSD

SEQ ID NO: 80556 - protein, 328 aa, Pyrococcus horikoshii OT3
MVNMHPKIFALLAKFPRVELIPWETPIQYLPNISREIGADVYIKRDDLTGLGIGGNKIRKLEYLLGDALSKGADVVITVGAVHSNHAFVTGLAAKKLGLDAILVLRGKEELKGNYLLDKIMGIETRVYDAKDSFELMKYAEEIAEELKREGRKPYVIPPGGASPIGTLGYVRAVGEIATQSEVKFDSIVVAAGSGGTLAGLSLGLSILNEDIRPVGIAVGRFGEVMTSKLDNLIKEAAELLGVKVEVRPELYDYSFGEYGKITGEVAQIIRKVGTREGIILDPVYTGKAFYGLVDLARKGELGEKILFIHTGGISGTFHYGDKLLSLL

SEQ ID NO: 80557 - protein, 217 aa, Oryza sativa
KKKQQQQSSQPVRRARSNRGSKRRRREDSTVRLYRLMGEEDISNDSKSSCGCEDGTVEAPAAAAPKENGRAADPRLQAISDAIRVVPHFPKPGIMFNDITALLLRPAAFKDAVDMFVERYRGMRIAAVAGIEARGFIFGPAIALAIGAKFIPLRKPKKLPGEVISETYILEYGTDCLEMHVGATEPGERVVVVDDLVATGGTLCAAIKLLVYHVLLI

SEQ ID NO: 80558 - protein, 429 aa, Yarrowia lipolytica CLIB122
MSQPSSPSQPTRRRSSMGTIALGDNSGPALATMPENVQQARASKARQRAISNTSLDDRKAPAGTSSSAVVDQDDKPLGPLAYLWTSYREYSYQNTWLNPLLTMLVVVGAYYAQGNPGPQNPLHRFIFPSYKLAPHTELNPTDDYMYGKGKRDFTFVGFYMIFFTFFREFVMQMFLKPFATFCGVTKKGKVNRFMEQTYSIIYYSLAGSFGLYIMYQTPIWFFNTTAFYENFPHKTHIAMFKVYYLLQAAFWGQQSVILCMQLEKPRKDFKELVFHHIVTIALIWCSYRFHFTWMGLCVYVTMDVSDVFLAVSKTLNYVDHAITGPFFLVFMGVWVYTRHYLNLKILYSILTEFATVGPFELNWVTQQYKCTLSQRITFCLLAALQLVNAYWCFLIFRIAYRFIFHDIQKDERSDDEDEDEDEDESKKDK

SEQ ID NO: 80559 - protein, 229 aa, Leptospira interrogans serovar Copenhageni str. Fiocruz L1-130
MNYQKYLFLDVGDTILHLKKSAGETYLEILLQAGLQKKENAGEIYRRAFTESWQKMQKNSPPEHRDKYQFHSGGTPGWWKELLEDFLKRVPDQVSIEKAFPIIYHKFADPELWTLDPGFWKLKDYCKEENWGLGAISNWDHRLRALLEAKGILEYLNPVIVSAEFGYEKPSPKIFEEAMRLVGLSGDCLVYCGDKYELDIKIPKSLGWRSYLKGEKGDLKTLSELIQFL

SEQ ID NO: 80560 - protein, 654 aa, Magnaporthe grisea 70-15
MPSAANQKGAVSAEDDGLTLADLPKSWRFTSALPADPEYPTPADSHKTPREQIGPRMVRGALFSWVRPERQRDPELLGVSPAALRTLGIRPSEVHTDEFLQTAVGNKLHGWSEEKLEGDGYPWAQCYGGFQFGQWANQLGDGRAISLFEATNPKTGERYEVQLKGAGLTPYSRFADGKAVLRSSIREFVASESLHALGVPTTRALALSLLPHQKVRRETVEPGAIVVRFAQSWIRLGTFDLLRARGDRDLIRKLATYVAEDVLGGWENLPGRLVDPDKPSLEECSPALASMVESAAEDSSKSPIRRGIPEAEVEGPSEMAENRFVRLYREICRRNAITVAHWQAYGFMNGVLNTDNTSIIGLSMDYGPFAFVDVFDPSYTPNHDDHALRYSYRNQPTIIWWNLVRLGEALGELLGAGADIDDPNFVDKGVKDEAAAEPIISRAEALITQAGTEYRAVFLAEYKRLMCARLGLRTHKDSDFDKLFSELLDTMEAAELDFNFFFRRLSSLPLTDISTEADAEKNASLFFYEEGVTGILGEEKARKRVGAWLCAWRDRVREDWGEPRDAERMEAMRRVNPNFVPRGWILDEVIRRVEKEGERDVLRRLMHMSLNPFDESWNGKTFDGKIYEGDEAEEKRWIANVPKYKRAMQCSCSS

SEQ ID NO: 80561 - protein, 248 aa, Synechococcus sp. WH 8102
MFDHIRADFAIIRERDPAARGWLEIICCYPGFQALSLHRLSHSLWRSPLPLKLAARCLSQISRTLTGIEIHPGARIGRSVFIDHGMGVVIGETAEVGHRCLLYQGVTLGGTGKDHGKRHPTLAENVVVGAGAKVLGAINIGANTRIGAGSVVVRDVDADCTVVGIPGRVIHQSGVRINPLAHSALPDAEANVIRNLMERIDELESTVSNLQRCLKEVAEGRQLRDVCRGESQSLKDREILEFLGENTG

SEQ ID NO: 80562 - protein, 328 aa, Pyrococcus horikoshii
  misc_feature (1)..(1): Xaa can be any naturally occurring amino acid
  misc_feature (8)..(8): Xaa can be any naturally occurring amino acid
  misc_feature (48)..(48): Xaa can be any naturally occurring amino acid
  misc_feature (86)..(86): Xaa can be any naturally occurring amino acid
  misc_feature (92)..(92): Xaa can be any naturally occurring amino acid
  misc_feature (96)..(96): Xaa can be any naturally occurring amino acid
  misc_feature (110)..(110): Xaa can be any naturally occurring amino acid
  misc_feature (147)..(147): Xaa can be any naturally occurring amino acid
  misc_feature (158)..(158): Xaa can be any naturally occurring amino acid
  misc_feature (290)..(290): Xaa can be any naturally occurring amino acid
  misc_feature (300)..(300): Xaa can be any naturally occurring amino acid
  misc_feature (316)..(316): Xaa can be any naturally occurring amino acid
XRILILGXGGTIASVKGERGYESALSVSKILKLAGISSEAKIEARDLXNVDSTLIQPSDWERLAKEIEKEVWEYDGIVITHGTDTXAYSASXLSFXLRNPPIPIVLTGSXLPITEKNSDAPFNLRTALEFVKLGIRGIYIAFNGKVXLGVRASKIRSXGFDAFESINYPNVAEIKDDKLRILHIPDFYGDEFFSDIKYEPKVLVIKLIPGLSGDIVREALRLGYKGIILEGYGVGGIPYRGTDLFEVVSSISKRIPVVLTTQAIYDGVDLQRYKVGRIALEAGVIPAGDXTKEATITKLXWILGHTKNIEEVKQLXGKNITGELTRVS

SEQ ID NO: 80563 - protein, 431 aa, Erythrobacter sp. NAP1
MAKFTFNMPDVGEGVAEAEIVEWLVKVGDTVAEDQHLVDVMTDKATIDIESPVDGKVLEVAGEVGDVVAVGSMLLVVEVEGEVSDEVEEEAAPAPTPEPAAEPKEASAPMPDPTITPEPELEPAPAPTPSPTPASEPAATAAKVLASPAVRKRANDLGVDLSRVKPAEDGRVRHGDLDQFIAYNSGGGYSPAGRTREDEPIKVIGLRKRIAQNMSAAKRNIPHFTYVEECDVTALEAMRADLNSARGDKPKLTMLPLLITAFCKLIPHYPMINARYDDEANVVTRHGSVHMGMATQTDNGLMVPVIRDAQSRNLWQLATEIGSLANAARDGSAKSEELSGSTITVTSLGPLGGVATTPVINRPEVAIIGPNRIIERPMFVSDGQGGERIEKRKLMNISISCDHRVVDGYDAASFIQDVKKLIETPVLLLSD

SEQ ID NO: 80564 - protein, 289 aa, Zea mays
MAKQDIEASGPEAGEFSAKDYTDPPPAPLIDADELTKWSLYRAVIAEFIATLLFLYITVATVIGYKHQTDAAASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 80565 - protein, 431 aa, Deinococcus radiodurans R1
MGERKCGGWPPKVFLHSLSPGGAGGSTKAVVWHGIGDIRLDDVPEPKIEAPTDAIVRLTASAICGTDLHFIRGTMSDMVPGTILGHEGVGIVEAVGPEVRNFVPGDRVVIPSSASCGYCPPCREGNTSQCDNANPNGPSAGTAFYGGPKSSGPLNGMQAEKVRVVYANSSLVKLPDNVSDDQAIMISDIFPTAYFGAEIAGVKTGSVVVVLGCGPVGQFSIISAKLLGATRVIAVDRLDDRLDMARKNGAEVINFEKEDPVEAVKKLTGGLLADCVIDAVGVDAQHAHAGPAKPDAEKEQKFEQEVQEVAPDAKPEKDGQWTPGDAPSQASEWAIEMTKKAGQIGIIGVYSPQMTTYPIGKAMNKNLTIRMGNCNHRAIIPGLVDLVAAGVVDPARVLTEHEHLGSAIEAFEAFDKRQPGWIKVELEPQAG

SEQ ID NO: 80566 - protein, 137 aa, Hyaloperonospora parasitica
VHAVSGLLVGSLTSGVQLAISQSNTGGAWDNAKKFVEKGCVSIEDKEGKPIVQGKGSAIHKAAVIGDTVGDPLKDTSGPALNILMKLMAIISLVFGDFFKSINDGRGLLNVPTGAVAEAVADVAAVPVAVVAAGPPM

SEQ ID NO: 80567 - protein, 505 aa, Pyrobaculum aerophilum str. IM2
MEKVLVVNFGGQYAHLIARRIREVGVYAEIASPEEAVIKASKEEVKAVILSGGPSSVYEPGAPDIDEGIFALSKPVLGICYGHQMIAKKLGGKVERGKGEYGKTIVKILVNDPLFDGWKPEEAVWMSHSDFVEEPPPGFHVLAISENGYIAAMRKGLIYGVQFHPEVHHTSKGRVMFENFLRKIARISDVWRPEDQITRIVEEIRSRVKGGDVIVGVSGGVDSTVTAVLLYKAVGQRVKAVFIDHGLFREGEPEEAASLLKSIGIDVVYIDAKERFLKRLEGVADCEEKRRIIGETFAEVFSDAVKQMPNVKYLAQGTLYPDVVESGAVKGADKIKSHHNVGGLPPWFQLELIEPLREFYKDEVRRIAKALGLPEDVVYRHPFPGPGLAVRIIGPFTREKLAIVRKATKIVEEELRKAGLFRKVWQAFATVGEDKWVGVKGDRRAMGYIVTVRIVESEDAMTADWSRIPFEILEKISSRITSEIPEVTMVTYAVTSKPPSTIEPC

SEQ ID NO: 80568 - protein, 265 aa, Yarrowia lipolytica CLIB122
MSRPEEIAPPEIFYNDDEAAKYTSSSRVQQIQAKMTLRTLELLNVPQGSYILDVGCGSGLSGEVLTEEGHHWVGMDIAPSMLATALDKEVEGDLFLADMGDGVPFRAGTFDAAISISAIQWLCNADTAGANPKVRLMKFFSTLYASLRRGGKAVCQFYPANDNQRDQIVQAAKATGFGGGIVVDDPESKKNTKYYLVLSAGMSDNDINLDGVQMDAVERSKTLRKGKKEETAKQWIQRKKEVGRKRGKRVANDSKFTARKRRPKF

SEQ ID NO: 80569 - protein, 463 aa, Pyrobaculum aerophilum str. IM2
MYIGTEFAIATESFLASRAGYEVYKKGGNAADAVVAASAVLTYTLPHLGGVGGDFLAVVHKGDRAESVLGLGWAPRKIPDRPPRRGIQSAVVPGYIAGLVEFHKRYGALPWGEVIGTALDFMRKATVHPSLAAAIERHRDLLASDPGGRLYLALPLEPGAPYKIEPLLKLWGVLRDNPLLFYDEIARDLEQYGYFELDDFLKYRPEVKPPVFINYDGWVIYEAPPPSLGFVVLLTVKLSQPVKSPFSYARIKNTVAALRKAHWARDAYLHDGEVPVYDILSGGVQLGEADKPEPTPGTTYLAAGDKELTVSAIQSLYYPFGSGFTDLKWGITFNNRASDFTTGLNRPAPRKRPSHTLSAVVMVKEGEAWALGASAGHYRPAIYAQLIQNVIWYGMSPREAILAPRFIWTGGWEVQAEEGWEAGLGVTIVKYPSRMGVAAALRKRNNYIAAVADIRGDGLALGI

SEQ ID NO: 80570 - protein, 244 aa, Zea mays
  misc_feature (228)..(228): Xaa can be any naturally occurring amino acid
MAPLGDAVAPAAAAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAAMRAAKSAGILCSYDPNVRLPLWPSAQAARDGIMSIWKEADFIKVSDDEVAFLTQGDATDEKXVLSLWFEGLKLLIVTD

SEQ ID NO: 80571 - protein, 193 aa, Haemophilus influenzae R2866
MSVIPMVVEQTSRGERSYDIYSRLLKERVIFLSGEVEDRMANLIVAQLLFLESEDPTKDINIYINSPGGSVTAGMAIYDTMQFIKPDIRTLCIGQACSMGAFLLAGGTAGKRAALPNARVMIHQPLGGFRGQASDIQIHAQEILKIKHTLNDRLAFHTGQSIERIEKDTDRDNFMSAEEAQAYGLVDEVLVKR

SEQ ID NO: 80572 - protein, 525 aa, Oryza sativa
MALLRAHHLLLMRPRAAFSSRPPPLSSSPCRRALPTTAIASRLLCSHHASSPPEDASASASPSIVADLLDYLNESWTQFHATAEAKRQLLDAGFTLLSENDDWDLQPGGRYFFTRNMSCLIAFAVGEKYKLGNGFNIIAAHTDSPCLKLKPRSASFKSGHQMVNVQTYGGGLWHTWFDRDLTLAGRVILKDADGSFKHELVKVSRPLIRVPTLAIHLDGTVNSDGFKPNLENHLVPLLATKHEETTANSSEKNSSSSTKVVHHPLLLQVLSDEIGCKSGEIIGIELNVCDTQPSCLGGGNNEFIYSGRLDNLASCYCALRSLMDSSKMPEELSNEKAIRMIALFDNEEVGSNSMQGAGAPTMFHAMRRIVDSLMHQSMGEGALERAINSSFLVSADMAHALHPNYPDKHEEHHRPELQKGLVIKHNANQRYATSAVTAFLFKEIARLHNLPVQEFVVRNDMGCGSTIGPILASGVGIRTVDCGIPQLSMHSVREMCGKEDVDTTYKHFKAFFEMFSDIDRKLNVD

SEQ ID NO: 80573 - protein, 336 aa, Arabidopsis thaliana
MGSTFRDRTVELHSLSQTLKKIGAIPSVHQDEDDPASSKRSSPGSEFNKKASRIGLGIKETSQKITRLAKLAKQSTIFNDRTVEIQELTVLIRNDITGLNMALSDLQTLQNMELADGNYSQDQVGHYTAVCDDLKTRLMGATKQLQDVLTTRSENMKAHENRKQLFSTKNAVDSPPQNNAKSVPEPPPWSSSSNPFGNLQQPLLPPLNTGAPPGSQLRRRSAIENAPSQQMEMSLLQQTVPKQENYSQSRAVALHSVESRITELSGIFPQLATMVTQQGELAIRIDDNMDESLVNVEGARSALLQHLTRISSNRWLMMKIFAVIILFLIVFLFFVA

SEQ ID NO: 80574 - protein, 210 aa, Parvularcula bermudensis HTCC2503
MRDPHDIYMNTLVPMVIEQTSRGERSFDIYSRLLKERIIFLSGQVHDQVSTLIVAQLLFLEADNPKKDIAFYINSPGGSVTAGLAMYDTMRYIRPQISTMCVGLAASMGSLLLTAGDKGMRFSLPNSRIMVHQPSAGFQGQASDIERHARDIIQTKKRLNEIYVEHTGQDYETIERTLDRDTFMTPEDALDFGLIDQVLEKRAVASGDEG

SEQ ID NO: 80575 - protein, 216 aa, Saccharomyces cerevisiae
MSSEPFKNVYLLPQTNQLLGLYTIIRNKNTTRPDFIFYSDRIIRLLVEEGLNHLPVQKQIVETDTNENFEGVSFMGKICGVSIVRAGESMEQGLRDCCRSVRIGKILIQRDEETALPKLFYEKLPEDISERYVFLLDPMLATGGSAIMATEVLIKRGVKPERIYFLNLICSKEGIEKYHAAFPEVRIVTGALDRGLDENKYLVPGLGDFGDRYYCV

SEQ ID NO: 80576 - protein, 366 aa, Bacteroides fragilis YCH46
MNIERKILLNPGPATTTDTVKLAQVVPDICPREKEFAGMMKQLRDDLVRVAHGDLSKHTAVLFCGSGTINIDICLNSLLPADKKVLVVNNGAYSTRAVEVCEYYGLPHIDLKFSVYELPDLSVIEKTLSDNPDIALVYTTHHETGTGILNPIREIGKIAHSHDAVFVVDTTSSLGMIPFDIGKDNVDFCMASAQKGLQAMTGLSFIVGDESLIRASRDYPKRSYYCNLYLQYDYFEKTGEMHFTPPVQTVYAARQALDEYFAVGEEAKFARHKRVFEAIHKGLQELGLQYAIKREWQSGLVVSVLYPDDPLWDFDKVHDYCYERGFTIYPGKISTTNTFRLCALGEIDVEDIERFFEVMREAVLKY

SEQ ID NO: 80577 - protein, 474 aa, Parvularcula bermudensis HTCC2503
MLELAVSKSEVSVSERLDTILEKQQAACRRQRVLSADQRRDAIARVKKIVTHHKDALIEAVNRDFGHRSRMETELCELMLVATAADHARSHVKKWMKPRRRGVNLTSLPGSAWVQHEPLGVLGIISPWNYPLLLTLSPLIDALAAGNRVMIKPSELTPQTSALMAQLIETYFDEEEVAVVTGGIDIGAYFSTMPFDHLLFTGSTSIGRRIALAAAENLTPTTLELGGKSPAIVCDDYSMDKAVRSIALGKFINAGQTCIAPDYVLVPKGTGTAFAEALIAEVKRGIPDLASETYTGIVNERHLERLEQIVTEAARLGGKVLTAGQAPVGKMSPTVILNPPNGVAILEEEIFGPVLPIVEYSDLDDALRFINDRTHPLALYVFTKNKSREKQVLSGAISGGVSVNSTLLHLVQHNLPFGGVGHSGSGAYHGEDGFKRFSHARSVFKVGPLNSFEMLGPPFGRLAKLTTNFFLRKS

SEQ ID NO: 80578 - protein, 183 aa, Brassica napus
SFACICFELATGDVLFDPHSGDNYDRDEDHLALMMELLGMMPRKIALGGRYSRDLFNRHGDLRHIRRLRFWPMNKVLTEKYEFSEQDANELSDFLVSILDFVPEKRPTAAQCLLHPWINSVPRSLEPSLSPQDQNPEEKLDTERKKREKEEQEAMVVKMGNVAISSPKSKPGMSKSSSYKQAI

SEQ ID NO: 80579 - protein, 350 aa, Bacteroides fragilis YCH46
MNVLVTGAAGFIGSHVCKRLLQRGDEVVGLDNINSYYDINLKYGRLSSLGVPQSELSWYKFTRSNVYPRFSFVRMNLEDRQAMQMLFANGNFDVVINLAAQAGVRYSIENPYAYVESNIDGFLNVLEGCRHSQVKHLVYASSSSVYGLNGQVPFSEKDGIAHPVSLYAATKKSNELMAHTYSHLYNIPSTGLRFFTVYGPWGRPDMSPFLFADAILHGRPIKVFNNGNMLRDFTYIDDIVEGVLRVADSIPEGNQCWDAEVADPSMSCAPYKIYNIGNSRPVKLMDFIRAIEMSIGREADKIYLPMQPGDVYQTYADTSSLSREIGFQPNTSLEAGVKKTISWYKEFYNL

SEQ ID NO: 80580 - protein, 209 aa, Triticum aestivum
MANFLASIFGTELDKVNCSFYFKIGACRHGDRCSRKHVKPSYSQTILMPNLYQNPAYDPKNRMNPSQLQNHFDAFYEDIWCELCKYGELEELVVCDNNNDHLIGNVYARFKYEESAQKACDELNSRWYAARPIYCELSPVTDFREACCRLNLGEGCVRGGFCNFIHRKNPSEELDRDLTLSTKKWLKQRGRDERSASRSPTPEPTRRRY

SEQ ID NO: 80581 - protein, 493 aa, Leptospira interrogans serovar Copenhageni str. Fiocruz L1-130
MFMVTELSYCQKMTQLKRSLNLFDSISLMFSSMVGPGIFITTGYILHQVPNPNIVLLAWILGGFLAVAGAMSYAKSASLFPYAGGDYVYLKEAYSPIVAFASGWLSLSINFSASISLSALAFSKSFFSLINPSWDIYFFEIPFLGLTISIGTAQILAMSAILVFTIVNFFGISTASRIQNLFTSVKILGLVSFVILGFVIGNYDISRFKSFSLFPSDLKGFELLFAGVIPVTYSYLGWNMITYVAEEVKDPDKNIYKAVLYSCALVTILYILMNFLFLSSGTLSELSGDKIGITASSALFGPKATVFITVFICWAFLASISAYIIGGSRIYFAMARDGFFFQNMAKLHSKHKSPYMSLLFQCGYACLFCFVKEIESLLYLITCSTLLLATITAYTPILFEKRNYKLKFRIPGYPYTTYLYIASNFGIIATLLWNKPTEAFWGVGFTFLSIPMYYYFKIMQNTLSKNSTPLETPEVLATSLLPENEPVPIASGE

SEQ ID NO: 80582 - protein, 440 aa, Bacteroides fragilis YCH46
MKIAIVGTGYVGLVTGTCFSEMGVDVTCVDVIESKIDNLKKGIIPIYEPGLEDMVHRNYNAGRLKFTTSLASCLNDVEVVFSAVGTPPDEDGSADLKYVLEVARTIGKTMNHYVLVVTKSTVPVGTAQQVKATIRGELDKRGLNLEFDVASNPEFLKEGDAVDDFMKPDRVVVGVESERAKSIMERLYKPFMMNNYRLIFTDIPSAEMIKYAANSMLATRISFMNDIANLCELVGANVNMVRKGIGADSRIGSKFLYPGCGYGGSCFPKDVKALIKTADKNGYSMRVLKAVEEVNNSQKSILFNKLIRYFDGNLSGKRIALWGLSFKPETDDMREAPALVLIDKILSCGGLVKAYDPIAVEECKRRIGDSIEYANDMYDAVLDADALLLVTEWKEFRMPSWGVLKKTMNRALIIDGRNIYDRQELQSVGVEYTCIGVEAI

SEQ ID NO: 80583 - protein, 194 aa, Zea mays
  misc_feature (138)..(138): Xaa can be any naturally occurring amino acid
MPTKRSVGTLGDKDLSGKKVLLRADLNVPLDDGQRIADDNRIRASVPTIKFLMGKDARVVLASHLGRPKGVTPKYSLKPLVPRLSELLGVDVVMANDCIGEEVEKLAAALPDGGVLLLENVRFYKEEEKNDPEFAKKXLASVADLYVNDAFGTAHRAHASTEGVTKYLRAAVAGFFMQKELDFLLEQLPPEKAF

SEQ ID NO: 80584 - protein, 435 aa, Campylobacter lari RM2100
MHYYCISFTHKNTDIATREKLSFSNEDKKRELLKLIHTNNKILESLVLSTCNRVEIFLFVGDVESINEHILKTLSLLCGVDRENLSTKADFYEDSGAIHHLFSVASSLDSLVIGETQIAGQLKDAYKFALQEQRCGVHLTRAVHYAFKCAANVRNQTEISKNPISVASVAVAKAKELVNLENKTAVVVGAGEMSELACKHLLNAKAKVLILNRDIQNAQKLCEDLGENASYESIANLKEALNQYEIFFSATNAPHAIITNDLLEEKDYSRYFFDIAVPRDIDVKANEKNIVYAVDDLEEVVRKNLTLREHQAQIAYSIVGTMTNEFFQHLSKLATLPLVKQLRLQADEIAKEQLQKAIDKGYLKHSNHEEARKLIRQVMNAFLHHPSVNLKKLSGTMQNDSVINAMRYVFDLKNENMEGLNLYKCEFNLENNHEI

SEQ ID NO: 80585 - protein, 410 aa, Saccharomyces cerevisiae
MGHHHHHHGSLVPRGSDVQELNSIIQRISKFDNILKDKTIINQQDLRQISWNGIPKIHRPVVWKLLIGYLPVNTKRQEGFLQRKRKEYRDSLKHTFSDQHSRDIPTWHQIEIDIPRTNPHIPLYQFKSVQNSLQRILYLWAIRHPASGYVQGINDLVTPFFETFLTEYLPPSQIDDVKIKDPSTYMVDEQITDLEADTFWCLTKLLEQITDNYIHGQPGILRQVKNLSQLVKRIDADLYNHFQNEHVEFIQFAFRWMNCLLMREFQMGTVIRMWDTYLSETSQEVTSSYSMSSNDIKPPVTPTEPRVASFVTPTKDFQSPTTALSNMTPNNAVEDSGKMRQSSLNEFHVFVCAAFLIKWSDQLMEMDFQETITFLQNPPTKDWTETDIEMLLSEAFIWQSLYKDATSHWL

SEQ ID NO: 80586 - protein, 335 aa, Erythrobacter sp. NAP1
MATKVAINGFGRIGRLVARAILERDDHDLELVSINDLADTKSNALLFQYDSTHGRFPGTVEVADGAMVVNGKSIAVTSERDPGNLPHGDQGVDIVLECTGFFQSHEAAEPHLKAGAKRVLISAPAKNVSATIVYGVNHETLTAEDVIVSNASCTTNCLSPVAKVLNDTVGIERGFMTTIHSYTNDQRMLDQMHSDMRRARGGAQNMIPTTTGAARAVGLVLPELAGKLDGSSVRVPTPNVSLVDLVFTPGRDTSAEELNEALKAAAEGPMKGVLEYTDQPLVSSDFNHQPASSTVDSLETSVMEGKLARVVSWYDNEWGFSNRMIDTAGVMAKFL

SEQ ID NO: 80587 - protein, 915 aa, Pyrobaculum aerophilum str. IM2
MEKYVYSFKEADYRNKKLFGGKGASLIQMTQLGLRVPPGFIITTEACKKFYEPRRREISELEGILLKNPPPEVRDEVIKKLHAIIDSLDLPGEIWSQVVSYMRELEKETGKRFGDPENPLLVSVRSGAAVSMPGMMDTVLNLGLNDETVKGLAKQTGNEWFAYDAYRRFLQMFGKIVLSIDEKLFSTAWEEIKRKYGVKDDPDVQLEGLKEAVERFKEIIVRARGGFPQDPWEQLKLAIKAVFRSWMSPRAIFYRIIEKITPDIADCTAVNVVTMVFGNAGWDSGTGVVFSRDVATGENKLYGEFLPVAQGEDVVAGIRTPMDIEEFRKRFPHLYEELYQGVKLLEKVNKDVQDVEFTVERGKLYFLQTRNAKMTALARVKTAVDMAKEGIITKEEALLMVSPDHVLQLLYPRIDPKAKATLVAQGLPASPGAVSGQVVFHPDDAVRWAAQGKRVILARVETKPDDVHGFYAAVGVLTSRGGMTSHAAVVARAIGKPAVVGAESIEIHEEEKYLKVGTHVIREGDWITIDGHTGNVYIGVVPTIEAELIPELEELLRWADEIRRLGVRANADLPEDAAIARKFGAQGIGLLRIERMFRKPERLELLRRIILAESPEERRPHLEALYKMLKNDFKEVFKIMDGLPVVVRLIDPPLHEFLPKPEEILEQIYQRKMRGDDASELEKLYRRVKALQEANPMLGHRGVRVGVTHPDFYYYLNKAILEAAAELKKEGFNPVVEIMIPQVSDVREIIYVKEKAIIPALKDVEASTGVKLDVKIGTMIETVRACLTIDEIAKHVDFISFGTNDLTQAVFSFSRDDAENKFIPQYLDLKILDADPFETIDIKGVGKLVEYAAKTAKEVNPSIEVGVCGEHGGDPKSIYFFHNKVDYVSASPFRVPLARLSAAQAAIINRQNPHY

SEQ ID NO: 80588 - protein, 219 aa, unidentified eubacterium SCB49
MSIQKNIEKYRDLMPEGVTLVAVSKTKPVSDLMEAYEAGQRIFGENKIQEMASKHEEMPKDIAWHMIGHVQRNKVKYMAPFVNLIHAVDSLKLLKEINKEAAKNNRTINCLLQIKIAEEDSKFGISKADATALLASEIVQDLKNVKIIGLMGMATFTEDKVQIRSEFKSLKEYFNTIKKEHRNLTQLSMGMSGDFTLAIEEGSTMVRIGSSIFGERNYN

SEQ ID NO: 80589 - protein, 541 aa, Campylobacter lari RM2100
MDAFITLFLTAVAVAVVLNVILKKFGIPTIIGYIATGLFVREFYGFSTNEIIIHVAEFGIVFLMFTIGLEFSFKHLLAMKKEVFLNGSLQMLTCGLVCTLLVTYILGIASHIAMIAGFALALSSTAIVLKILNDSGDINEEYGRKALGILLFQDIAVIPLLLMIDIFSSQNADISKLLFTTLVSAVILLVLLYFIGKYLFTYVLKFIIKTNANEIFIATILFTVIGASFLAHSFGFSYSLGAFIAGALIAETKYKHKIEADLVPFRDLLLGFFFISVGLQIDFHIVFENWFLIFVFVSLVLLIKFVVIYGLLILYTRKRVALKTALSISQIGEFALAVFSLMQVNSLIDEKTAQIFIIVSIITMVATPFILNNLRKIANAAEGEQSDMAKFYLCDQKMKDHFIIFGYTRLGQEVVQKIKKTGIPYLVLESDLNLVELGRSRNENVFFANVAQVETLKVANIEECSVAIITISNEAKLDMLYQVLSNFNKPIQTVLKTSGMGAKIIFPHTDKHLHIVDAEASIARNLVQEALQCRINTSAAE

SEQ ID NO: 80590 - protein, 452 aa, Aspergillus nidulans FGSC A4
MGSVDHVEAFFDKADKYLMSTGVPYSPFVVTKAKGTRLYNQDGRSILDFTSGQMSSLLGHSHPDIVEVVKQYIGELDHLLSNMITHPVVDLAERLARFLPAPLEKSFFLNTGSESTEAAIKIAKVYTGNFEVIAFAASYHGLTQGSGSVTYSAGRRRGGPVMPGALAFPAPYAYRSPFKKADGSYDWEAELDFGWSMIDRQSVGSIAAFIMEPILSTGGILDPPKGYFKRMVEECRKRGILVIMDEAQTGVGRTGQMFAFEYDGIVPDILALSKTLGCGLPLASVSTTAEIAKGCKEAGFLWLSTHINDPLTAAVGNKVLEVVERDNIARRAAERGAQLREGLVKLQQKYWCIGDVRGRGLLQGIEIISDPETRAPGPELGQAVSDQAMTKGLSCNVVNLPGMGGVFRLAPPVTVTAEEIEEGLAILDEAFGDVLKTWSASESDSKLGGLFK

SEQ ID NO: 80591 - protein, 369 aa, Festuca arundinacea
MVMMVDPPNGMGNHGKHYYTMWQTMFEIDTKYVPIKPIGRGAYGIVCSSINQETNEKVAIKKMNNVFDNRVDALRTLRELKLLRHLRHENVICLKDIMMPVHRRSFKDVYLVSELMDTDLHQIVKSLQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSDSDLEFIDNRKARNYIKSLPYTPGIPLSNMYPQVHPLAIDLLQKMLVFDPSKRISVIEALAHPYMSELYDPAANPPAQVPIDLDIDENIGVETIREMLWQEMLQYHPEAATMVNM

SEQ ID NO: 80592 - protein, 411 aa, Synechococcus elongatus PCC 7942
MSESLESLARLAHWRHELRTPINAILGYSQLLLEDWAGTAIATDLERIESAGQELLRLVNEILDPHSSDRGLSLDTYQARLRYALRTPVNTVCGYVELLLEEDSPELAESRVDLERISAAGERLLEQLEAMAAWDQPASQASAVALSEMEVEVAESVLRYRQAAVSASAVTGGRLLVAEDNEINRDVLERRLRRLGHDVVCVASGQEALNQLAQQPFDLLFLDVMMPGLTGFEVLQQLKADPTLAELPVLMISALDDLESVIRCLRLGATDYLTKPFEPTLLQTRLETCLQHKRLRDRELDYLRNVAIVTDAAVAVEAGDYDRDRLQTVAERSDALGQLARMFRQMTRSVEQRETQLKQTIRRLELQIDTATVKSQVKEITESDYFRDLESRARQIRRDRSYRSSPPDRHA

SEQ ID NO: 80593 - protein, 260 aa, Candida glabrata CBS 138
MSYTPLPNINDFPTLGNPLEDAKRAAAYRAVDENLNFDEHRIIGVGSGSTVVYVAERIGQYLKDEKYHDKVSKFICIPTGYQSRNLIQDNGLILGSIEQHPHVDIAFDGADEVDHNLQLIKGGGACLFQEKLVSTSAKIFIVVADSRKKSDTNLGINWKRGVPIEIVPSAWSRVQHDLTSILHANSAPVRQGGSAKAGPVVTDNMNFLIDADFGEIQDPKALHEQIKMLVGVVETGLFIDNAHRAYFGKPDGSVEVIDKK

SEQ ID NO: 80594 - protein, 312 aa, Symbiobacterium thermophilum IAM 14863
MDRPVVVVGSLNLDLVVNPERAPAAGETVFAPRLDQFPGGKGANQAVAAARLSAPVAMVGRVGQDAFGDRLLESLRADGVATEGISRSATAGTGTAVITVEATGQNRIVVVSGANAEVTPELVEAHGPLIASASALLLQLEVPVEACVRAAELAAAAGVPVILDPAPAPAEPLPEPLRRNTWLITPNETEAAALTGVPVAGRCGAEEAARVLWAQGFRQVLIKLGSEGAYLFRGGAGQWFEPFRVPVVDTTAAGDAFAGGLAAALHRGMALEEAVRWGMAAGALAVTRPGAQPAMGNLDELMTLLRTGRLDA

SEQ ID NO: 80595 - protein, 71 aa, Glycine max
  misc_feature (20)..(20): Xaa can be any naturally occurring amino acid
  misc_feature (41)..(41): Xaa can be any naturally occurring amino acid
PGAGMVVPFTGLKSMVGFPXRKTTIDFTSIVTTGEKFQCMXQVWPPFGKKNFKTFSYLPNLDDPQWAKEVE

SEQ ID NO: 80596 - protein, 314 aa, Aspergillus nidulans FGSC A4
MASSSDLTLAFIGCGNMGSAILSGILDASKVVSSPFSRILACTKTQSSAEKLDARFRDHGSPLTASFFADKNTAAAEEADVIILGCKPYLVDAMLAEEELADALAGKLVISIIAGKTIDVLSEGISQNQTENSPSKKAVIVRAIPNVAASVRESMTVIELPTPSPSNDQKDLITWIFSQIGQTSFLSSDLFDCGTMLMASIATVSVAVDGILDGCVAEGMKRADASEMTAQCLLGLAKLLREGYHPAVLRESISSPRGCTIQGLLAVERGGVRTGTVQEPRARHKMLDLGIGKTRGFTVRGGRIKKRGAVIDPS

SEQ ID NO: 80597 - protein, 375 aa, Zea mays
MSGGVEPDTPPGSSSSSSRSGGSTPVGGKPPRHHLTSIRHCASSARIAAASAEFGLESGTLSLISPTADIRPGFLPVFRSGSFADIGPKSFMEDEHVCVDNLVEHLGLRGPGIPAPGAFYGVFDGHGGSDAACFVRKNILKFIPEDCHFPNSIEKAIRSAFVKADNAIADSHSLDRNSGTTALTVLIFGRTLLVANAGDCRAVLGKRGRAVELSRDHKPSCIVERLRIENLGGTVFDGYLNGQLAVARAIGDWHMKGSKGSVCPLTPEPEFREVRLTEEDEFLIIGCDGLWDVMSSQFAVSMVRKELMEHNDPQRCSRELVHEALRRDCCDNLTVVVVCFSADPPPQIEIPRFRVRRSISMEGLHRLRGALDSNI

SEQ ID NO: 80598 - protein, 265 aa, Pseudoalteromonas tunicata D2
MNMLSLLEPCIALAEQAGRAILAIYDQDDIGQQEKLDHTPVTKADLAANDVLMAGLIALDSSIPIMSEETSIPSLEERKHWQRYWLLDPMDGTGEFILKSGDFAVNIALIENNQPVLGIIHWPTKGVTYFAAEGNGAFKRENGQDIAIKVAKPQKLTLAISRRQKLDVVSQYITTQFDTIPLGSCSLKACLIAEGQADFFMRIGPTGEWDTGASQVIVEQAGGTLVDAQFQPLTYNQRESTENPDFIVMGHPDWDWLSLIQPHQR

SEQ ID NO: 80599 - protein, 461 aa, Burkholderia thailandensis E264
MTSRDERLHRGLEERHINLMALGATIGVGLFLGSATAIRAAGPAILLTYMLGGIAIFLIMRALGEMAIDNPVAGAFSRYARDYIGPLAGYLTGWTYWFMWIVTCMAEITAVGVYMHMWFPDVPNWIWTFAALIVMGAVNFIAVKLYGEFEFWFALIKIVTIVLMIAGGALMIVAGVGNGGVPTGVSNLWAHGGFLPNGLAGVVDALPIVMFAYLGVEMLGLTAGEARNPEKSLAKAVNSVFWRVVIFYVGALFVIMSIYPWSQIGTQGSPFVMTFSRLGIPAAAGIINFVVLTAALSSCNSGIFSTARMLFNLAEQGQAPERLASVNRRGVPVHGVLISVALLFVGVALNYYAPQKVFVWLTSVSTFGAIWTWCVILIAQLRFRRRVSAERLARLPLRVPLYPMSSFVALAFLAFVVVLMAFSPDTRVALVIGPLWIAALTVYYHLSQAGRRAPLGAPTDG

SEQ ID NO: 80600 - protein, 391 aa, Mycobacterium bovis AF2122/97
MSTSLPPLVEPASALSREEVARYSRHLIIPDLGVDGQKRLKNARVLVIGAGGLGAPTLLYLAAAGVGTIGIVDFDVVDESNLQRQVIHGVADVGRSKAQSARDSIVAINPLIRVRLHELRLAPSNAVDLFKQYDLILDGTDNFATRYLVNDAAVLAGKPYVWGSIYRFEGQASVFWEDAPDGLGVNYRDLYPEPPPGMVPSCAEGGVLGIICASVASVMGTEAIKLITGIGETLLGRLLVYDALEMSYRTITIRKDPSTPKITELVDYEQFCGVVADDAAQAAKGSTITPRELRDWLDSGRKLALIDVRDPVEWDIVHIDGAQLIPKSLINSGEGLAKLPQDRTAVLYCKTGVRSAEALAAVKKAGFSDAVHLQGGIVAWAKQMQPDMVMY

SEQ ID NO: 80601 - protein, 359 aa, marine gamma proteobacterium HTCC2080
MKAAVCRAFGHPLTIEELDIAEPKAGEVKVRLTACAICHSDVILIDGGWGGDLPAVYGHEASGVVESIGSGVVDLKPGDPVVVTLIRSCGNCHYCNQSIETQCDGAFPLDQQSPISDSSGQVVSQGLNSGAFAEQVVVEQSQVCVIPEDIPLDVASILACGVLTGFGAVVNTAQVKAGSTVAVIGCGGVGINSIQGAVHAGASQVIALDLLDDKLELAQQFGATHAVNSAEKDCIDQVIALTAGRGVDYVFVTVGAKAAIEQSVSFLAKSGTAVIVGMPASGVMAQYDPGELAARGQSVLGSKMGSGSVKRDIPKLAALYQSGELKLDQMISGRYALEEINEAIASVKRGEALRNVVIF

SEQ ID NO: 80602 - protein, 328 aa, Gibberella zeae PH-1
MDNYQRIEKVGEGLSQLITHLIHLLTQLSGTYGVVYKARDLGHSGRIVALKKIRLETEDEGVPSTAIREISVLRELNHANVVSLLNIVHADGHKLYLVMEFLDLDLKKYMDSLPVTDGGRGKPLPTGTATVIRNLGMSDKVVEKFMLDLCQGIKYCHSRRILHRDLKPQNLLIDKEGNLKLADFGLARAFGVPLRSYTHEVVTLWYRAPEVLLGGRQYSTGVDMWSVGTIFAEMCSRKPLFPGDSEIDEIFKIFRTLGTPDEDAWPGVTAYPDFKPSFPKWQRDFSTPLCPNLNEQGLELLDYLLICDPVTRISAKAALNHPYFDDIL

SEQ ID NO: 80603 - protein, 402 aa, Erythrobacter sp. NAP1
MTAFKTLDDLGDVTGKVALVRVDLNLPMKDGSATDLTRVEAVKPTILELADKGAKVLLLAHFGRPKGQRSSVLSTSMVVGDVEKVLDKELMFIPEVHGPVVEQSIGILRNGDIGLLDNTRFWPGEEGNDPNFAQAIAAHGDFYVNDAFSAAHRAHASTEGITHFLPSYAGRAMERELKALDAALGNPEAPVAAVVGGAKVSTKLAVLENLVGRVQHLIIGGGMANTFLAARGVDVGKSLCEHDLTDTASKIMDEADHSGCTVHLPYDVVVAQEFAANPASLRTCNVHEVSSDEMILDIGPQATEALADVLKTCRTLVWNGPLGAFETEPFDTATVALARHAAALTQEGSLTSVAGGGDTVAALAQAGVTEDVTYISTAGGAFLEWMEGKELPGVAALERAHG

SEQ ID NO: 80604 - protein, 357 aa, Brassica napus
  misc_feature (330)..(330): Xaa can be any naturally occurring amino acid
MSYSTILSHNSFLSLATKFTTRGSRLQCTIAMARSAVDETSDSGAFQRTASTFRNFVSRDSNSQFPAESGRYHLYISYACPWASRCISYLKIKGLDDAISFSSVKPIWGRTKESDEHMGWVFPDSDNEVEGAEPDHLNGAKSVRELYEIASPNYTGKYTVPVLWDKKLKTVVNNESAEIIRMFNTEFNHIARNPDLDLYPSHLQAKIDEANEWIYSGINNGVYRCGFAKKQEPYEEAVQQVYEALDRCEEILGKHRYICGNTLTETDIRLFVTLIRFDEVYAVHFKCNKKLLREYPNLFNYTKYIFQVPGMSSTVNMNHIKQHYYGSHPXSINPFGIIPHGPNIDYSSPHDRHRFSK

SEQ ID NO: 80605 - protein, 180 aa, Zea mays
MLRAGARQLLAPGLRRLGLGTGAAGQVGPAAAAAGMRAYHERVVDHYNNPRNVGSFDKEDPNVGTGLVGAPACGDVMKLQIRVDEDSGKIVDACFKTFGCGSAIASSSVATEWVKGKPMDEVLTIKNTEIAKHLSLPPVKLHCSMLAEDAIKAAVKDYEAKKAKMGQKSEDSPSEKAAEA

SEQ ID NO: 80606 - protein, 172 aa, Lactobacillus reuteri
MALDLYKYVASVPDYPEKGIIFRDILPLMADGAAFKQATDELVDYAKDKKVDMVVGPEARGFIVGCPIARELGVGFAPARKKGKLPRKAISASYDLEYGTATLQMEADAIKPGQRVLVVDDLLATGGTISATIDMVEQMGGIVVGCAFLIELKDLHGRDKLKDYDMKALMEF

SEQ ID NO: 80607 - protein, 418 aa, Saccharomyces cerevisiae
MSATLFNNIELLPPDALFGIKQRYGQDQRATKVDLGIGAYRDDNGKPWVLPSVKAAEKLIHNDSSYNHEYLGITGLPSLTSNAAKIIFGTQSDAFQEDRVISVQSLSGTGALHISAKFFSKFFPDKLVYLSKPTWANHMAIFENQGLKTATYPYWANETKSLDLNGFLNAIQKAPEGSIFVLHSCAHNPTGLDPTSEQWVQIVDAIASKNHIALFDTAYQGFATGDLDKDAYAVRLGVEKLSTVSPVFVCQSFAKNAGMYGERVGCFHLALTKQAQNKTIKPAVTSQLAKIIRSEVSNPPAYGAKIVAKLLETPELTEQWHKDMVTMSSRITKMRHALRDHLVKLGTPGNWDHIVNQCGMFSFTGLTPQMVKRLEETHAVYLVASGRASIAGLNQGNVEYVAKAIDEVVRFYTIEAKL

SEQ ID NO: 80608 - protein, 120 aa, Pseudoalteromonas tunicata D2
MSVTKDQILDAIAAMSVMEVVELVQAMEEKFGVTAAAGVVVAAAAEAVEEKTEFDVILAEAGANKVGAIKAVRAATGLGLKEAKALVEAAPTPIKEGVSKADAEALKKELEEAGAKVEIK

SEQ ID NO: 80609 - protein, 486 aa, marine gamma proteobacterium HTCC2080
MTAPEPQLTTADVLTQLNATLNSQKQSYLAEGAVSAEVRMDRLDRALDILVRHAERISEAMNADFVCRPRQINMMTDVAGSIDCIKHNKKHLKRWMKSESRPSKFPLGLLGSRSKIEYQPKGVVGIIAPWNFPVAMVFEPLASILAAGNRAMIKPSEFTPKTANLLAEIIAEAFDPDEVTVITGGPDVGQAFSALPFDHMIFTGATSIAKHIMAAAAKNLVPVTLELGGKSPTVISRSADLELSLERIMSGKCLNAGQICIAPDYLMVPEESLDEVIKITQSVVGQMYPTLLDNPQYTSVINQRHHDRLSGYLADAESQGLQVIPINPADESFETSTSMKIPPTMVINPTDDAKCMQEEMFGPILPIVTYRSFDDTIDYINSHPRPLAAYYFGTDAAEEENFLQRTTSGGACVNDVMFHMLQKDLPFGGVGPSGMGAYHGIEGFKTFSHAKSVYKQTLSFNVSKLGGFLPPYGDAAEKAIKAQVKR

SEQ ID NO: 80610 - protein, 339 aa, Vitis vinifera
MASLFTCRYISESLSSSFAYHLFFLILTPLIFPFLTLTAAQASLCRTSCGGIPINYPFGIDDGCGSPYYRHILVCPDSGQLELRTPSGRYPVRSLSYSDPHILVSDPFMWNCQDGDAFRPTRPFSLDTSTHFSLSPQNDYLFFNCSEDDVIVEPKPIFCERFPDRCDSSCDSASYLCRHLPECASALGGSSCCSYYPKATESLRLMLKYCASYTSVYWRSSGGNPPDDQIPEYGVRVDFDIPVTTRCLQCQDTTKGGGTCGFDTQTQDFLCLCEQGNTTTYCKVSTVMLTIRTLIFPGTATAVSFAGVVGIAAGIWYLIKLRKKAPVACGVQSNENRLF

SEQ ID NO: 80611 - protein, 296 aa, Erythrobacter sp. NAP1
MNTQEMTAKIAKGDGFIAALDQSGGSTPKALRGYGVEDSEWSGDEEMFSRIHDMRSRVITSPCFSSGKVIGAILFEKTMDGEVDGKPTADALKARGIVPFIKVDQGLMDEANGVQMMKPLDKLPALLEKSVAKGMFGTKMRSVIKAADAEGIAAIVAQQFSVGNQIAEAGLMPMLEPEYDINADDRAEGEDILLAEIQKGLDALPEGRQVMLKLSIPKRPGHYTTLIEHPKVLRVVALSGGYSTDDACDQLAKNPGMIASFSRGLLQDLRKDQSDDEFNSALSGAIDKIQKASVLV

SEQ ID NO: 80612 - protein, 659 aa, Rhodospirillum rubrum ATCC 11170
MRPVDPAPGMSDQVTPDSEAPSSEKPAGSKATPASAPYRVLARKYRPASFDALIGQEALVRTLTNAIDSGRLAQAWMLTGVRGVGKTTTARLIARALNCVGADGKGGVTITPCGVCEHCKAIAEDRHVDVLEMDAASRTGVGDIREILDGVRYRPAVARTKVYIIDEVHMLSTAAFNALLKTLEEPPEHVKFIFATTEIRKVPVTVLSRCQRFDLRRVSAAELSGHFLRIAGLEGAEIAPSALTLIARAADGSVRDGLSLLDQAIAHGGGTVSEAQVAEMLGLADRARIFDLLDALLAGRIAESLDLLDRQYALGADPLVIVQDLLDLVHWMTRVKVVPVSAEDAAVPEAERTRGRAMAERLSMAVLNRCWQILLKGLGEARGAPVPLQAVEMVLIRLAYASDLPTPEEALKMIAGGAQPAAPRPPAPHSPAGPPPAAPPPPSPPSRADEPPRPSRPSQSNAGGGALAVAPVEVAPDPPPPPPPPPAPPAADPAGAFDPVPRSFALLVDLFRRKREAVVTGHLYRDVELVGYDPEAGLLEIHPLPAAPAKLAGQITRLLGEWTGRRWMVTLTDRPGQPTLHDATQADIHAHPLVKAVLDRFPGAVIGTIREHPGAVAAEADSPDLLGDPGEAYGAPGFDTPAGADPDDLFDPFIGDDET

SEQ ID NO: 80613 - protein, 477 aa, Burkholderia thailandensis E264
MSYRLNNESAWIQPAAPAPGAHAHRTSAEYRALDAAHHIHPFSDMGSLNRAGSRVIVKAEGVHLWDSDGNKIIDGMAGLWCVNVGYGREELIAAGSRQLRELPFYNTFFKTTHPPVIELSALLAEIAPPAFNRFFYCNSGSEGNDTVLRIAHQYWRTQNRPQKKFVISRRNGYHGSTIAGATLGGMGYMHEQMPSKVEHIVHIDQPYYFGEASEGQTPEAFGLERARQLEAKILELGAQNVAAFIGEPFQGAGGVIFPPSTYWPEIERICRQYDVLLVADEVIGGFGRTGEWFAHQHFGFEPDLMTLAKGLTSGYVPMGAVALSDRIADALIAHGEFNHGMTYSGHPVAAAVAVANLKVLRDEKIVERVKTDTGPYFQQLLRETFANHPIVGDIAGAGLVAGIQLAREPGARKRFENGGEVGTICRDYCFNGNLIMRATGDRMLLSPPLVISRPEIDEIVEKAKRAIDATAQQLGLS

SEQ ID NO: 80614 - protein, 439 aa, Candidatus Kuenenia stuttgartiensis
MATPCIDFALHKKRVSESVLVQRTGRVAHIAGLVIESNGPSVPVGELCYIHSNNGETPIPAEVVGFKEKRILLMPIGELERIGPGNRVTASGSPLTVGVGMGLMGRILGGLGEPMDGKGPLNVEERVSIYNSPPDPLTRSRIKEVLETGVRAIDGMLTFGQGQRLGIFAGSGVGKSTLMGMIARNSGAEVNVIALIGERGREVREFVEKNLGEEGMKKSVIVSVTSDKPALLRVKGAYIASSIAEYFRDRGMRVLLMMDSVTRFANAQREIGLAIGEPPTSKGYTPSVFALLPKLLERSGTGTKGSITGLYTVLVDGDDMNEPIADAVRGILDGHVVLSRAMASQNHYPAIDIMESVSRCMDDIITGEHRKAAQMLKAVYATYKEAEDMINIGAYAKGGNKKIDYALSVIDAINEYLKQDMTTNGNFNESISKLSALFT

SEQ ID NO: 80615 - protein, 272 aa, Erythrobacter sp. NAP1
MSMFSGLIRVMERAARKAGGRLRRDFGEVEHLQVSRKGPADFVSKADMRAERTLYDELLNARPGWGFVLEEAGIIEGDEGKPRWIIDPLDGTSNFLHGVPHFAISIAVQEPRLDGKGWGEVTAGVVYDVIQDATYWAEKTRGAWLQDARLRVSSRRSLSDALVATGIPFQGHGDFAEWSRIFGAIGPEVAGIRRFGAASLDLAFLAQGRFDGFWESGLNDWDTAAGCLLVREAGGFVSDFRGRSEAIHSKQILAANDTLHSKLHKILAGSLR

SEQ ID NO: 80616 - protein, 779 aa, Aspergillus nidulans FGSC A4
MTSDDTNVPPKDAETTAVQSPTSASRYSKHIVLTTYPGQSGIDPVPLEWGAPDAESRGPVVVSRSGAFVKRRNAMGAHGGSYSIYNALAIAAGDLDPNFRPNFVNTEPTFDFPWQPAWSDKTKIVSMDPYGHDVVKYFSDKINAGWDIRPTMAVTRANMKLAEIGEAVRDGLLEVDGSIVVDSTGEVRVTKVAVEPVWYLPGVAERFGVDEPTLRRTLFEHTGGSYPELITRPDLKVFLPPIGGLTVYIFGPPERVSDENVKLALRIHDECNGSDVFQSDICTCRPYLAFGIREAIREAQNGGSGVVIYFRKEGRALGEVTKYLVYNARKRGGDTADKYFTRTENIAGVRDMRFQALMPDILHWLGIKKIDRMLSMSNMKHDAIVESGIKIVERIPIPEDMIPDDSRVEIDAKINAGYFTTGKAYTMEELAQVRGRGWEKWEDITDTAAMGSQSTAVNTHPHVPKAGVWCPAVTYFDHATDTIDLEAQKKYYAYLSKTGLTGLVILGTNSEAFLLTREERAQLISAAREAVGPDFPLMAGVGAHSTKQVLELAADAASAGANYLLVLPPAYFGKATTMNVVKRFFADIARRSPLPVVIYNFPGVCNGVDIDSETITDIVHESAKSSPNGVSNVVGVKLTCASVGKITRLAATFPASEFAVYGGQADFLIGGLSVGSAGCIAAFANVFPRTASKVYELYVSGKVTEAMNLHQKAALAESPCKSGIATTKYATAIYSAKLAGIEDAEEKLKPRTPYEEPAEGAKKMVREVMGAIAKLEATL

SEQ ID NO: 80617 - protein, 720 aa, Coccidioides immitis RS
MAAPTQLAYRTLKGIGILDAAPVYEPLPGFTRPEGNLRCCTYSPCGRYFAWASPEGVSIIDPSVGHLIATLPAENVYELGFSPLGTFVITWQRPSKDENGDAVRNLKVWRVVEGPPSDNGDEPPRVPTGSFVQKSQTGWNLQYTADEKYCARVVTNEVQFYQSGNLTTVWNKLRVEGVVDFAISPGQNHTVAVFIPERKGQPASVKVFNVPQFNLPLSQKNFFKGDKVQMKWNKSGTTLIVLAQTEVDKTGKSYYGETTLYLLSTNGFDSRIDLDKEGPIHDVTWSPNSKEFGVVYGYMPAKTTVFNSRGAATHSFPLAPRNTIVFSPHGRFVIVAGFGNLAGQMDIYDLEKNYTKVATVEASNASVCEWSPDGKHILTATTSPRLRVDNGVRIWHVGGGLMYNEDMNELYDVHWRPQSSVSHPLENPLHPMPNPHPSALAYLANKKTPSKPVGAYRPPGARGQSAPMTFRREDEGGAAFIRDERPNAFGPSANAFGKPRRRVVPGAEPMDEFLPPGAAPGGGVALPPGAQADEKLSKSAAKNKKKREAKKAKENAEKAQNLSVENGGSGEQSPAGVNADRREKRAHSRSRSRGNLDPNAHGRQNRDRSRSSHRRQRSDAHGKGNNNAAQGRPNGKAKAGQPPNGALAAPVPDVTVTSPTTGNASTPQEKKIRGLLKKMRAIDELKMRLAGGEKLEDTQMKKIKTEESVRKELEALGWSG

SEQ ID NO: 80618 - protein, 163 aa, Zea mays
  misc_feature (89)..(89): Xaa can be any naturally occurring amino acid
RRITFLIGPDVSAHFFMSNESDMSQQEVYRFNVPTFGPGVVFDVDYQVRQEQFRFFTEALRANKLRSYVDQMVAEAEEYFPKWGESGTXDLKYELEHLIILTASRCLLGREVREKLFDDVSALFHDLDNGMQPISVIFPYLPIPAHRRRDQARTRLAEIFATI

SEQ ID NO: 80619 - protein, 319 aa, Bradyrhizobium sp. BTAi1
MSSRPITGSGLDNATSAGERWGLDRLVAELRVSREETHSIRKDGVIHRPPSREKLAQVVSALTEALFPRHYGQYDLDGENIDYFVGHRLSVALDLLSDQIHRAALFVGDELIPGFRQPEAMELTRRFAAELPALRGILISDLRAAFVGDPAAKSFPEILIGYPGMTAIIHHRLAHLLYGLGTRLVSRLIAEIAHARTGIDIHPGAQIGSGFFIDHGTGVVIGETAIIGDHVRIYQAVTLGARHFPTEEDGTLIKGDARHPIVEDDVVIYAGATILGRITIGRGSTIGGNVWLTHDVPANSVVTQASLRNRVGGPALQKS

SEQ ID NO: 80620 - protein, 292 aa, Symbiobacterium thermophilum IAM 14863
MARFLVTGAAGFIGSHLVEALRAAGHDVVGVDRRPGADVVGDLLTLDLAPLLDGVEYVVHLAGQPGVRESWSQFPAYLAGNLQTTQRLLESLRDRPLKKFVLASTSSVYGEVPMPAREDGPAMPVSPYGLTKLAAEKLCDLYGRTAGIPWVALRYFTVYGPRQRPDMAFSRWFNAALDGEPIQIYGDGSQLRDFTYVADAVTATQRAALNPVVGVPINVGGGSAVTVREAIRLIAAITGRPIRIRQLPPAPGDMRETRADTERLWREVGFRPSTPLEEGLWQQYRWHLAQRA

SEQ ID NO: 80621 - protein, 402 aa, Oryza sativa
QMNDSRLNVGLACTAAVVGAAILNYAEVVSLIKDESGERIIGARIRDTLSGKEFDAFAKVVVNAAGPFCDSVRKMANNDVVPMISPSSGVHIVLPDYYSPDGMGLIVPKTKDGRVVFMLPWLGRTVAGTTDSSTAITMLPEPHEDEIQFILDAICDYLNVQVRRSDVLSAWSGIRPLAMDPSAKNTESISRDHVVFEDYPGLITITGGKWTTYRSMAEDAVNAAIRSGNLKPANGCVTDHLHILGGYGWDPASFTVLAQNYKRMKRTYGGKIIPGAMDSAVSKHLSHAYGTLATQVASIAQNEGLGKRLAHGYPFLEAEVAYCARHEYCESAVDFIARRCRLAFLDTDAAGRALPRIIEILALERKWDKARQKLELQKGKDFLETFKSSKNAQFRDGKHNGQ

SEQ ID NO: 80622 - protein, 367 aa, Sulfolobus solfataricus P2
MKLENKKGYLYLEDGTFIEGYSFGAKGIKVGEVVFTTSMNGYVESLTDPSYKGQILIITHPLVGNYGVPEKKYEQGILTNFESERIQVEGLIVAEHTYPSKWNSALTLDEWLKSENVPGVFDVDTRMIVKKIRTYGTMMGIIASELEIDDPRKYLEKKYDEIDFTQFTSPKSPIFHPNTGDMIVVVDCGIKHGILYGLYKRGFSIVRVPCSFSASKIIEYNPKGIVFSNGPGNPNLLENQIKTFSELVEYKIPILGICLGHQIATLALGGKIKKMKFGHRAINKPVIESNSNKCYISTHNHGYGIISKNDIPPNTKIWFYNPDDYTIEGLIHEKLPIITTQFHPEARPGPWDTTWVFDKFRTMVTGK

SEQ ID NO: 80623 - protein, 236 aa, Haemophilus somnus 129PT
MSKLSLIQQLKQQKLSVGILSANWLQLNEEVTTLLENQINVLHFDIADGQFSSLFTVGAIGIKYFPTHCFKDVHLMVRNQLEVAKAVVANGANLVTLQLEQYHDFALTIEWLAKQKTTYANQVYPVLIGACLCPETPISELEPYLDQIDVIQLLTLDPRNGTKYPSELILDRVIQVEKRLGNRRVEKLINIDGSMTLELAKYFKQGTHQIDWLVSGSALFSGELKTNLKVWKSSIM

SEQ ID NO: 80624 - protein, 491 aa, Bacteroides fragilis YCH46
MATQNKTDIGLIGLAVMGENLALNMESRGWNVSVYNRTVPGVEEGVVERFINGRAKGKHIEGFTDIEAFVESIALPRKIMMMVRAGSPVDELMEQLFPYLSPGDILIDGGNSNYEDTNRRVKLAESKGFLFVGAGVSGGEEGALNGASIMPGGSEKAWEEVKPILQSIAAQAPDGTPCCQWVGPAGSGHFVKMIHNGIEYGDMQLIAEAYWVMKELLDMTNEEMASVFTRWNEGKLRSYLIEITGNILRHKDKTGAYLIDKILDAAGQKGTGKWSVINAMELGMPLGLIATAVFERSLSARKELREAAARQYQCRHSMAVYNKQDTEKEIFSALYASKLVSYAQGFAVLQRASDTFGWNLDLASIARMWRGGCIIRSVFLNDIAAAFEAKEKPKHLLLAPYFEEEIKGLLSGWKNLVAQAMREELPVPAFSSALNYFYSLVSADLPANLVQAQRDYFGAHTFERKDELRGVFFHENWTGHGGDTKSGTYNV

SEQ ID NO: 80625 - protein, 498 aa, Bacteroides fragilis YCH46
MSKFVMTIFGASGDLTKRKLMPALYSLYVAKRLPEEFEILGVGRTVYEDADYRTYIYNEMEKFVKSEEQNKEKMDAFVGHLHYLAIDPALESGYGQLRLRIEELSGDSRPDDLLFYLATPPSLYGVIPLHLKSVHLNKGRARIIVEKPFGYDLESAEKLNKIYASVFDEHQIYRIDHFLGKETAQNLLAFRFANGIFEPLWNRNYIDYVEVTAVENLGIEQRGGFYDTTGALRDMVQNHLIQLVALTAMEPPAVFNADNFRNEVVKVYESLTPLTETDLSEHIVRGQYTAGGNKRGYREEKNISPDSRTETYIAMKLGISNWRWSGVPFYIRTGKQMPTKVTEIVVHFRETPHQMFHCAGGNCPRANKLILRLQPNEGIVLKFGMKVPGPGFEVKQVTMDFSYDQLGGVPGGDAYARLIEDCILGDQTLFTRSDAVEASWHFFDPILRYWNEHPEAPLYGYPAGTWGPLESEAMMHEHGAEWTNPCKNLTNTDQYCEL

SEQ ID NO: 80626 - protein, 382 aa, Acacia mangium
MVVECITNNLPSMPHPAKHGTKEDKEDEPLVFDASLLRYEHNLPKQFIWPDEEKPCLNPPELVVPLVDLRGFLSGDPVAAMETSKLVSEACRKHGFFLVVNHGIDSRLISHAHRFMDDFFELPLSQKQRAQRKTGEHCGYASSFTSRFSSKLPWKETLSFQFSADKNSQNLVKDYLCEKVGHEFEQFGMVYQEYCEAMSNLSLVIMELLGMSLGVGRTCFREFFDKNNSIMRLNYYPPCQKPDLTLGTGPHCDPTSLTILHQDKVGGLQVYVDNEWHSITPNFNAFVVNIGDTFMALSNGRYKSCLHRAVVNSQTTRKSLAFFLCPGDDKVVTPPSELVDHVSPRIYPDFTWPMLLEFTQKHYRADMNTLEQFANWVQRNKS

SEQ ID NO: 80627 - protein, 334 aa, Saccharomyces cerevisiae
MASKTLRVLFLGPKGTYSHQAALQQFQSTSDVEYLPAASIPQCFNQLENDTSIDYSVVPLENSTNGQVVFSYDLLRDRMIKKALSLPAPADTNRITPDIEVIAEQYVPITHCLISPIQLPNGIASLGNFEEVIIHSHPQVWGQVECYLRSMAEKFPQVTFIRLDCSSTSESVNQCIRSSTADCDNILHLAIASETAAQLHKAYIIEHSINDKLGNTTRFLVLKRRENAGDNEVEDTGLLRVNLLTFTTRQDDPGSLVDVLNILKIHSLNMCSINSRPFHLDEHDRNWRYLFFIEYYTEKNTPKNKEKFYEDISDKSKQWCLWGTFPRNERYYHK

SEQ ID NO: 80628 - protein, 485 aa, marine gamma proteobacterium HTCC2080
MREDSSSNSTGLKQGAVDYESVDSGYLEQRQLKQGTAGWILLAGLGVSYVISGDFAGWNFGFAQGGFGGMFIATVLIALMYGCMVFGLAELSAMIPTAGGGYGFARRAMGPVGGFLTGTAILLEYAIAPAAIAVFIGGYTGALLGVDGPIIYALFYTIFVGIHLRGTGEALKIMLVITAVAVLALLLFVVGMLPHFSWDNLTDMPVNTDAVGASIWLPEGYWGIWGAIPFAIWLFLAVEGVPLAAEESKDPTRDMPKGIITAMLILLLLGGLVLFLAPGGSSAALMADHAAPLVGALQHVYGENSVLATVVNVVGLAGLIASFFSIIFGYSRQVFALSRAGYLPRWLSVTSARKVPVLALIVPGVFGFALSLTGAGDLMITMAVFGATLSYGLMMASHILLRLKEPDLERPYRTPGGILTTSIALVLSVVAFASTFVVSREAALWSAVFYGALVAYFALYSRHHLVAQAPEEEFAALAKAEAELQ

SEQ ID NO: 80629 - protein, 382 aa, Acacia mangium
MVVECITNNLPSMPHPAKHGTKEDKEDEPLVFDASLLRYEHNLPKQFIWPDEEKPCLNPPELVVPLVDLRGFLSGDPVAAMETSKLVSEACRKHGFFLVVNHRIDSRLISHAHRFMDDFFELPLSQKQRAQRKAGEHCGYASSFTSRFSSKLPWKETLSFQFSADKNSQNLVKDYLCEKVGHEFEQFGMVYQEYCEAMSNLSLVIMELLGMSLGVGRTCFREFFDKNNSIMRLNYYPPCQKPDLTLGTGPHCDPTSLTILHQDKVGGLQVYVDNEWHSITPNFNAFVVNIGDTFMALSNGRYKSCLHRAVVNSQTTRKSLAFFLCPGDDKVVTPPSELVDHVSPRIYPDFTWPMLLEFTQKHYRADMNTLEQFANWVQRNKS

SEQ ID NO: 80630 - protein, 642 aa, Triticum aestivum
  misc_feature (625)..(625): Xaa can be any naturally occurring amino acid
MESARAGSERAGTMDSPEPRIEVEQKPVLASNTKEQTIPVKDEKTVKPTISLDSSVINLPSDGQAQAGTSNIGGEHNVVYPQHMYSSQAQPFYYQGPGYENPPNEWDVYPPYAEGLEAGPAVVYNEDPSMMYHGGYGYDPYAHYSPISTPVPAGVSGDGQLYSPQQFSFSAPYYQQPVQPGMPYLSSPTPISQGETMMPIDPTQGAFMADTLSPNSFLFGPRPEWFRSSEGTGSFPSPAASPQPFGGVSGPFGQSNFPMASGMMSPQQKSFFGFGTPGDSYGRGFSHSGGFPQATNYGGPFPGYGMNGRSFIPIDKGRRRGRGNSLLCSCDGPLDFLNEQSRGPRATRPKKQPEDDSKDEKPSVGLDQEPYNRADFVTEYKNARFFIIKSYSEDNVHKSIKYGVWASTTNGNKKLDAAYHEVKDKEEHCPIFLLFSVNASAQFCGVAEMTGPVNFEKSVDYWQQDKWTGQFPVKWHIVKDVPNNLFRHIILENNENKPVTNSRDTQEVKLEQGLEMLKIFKDHEDDVSILDDFDFYEEREKALLENKARLHQQQQISSSCVADPKRPSTVPTDLVGHGTKTPSVVEPKKPSTVPTDVVGHITKTFAQAVRLGEAKSVSPSGQESXGGDSSAAAKPVEVRESD

SEQ ID NO: 80631 - protein, 306 aa, Synechococcus sp. WH 8102
MIDRLGPPGGDPAIDGPLDDRLGGAPANVACGLARLGTSVAFLGRLGADAIGDRFATLFLQRGVDVDSVQWDAQRPSRIVLVRRSADGERQFRGFAGDEGLGFADQALASVELPKQARWLLTGTLPLAAHASADSLRGAVAQSKARGIALAVDVNWRPTFWDSAARPDAGPSQQAIELIRPLLEQAALIKLAREEAIWLFGSTDPRAICTQLPQEPDVVVTDGAEPVRWWMDGASGTQPAFHPPQVVDTTGAGDAFTAGLLHRWSASPAERVRFASACGALVCAGAGGIDPQPTEAQVEAFLGGVS

SEQ ID NO: 80632 - protein, 437 aa, Oryza sativa Japonica Group
MGKHHVTLCCVVFAVLCLASSLAQAQVLFQGFNWESWRKQGGWYNFLHEKVEEIASTGATHVWLPPPSHSVSPQGYMPGRLYDLDASKYGTEAELKSLIEAFHDKNVECLADIVINHRCADYKDSRGVYCVFEGGTPDGRLDWGPDMICSDDTQYSNGRGHRDTGAGFGAAPDIDHLNPRVQRELTDWLNWLRTDLGFDGWRLDFAKGYSAPLARIYVDNTNPTFVVGEIWSSLIYNGDGKPSTNQDADRQELVNWVEGVGKPATAFDFTTKGILQAAVQGELWRLHDGNGKAPGLMGWMPDQAVTFVDNHDTGSTQSLWPFPSDKVMQGYAYILTHPGIPCIFYDHVFDWNLQHEIATLAEIRSRNGIHAESTLDILKAEGDIYVAMIDGKVITKLGPRYDAGGIIPSDFHVVAHGNDYCVWEKEGLRVPAGRKHY

SEQ ID NO: 80633 - protein, 160 aa, Zea mays
VDIPGGGRVVVLNTANLPLVREVGLGADLVRIDAHSMCSPGFSCDSAYQVTYIVRGSGRVQVVGPDGRRVLETRIEGGSLFIVPRFHVVSKIADASGMEWFSIITTPNPVFSHLAGKTSVWKAISPEVLQASFNTTPEMEKLFRSKRLDSEIFFAPPSSN

SEQ ID NO: 80634 - protein, 282 aa, Oryza sativa
  misc_feature (207)..(207): Xaa can be any naturally occurring amino acid
  misc_feature (225)..(225): Xaa can be any naturally occurring amino acid
  misc_feature (244)..(244): Xaa can be any naturally occurring amino acid
MAHFNYLTPELQAELKRTAEAIVADGKGILAADESEGTIGKRFATIGIENTEENRRLYRQLLFTTDPELANYISGVILFHETVYQKDDNGTPFVKLLEEKNIIPGIKVDTGVVDLQGTNGEVTTQGLDNLTKRCVQYKKDGCRFAKWRCTLKITDKTPSQLAILENANVLARYASCCQQAGIVPIVEPEVLPDGDHDVERCQKVTEXILAAVYKALSDHNVYFRXGLLLKPNMVTSCMQAPKKXTTNENAETTVKSVQRTMPPTWPVVVSLSRGSSEEETFT

SEQ ID NO: 80635 - protein, 431 aa, Symbiobacterium thermophilum IAM 14863
MPIAVAGAGYVGLTTAACLCELGHEVALLEIDGERVARLRRGECPFYEPGMDRLLRRHLGRSLTVTTSLDEAIRRAGMIIVCVGTPPSSSGAPDLQALWRLLDDLRVRRPAEPLTVVLKSTVPPGTNRRAQGRLGAGFAVVSNPEFLREGTAIHDFFHPDRIVVGAESAPAARQVADLYRGIDAPLVTTGWEEAELIKYASNAFLAVKLSFANEVAALADALGADGLAVLKGVGLDRRIGGHFLHPGPGYGGSCLPKDLAALLWTARRRRVRLDLLPAARRANLRQRERVLAMLEPAAGRRIAVWGLAFKAGTDDVRESPALAIVPALLAQGARVLAHDPQARGNFAAALAAGQAQGLPAGLELVDDPWEAIRGADALLVLTEWPEYAAAPPEEIRSALAGDLVVDARNLFDPASMAAAGLRYRGVGRRGR

SEQ ID NO: 80636 - protein, 466 aa, Glycine max
VQLGLGDTEDRYTPCFVEALRDRQVNTITCGPSFTAAISLHKPISISDQSTCTGCRLPFGFTRKKHNCYNCGLLFCRACSSKKITNAPLAPSKSKAFRVCDQCFDKRQGGAHSVMASKSRNYNTQQVLKHQHKISDVTEDRGETTVTQGPMLSLGQSCYRKSMPSGRKDWKNHQEIQQDVEDSSSMLGGMPQWGQVPCPAMFQINCTENPVVHVSSSKNKLATVSPFNVESTAYNFSSNVETDTTKSDKVLLEEVHRLRAEAKRLEEQCELKNRKIQECRQKIEESWFVAREEAAKCKAAKEVIKALALRARVVDARAGNVGQEGKAGPNEFVPNVAPIHTEMKSPRDVNVDSLSNSPIVFSDTLKSKFGRSLFPKIDNSNRAESQQDNIDGLKAEWVEQYEPGVYITFTTLQCGKKGLKRVRFSRKRFSEKEAEKWWEENQGTVYHKYGIEGYINNNTSQSQVKG

SEQ ID NO: 80637 - protein, 187 aa, Marinobacter sp. ELB17
MGIINSEIKPFNATAFKRGEFVEISETDVKGKWSVFFFYPADFTFVCPTELGDVADKYAELQKMGVEVFSVSTDTHFTHKAWHDSSETINKIQYYMVGDQTGNITNNFGVMREGQGLADRATFLIDPDGVIQAVEITAEGVGRDASELMRRVKAAQYVRKHPGEVCPAKWQEGEATLSPSLDLVGKI

SEQ ID NO: 80638 - protein, 249 aa, Vitis vinifera
MKFNIANPTTGCQKKLEIDDDQKLRAFFDKRISQEVSGDALGEEFKGYVFKIMGGCDKQGFPMKQGVLTPGRVQLLLHRGTPCFRGYGRRNGERRRKAVRGCIVSQDLSVLNLVIVKKGEGELPGLTDVEKPRMRGPKRASKIRKLFNLSKEDDVRKYVNTYRRTFTTKSGKKCSKAPKIQRLVTPLTLQRKRARIAEKKKRIAKAKSEAAEYQKLLATRLKEQRERRSESLAKKRSRLSAASKPSIVA

SEQ ID NO: 80639 - protein, 433 aa, Shewanella sp. MR-7
MRFESFSFCPEILRAISDCGYQKMTPIQQQAIPAIRRGQDVLASAQTGTGKTAAFALPILQKMVENPSETLKSNARVLILTPTRELAAQVADNVEAYSKYLNFSVLTIYGGVKVETQAQKLKRGADIIVATPGRLLEHLTACNLSLSSVDFLVLDEADRMLDMGFNADIQKILQAVNKKRQNLLFSATFSSAVKKLANDMMVKPQVISADKQNTTADTVSQVVYPVEQRRKRELLSELIGKKNWQQVLVFTATRDAADTLVKELNLDGIPSEVVHGEKAQGSRRRALREFMSGKVRVLVATEVAARGLDIPSLEYVVNFDLPFLAEDYVHRIGRTGRAGKSGVAISFVSREEERTLADIEKLIGQKIRRITVPGYEVGSRDLLLKQLQTRRSFAKKQQRLDNVSEQIVAEKSMQGRRVKMKVGQAPSKAKKLK

SEQ ID NO: 80640 - protein, 407 aa, Pyrobaculum aerophilum str. IM2
MVRIAVIPVGGEAVRLRPLTVETSKAMIRFLNRPLVELSILHLARQGIEEFYFGVRGYHNYRDIYDYFREGSWFAVKYGVNIKIRYMPRVETRGNAEAVLATLEYYDINEPVLVIQGDNIFNLDVKEMYSFHSSKKAFITIALKEETGDLSEFGVAAVDDNMRILKFVEKPKRREEAPSNLVNTGLYLLSEDFKSFFKGELGGKLYSEGRLDFGGDVIPAVIEAGLPVYGYHTKGYWFDVGTPERYLKAVQYLLRHLTAYELEAEEIAPSVFAQGKSEQSKALKEKIAEAIKNGQIKAEGRLLLGRHVQIGDNSYLRDTVIDNYVIIGDNSVIEDSVVMDRSYIGRGVVIRRSIIGRHVQIGDGAVIEDAVVADNVIVGDGAHLRRVKVWPHKTVERGVRLEGFSLI

SEQ ID NO: 80641 - protein, 403 aa, Pseudomonas fluorescens PfO-1
MNKSFWKSGHTPTLFAAFLYFDLSFMVWYLLGPLAVQIAGDLHLTTQQRGLVVATPILAGAVLRFAMGMLADRLSPKTAGLIGQVIVICALFGAWKLGIHSYEQALLLGLFLGMAGASFAVALPLASQWYPPEHQGKAMGIAGAGNSGTVFAALIAPVLAAAFGWSNVFGFALIPLILTLVLFAWLAKNAPERPRAKAMADYFKALGDRDSWWFMFFYSVTFGGFIGLASALPGYFNDQYGLSPVTAGYYTAACVFGGSLMRPLGGALADRFGGIRTLLAMYTVAAVCIAAVGFNLPSSYAALALFVCTMLGLGAGNGAVFQLVPQRFRREIGVMTGLIGMAGGIGGFALAAGMGAIKQSTGSYQLALWLFASLGVLAWFGLHGVKRRWRTTWGSAAVTAARV

SEQ ID NO: 80642 - protein, 1000 aa, Kluyveromyces lactis NRRL Y-1140
MSGYYNRQYSHFHGNNDRYQTGRYAYQENGNRYKGFQRNGSGNRRYSREGFGSQLRNNENESRPIRSQSRGISEIPRNPFATRPVVSAKYDRDEFNTKYHYYDIVSKRLRNESSFKKWKSEKIPEHGYVTTTELIASDKQKPILMARQPEQTSVDPRIRPMNGDAVSGSISAKKRYRKLRSALVRNSRIPYDSFYIGPEPPKEIIVYPSASNQQPIAAALSEAIIKNYFKSFGEIAHFEQFMDPNSALPLYVYLIKFTGPVSQPDAPYKAAYKASEKFKDAPYTVSGIKFNVILNQNTVLNSIKDKLIKQNAARVTEVNKAKRAIAEKSSGQKPQVIRGVPYDLTQVVNNRPVLFVPAKITFYHRFNAADFRYQLRKYNWAKIIDHYTGVYIVFHDLENAKACLEYESGALVINSHRTHSPIQIEFTFIEPKRRLQSNITNQRDINKPRKIEYSSTEELLEASTKQILKDLHNIIKRDILRRLVGPIIFDTLNPANYPEVVERQKKLDDEKKKREESQKKTTIKAKPAEFDIFSLYGPASKTKKLKRDRKADLGKRHLYTEESPDHQRKKKPKVEHMSHLLNDEISTREDTVDSLNVGSNGENSPESSGYESEDIISDESKKQSSVITTPEEDLPESAASLPDERSKELLQYEGKYKPIASEFPTPVYPYDDFDLNKSKQLSLDKFQLALKDEEDFSILKGIVSEKSKDITTDYTPFLPYSMWKLYQQIEQNGIIRDNQIALNEKEFDSTLASTTGSFIADGFKKIPDKLKSSYLLHHRRLAQPLNTVHNHQEQNFMALNGTESTNQEADLEQDNHNASSRLNRVFQRRFQQDIEAQRAAIGFESDLLSLNQLTKRKKPVTFARSAIHNWGLYALEPIAAKEMIIEYVGESIRQPVAEMREKRYIKSGIGSSYLFRIDENTVIDATKRGGIARFINHCCEPSCTAKIIKVDGRKRIVIYALRDIGTNEELTYDYKFERETDEGERLPCLCGAPSCKGFLN

SEQ ID NO: 80643 - protein, 524 aa, Streptomyces cyanogenus
MTSVEEGVPDIQDRLDELRELKRQAREGLDPSATERQHAKGKLTAYERIELLLDEDSFNEVEPLRRHRAQGFGLEAKKPYTDGVITGWGTVEGRTVFVYAHDFRIFGGALGEAHATKIHKIMDMALSAGAPLVSLNDGAGARIQEGVTALAGYGGIFQRNTKASGVIPQISVMLGPCAGGAAYSPALTDFVFMVRETSQMFITGPDVVKAVTGEEITQNGLGGADVHAGTSGVAHFAYDDEESCLQEVRFLLSLLPANNRELAPVEDSGDPAERLTEALLTLVPADSGRSYDIRAVIEEIVDGGEHFEVHPAWGANLVCALARLDGHVVGIVANQPTVMAGVLDIESSEKGARFVQFCDAFNIPLVTLVDVPGFLPGVDQEHSGIIRRGAKLLYAYCNATVPRVSLVLRKAYGGAYIVMDSRSIGADLALAWPTNEIAVMGAEGAANVIFRREINASDDPESVRRQRIKEYRTELMHPYYGAERGLIDDVIDPRDTRRVLIRSLAMLRAKHADLPSRKHGNPPQ

SEQ ID NO: 80644 - protein, 753 aa, Oryza sativa Japonica Group
MAWHFTAAFMIATCLMLFPRSEQSSQGEVLQQLRKQLEYPRQLDVWNNPNSDPCYTQPTSVVTVACEGNAITELKIIGDRITKPPKFSGYPVSNITLSEAFVLDSFVTTLARLPALHVVILVSLGLWGPLPDKIHRLSSLQVLDLSSNFLYGSIPPKLSAMPKLHTLTLDGNFFNGTMPDWFNLYSNLTVLRLQRNRLKGPIPASIGKATMLSELALAGNSIAGEVPQLGSLNKLEMLDLRDNELDGELPELPTALVTILLSKNSLKGEIPEQFGQLNRLQHLDLSFNFLVGKPPEKLFALPSISYLNLAANMLSGSFSTSLTCSSTLGFVDLSTNQLTGDLPVCLNVNVNNRVVKFDGNCFSDDPEHQHETKYCQQPHKGRGSNKDVGLVVTVVGVVFIVLVLSLILMASNRRSCQRVLAEQQLLQKQMQDNSTSGMSTELLVNARYISQAVKLGTQIMPMYRAFSLEELKEATKSFERSAFLGEGSIGKLYKGKLENGTLIAIRCLALHQRYSIRNLKLRLDLLAKLRHPNLVCLLGHCIDGEVDESSVKRVFLVYEYVPSGTFPSYLSGSSPEKTLNWCERLQVLMNIAKAVHFLHTGIIPGSLYNRLKPSSILLDEHLVAKLSDYGLSIITEEIYKHEAAGEGQRCVEDNGGELENLEDDVLSFGGILLEVLMGPKRHRKDLSVLSELVLSISKQEEREQVLDPVVLSTSSQDSLSMLNLQPGLRSKRFSGIRRTSLESAVRCTSPGNI

SEQ ID NO: 80645 - protein, 586 aa, Dichelobacter nodosus VCS1703A
MRRKVSFIAHKMQMLFYRLTPMRHWYQRITPKNVQYDFWAGLTGAVMVLPQGIAFSLIAGLPPEFGLYSAIVVQIIAGFWGSSLHMVSGPTIALSIVIPNIVSNYAAMGSPEYIGLSLTLMLIVGVIQLAFGLFRLGGLVNFISHTVIIGFTAGSGVLIMLSQLPTYLGIDIARGLSFIDKWGAIYQQLPHIHWHSFIVATVTLITAISLRIYRKKLPFMLLGMIAGAVTASFLGGEEAGIAMLGALPEKLPRFIAPPFDILKISAMIPSAFALALLGLIEAVSIARSLSIRSHQRIDGNQEFFGQGLSNIIGSFLSCYVGSGSFNRSAVNYDAGAKTPFALLFSSLIVATVIITIPWITRYLPMAAMAGVIMLAGYNLFDITHIKIIARTSTNETAIILVTFLSTLFLNLEFAIYVGVILSLVLYLQKTAHPVIVEVDFSSITPAVLHQDNPPKISVVQINGSLFFGAIDHIHRTMEQYAANHQWQHVIIMAEGINLIDISGIEFLISERERLLKYGGDLYIIGLKPHVREELRKSPYWRDLDGDEKIFESTYSAFRDICKKLEIQNYRDFMRLLFHDYNKLGLN

SEQ ID NO: 80646 - protein, 567 aa, Acidobacteria bacterium Ellin345
MPEVAQETKAQRVERLKREKNAWERIDEIRTFAREGWDSIPPEWLGTYFRSWGVYTQGDGVGAVGGKGGEGRAVPFFMVRIRIPNGILTTSQLRVIADVSRRYARGIADITVRQNVQLHWVKIEDLPDLLAALENAGLTTLGACGDVTRNITGCPLAGVDGDEIFDASPIALELNRLFVGNAEFYNLPRKFKISITGCRHWCTYPEINDVGLTAVIRRRNGVEEKGFSIRVGGGLSTQPFLGVRLNAFVPYDKAVVTARTIAEIFRDQTVLRESREQARLKFLFLKHGWSADAMLAEVERRLSFHFDPAEPEDLVGDEFRDHIGIHPQRQPGLSYVGASVLRGRTGADQLSAVADLADRYGNGEIRTTTMQNLIFVNVPSAQTGRLAAELEALGLQVEPSPFWRGAVACTGTEFCKLAITETKSFTRWLVDELEERAPEFTEPLRINVTGCPNSCGQHWISDLGLEGKKLKVNGVMQDAYYFCVGGAVGLHQAIARPVGYRCLATDVPDAIARLLSRYLDDKHEAKSLREFLGRHTIDDIRGFLAGTSITGVPRDVAAGPVPHGVEG

SEQ ID NO: 80647 - protein, 130 aa, Saccharomyces cerevisiae [sequence omitted]

SEQ ID NO: 80648 - protein, 168 aa, Pseudoalteromonas tunicata D2
MANVEAKQQQSDLAEKLVAVNRVSKVVKGGRIFSFTALTVVGDGAGKVGFGYGKALEVPAAIQKAMEKARRNMINVDLNGNTLQHPVKGRHAGSLVFMKPASEGTGIIAGGAMRAVLEVAGVHNVLSKCYGSTNPINVVRATISALENMTSPAKVAAKRGLSVEQIKG

SEQ ID NO: 80649 - protein, 439 aa, Dichelobacter nodosus VCS1703A
MSSSTNKMSVLQLTILTAVNMMGSGIIMLPTKLAEVGSLSIVSWLITALGSMALAYAFAKCGMYSRKGGGMGGFAEYSFGKAGNFMANYTYGVSLLIANIAIAISAVGYGAAFLNAQLTPVSTALFTIAVLWIATVLNFGGAKLTGRISSFTVWGVIAPVIVISTAGWYFFSGDLYTQNWNIHNLPFGEAATSSIAMTLWAFLGLESACANADAVENPEKNVPIAVLGGTLGVAAIYIVSTNIMFGIVPAANLAESSAPFGMVFSSMFNPSIGKLVMGLMVLSCFGSLLGWQFTIANVFKGSSDEGYFPAIFSKVTAKNAPVVGMIVITATQSLMSLMTISPTLSKQFEALVNLAVVTNIIPYLLSMGAAIVILKAAQRGGKELTITTILATVGSIYSLYALYASGFEAMTYGSIVTFAGWTLYGFISDKFDLASNKKP

SEQ ID NO: 80650 - protein, 181 aa, Debaryomyces hansenii CBS767
MGLSFSKLFSGLFGRKEMRILMVGLDAAGKTTILYKLKLGEIVTTIPTIGFNVETVDYKNISFTVWDVGGQDKIRPLWRYYFQNTQGIIFVVDSNDRDRIAEAREELQQMLNEDELRDALLLVLANKQDLPNAMNAAEITEKLGLHSIRQRPWYIQATCATSGDGLYEGLEWLSTNLKNSA

SEQ ID NO: 80651 - protein, 472 aa, Arabidopsis thaliana
FASSGSDDNDVVIIGGGPGGYVAAIKAAQLGLKTTCIEKRGALGGTCLNVGCIPSKALLHSSHMYHEAKHVFANHGVKVSSVEVDLPAMLAQKDTAVKNLTRGVEGLFKKNKVNYVKGYGKFLSPSEVSVDTIDGENVVVKGKHIIVATGSDVKSLPGITIDEKKIVSSTGALSLTEIPKKLIVIGAGYIGLEMGSVWGRLGSEVTVVEFAADIVPAMDGEIRKQFQRSLEKQKMKFMLKTKVVGVDSSGDGVKLIVEPAEGGEQTTLEADVVLVSAGRTPFTSGLDLEKIGVETDKGGRILVNERFSTNVSGVYAIGDVIPGPMLAHKAEEDGVACVEFIAGKHGHVDYDKVPGVVYTYPEVASVGKTEEQLKKEGVSYNVGKFPFMANSRAKAIDTAEGMVKILADKETDKILGVHIMSPNAGELIHEAVLAINYDASSEDIARVCHAHPTMSEAIKEAAMATYDKPIHM

SEQ ID NO: 80652 - protein, 324 aa, Yarrowia lipolytica CLIB122
MSITDSFKLNDGHSIPALGLGTASDGNVEEVVYAAIKNGYRHIDTAFIYGSEVDVGKGIKRAIDEELVKRENLFVTTKVWPTFYNRVSESLDISLKDLSLDYVDLLLVHWPVSLLADSDDPRAIYLVNTDGSVRYSDSLDDWITTYKQIEEEKLSGRTKSIGVSNVSEVYLKRLLDQVKTVPAVNQFEIHPYLPQKKEIEFNEKHGILVTAFSPLGSSTGALKLHENPIAVEIAQKHNTSTGSVLINWHVSQKRAVLPKTRSIERVVANGMKVPLDQGDLDKLDKIWLQTGTQRAIGLRWLDKNGDYLGFSEDDIEHKHIWAKD

SEQ ID NO: 80653 - protein, 326 aa, Streptomyces avermitilis MA-4680
MTWLITGGAGYIGAHVAWAMTEAGERVLVLDDLSAGVPDRLPTSIPLVQGSSLDGALLKRVFAEHSVTGVVHLAARKQVGESVAQPTRYYQENVGGLTTLLDAVAGAGIQRFLFSSSAAVYGNPDVDLITEDTPCAPVNPYGETKLAGEWLVRAAGRAHGISTVCLRYFNVAGAASPELADTGVFNVVPMVFDRLTRGEAPRIFGDDYPTSDGTCVRDYIHVADLADAHLAAARRLTAGATGDLTVNIGRGEGVSVRELITLIGEVSGDTTPALVEPRRPGDAPRAVASAALAAEELGWHARRGVREMVESAWRGWRHHHPEAARG

SEQ ID NO: 80654 - protein, 206 aa, Cupriavidus necator
LQPGSAQVAAGYALYGPTTMLVLTVGNGVNGFTLDPNLGEFFLTHPHLRVPPDTQEFAINASNSRFWEAPVQRYIGECMAGKSGPRGKDFNMRWIASMVAEAHRILMRGGVFMYPRDTKDPAKPGRLRLLYEANPIAFLMEQAGGRASTGRQTLMSVAPGALHQRIGVIFGSRNEVERIEGYHTNQTDPDLPSPLFNERSLFRASA

SEQ ID NO: 80655 - protein, 444 aa, Marinobacter sp. ELB17
MSFSSLGLSEPLVRATLDQGYETPSPIQLKAIPAVLAGKDVMAAAQTGTGKTAGFVLPILQMLEQNPRTGKGPRVLILTPTRELAAQVHDSVNLYSRYVPTRAAVVFGGVKINPQMMKLRKGLDVLVATPGRLMDLYQQNAVRFNEVEFLVLDEADRMLDMGFIRDIRKILAMLPAKRQSLLFSATFSNEIRTLAKGLLNDPVQIDVAVRNTTAESVIQSVYPVDQSQKTALLSKLVRDNSWEQVLVFTRTKHGANRLTEKLGKDGITAAAIHGNKSQGARTRALAEFKQGDIRVLVATDIAARGLDIKQLPQVVNFELPNVPEDYVHRIGRTGRAGESGHALSLVSADELSMLVGIEKLIKKQLPRKEVEGFEPKNNVALKPKAKADPSKARNRSGGNGGGNGRPSDKPRSFGDKPGGRSAGRSQNGNGGQRGRSGQRQNQGA

SEQ ID NO: 80656 - protein, 131 aa, Oryza sativa Japonica Group
MAAAALRPAILRRIRLSPSPAAAAGAAAASQPHALARWLARPMSSHDAHLTRDEVVDRLLDVLKCHPKVDPSKVSPEAHFEKDLGLDSLDTVEVVMAIEEEFKLEIPDQEADKIDSLPLAIEYVANHPMAA

SEQ ID NO: 80657 - protein, 532 aa, Yarrowia lipolytica CLIB122
MPSQRWTQINQGPDRDSLELASLASSHSDGNEVHSPSSSRNLSPWDSPIGSDFGDDREPLHERTESGHTVESFQLQQSTDVGPQQALDKQKSLTYFNCLALVMGLQVGSGIFSSPGTVDHNAGSIGSAIIVWAVAGVLAWTGACSYTELGSTIPLNGSSQAYLNYVFGSLAGFLFAWAALMVLKPGSAAIIALVFGEYVVKMCIGTDTPAPFWAVTLAALGGLAFVTGLNCFSTKSSTRAGNGFLVLKLGLLLLIFIVGIVGVAKKETRSAQISENWFNGASTKLGNYAVALIAGVWAYDGWDNVNYVTSEMKNFRRDLPRVIHTAMPVVIFCYLLVNLAYFMVLDKEEVRSTQTVAVLLAGRVMGRAGEIIVSLLIALSCLGALNATTFTAGRLAYASAQEGHLPKLFSRLSARNTPIYCILMECTLAAVFIFFGGFESLVMFYGVSSYLFYFVTVASVLVLRFREPELDRPYKTFLTTPIIFCSVALFLISYGFFEKPRQALLSLLFIGSGIPVYFLRHYGYMGVSEPRA

SEQ ID NO: 80658 - protein, 329 aa, Triticum aestivum
  misc_feature (123)..(123): Xaa can be any naturally occurring amino acid
  misc_feature (167)..(167): Xaa can be any naturally occurring amino acid
  misc_feature (179)..(179): Xaa can be any naturally occurring amino acid
  misc_feature (215)..(215): Xaa can be any naturally occurring amino acid
  misc_feature (237)..(237): Xaa can be any naturally occurring amino acid
  misc_feature (242)..(242): Xaa can be any naturally occurring amino acid
  misc_feature (269)..(269): Xaa can be any naturally occurring amino acid
  misc_feature (272)..(272): Xaa can be any naturally occurring amino acid
  misc_feature (281)..(282): Xaa can be any naturally occurring amino acid
  misc_feature (286)..(286): Xaa can be any naturally occurring amino acid
  misc_feature (294)..(294): Xaa can be any naturally occurring amino acid
  misc_feature (302)..(302): Xaa can be any naturally occurring amino acid
  misc_feature (304)..(304): Xaa can be any naturally occurring amino acid
  misc_feature (312)..(313): Xaa can be any naturally occurring amino acid
  misc_feature (317)..(318): Xaa can be any naturally occurring amino acid
  misc_feature (321)..(321): Xaa can be any naturally occurring amino acid
  misc_feature (328)..(328): Xaa can be any naturally occurring amino acid
MASPSVFAGIAQGPEDPILGVTVAYNKDPSPVKVNLGVGAYRTEEGKPLVLNVVKRAEQMLIHNESRVKEYLPITGLADFNKLSAKLIFGADSPAIQENRVATVQCLSGTGSLRVGGEFLGRXHYHERTIYIPQPTWGNHPKVFTLAGLTARSYRYYDPATRGLDFXGLLEDLSSAPSXGAIVLLHACAHNPTGVDPTLEQWEQIRQLMRSKALXPFFDSAYQGFASGSLDKDAQSXVRMFXVADGWVNCSWLKSYAKEHGLYGERVGXAFXILCGSADIXXRLKXTLACIKLXIQPPPSRXLXWVVPYFKXXLCSXXWPXLKGMADXI

SEQ ID NO: 80659 - protein, 159 aa, Cupriavidus necator
LQVPADTQEFAINASNSRFWEAPVQRYIAECMAGKSGPRGKDFNMRWIASMVAEAHRILMRGGVFMYPRDSKDPAKPGRLRLLYEANPIAFLMEQAGGRASTGRQTLMSVAPGALHQRIGVIFGSRNEVERIEGYHTDQTDPDLPSPLFNERSLFRASA

SEQ ID NO: 80660 - protein, 283 aa, Triticum aestivum
  misc_feature (180)..(180): Xaa can be any naturally occurring amino acid
  misc_feature (206)..(206): Xaa can be any naturally occurring amino acid
  misc_feature (224)..(224): Xaa can be any naturally occurring amino acid
MDYMNGPGRNHLFVPGPVNIPDQVIRAMSRQNEDYRSPAIPALTKTLLEDVKKIFKTTTGTPFLFPTTGTGAWESALTNTLSPGDRIVSFSLGQFSLLWIDQQQRLGFSVDVVESDWGYGADLGVLESKLRTDSQHTIKAICIVHNETATGVTNDLHAVRKLLDAYRHPGAAAWWNGVSXICALDFRMDEWGVDVALTGSQKALSXLPTGLGIVCPTPKALEAXRTAKSVRVFFHWKDYPRFLQYVHLLILHALNQSLYRLPAVSTSSRGWSRHVIIGITLGT

SEQ ID NO: 80661 - protein, 427 aa, Pyrobaculum aerophilum str. IM2
MAHISGVYINSAFLENTLYTIKRGIELSGLPVEFYEIITKPKRIHIVYIPVKMDSGRIEVFEGYRVQHNDALGPFKGGIRFHPEVTLADDVALAILMTLKNSLAGLPYGGAKGAVRVDPKRLSQRELEELSRGYARAIAPLIGDLVDIPAPDVGTNSQIMAWMVDEYSKIAGRNAPAVFTSKPPELWGNPVREYATGFGVAVVAREMAKRLWDGIEGKTVAVQGLGNVGRWTAYWLAKLGAKVVAVSDINGVAYKKEGLNVDIIANNRGLGGPALLEAFVSKDGAQYVKDPDAILAVDVDIFIPAAIENVIRSDNAGRVKARLVVEGANGPTTPEAERVLYQRGVVVVPDILANAGGVIMSYLEWVENLQWLSWDEEETRKRLEAIMVNNVARVYQRWQKEKWTMRDAAIVTALERIYKAMKLRGWI

SEQ ID NO: 80662 - protein, 310 aa, Malus x domestica
MSTGTLSSGYEMPVIGLGLWRLEKDELKEVILNAIKIGYRHFDCAAHYKSEADVGEALAEAFKTGLVKREELFITTKIWNSDHGHVVEACKNSLEKLQIDYLDLYLVHYPMPTKHNAIGKTASLLGEDKVLDIDVTISLQQTWEGMEKTVSLGLVRSIGLSNYELFLTRDCLAYSKIKPAVSQFETHPYFQRDSLVKFCMKHGVLPTAHTPLGGAAANKDMFGSVSPLDDPVLNDVAKKYGKSVAQICLRWGIQRKTAVIPKSSKIQRLKENLEVLEFQLSDEDMQLIYSIDRKYRTSLPSKTWGLDVYA

SEQ ID NO: 80663 - protein, 364 aa, Opitutaceae bacterium TAV2
MSYKLFIPGPIAVSDKTLRAMAQPMIGHRSNDFVALYNSIQPELQALFYTKDPVYLSTSSAWGVMEGAVRNVTRPARKVLNCMNGAFSDKWNDVSKRLGRAAGFIKSEWGQPVDPAAIRAELATGDYDAITFIHNETSCGCMSDIVAIMKVVREFPDVISICDTVSSFSALPIKKDELGIDIFITGSQKALALPPGLALISVSQRALDRAATINDRGYYFDLVEFQANHEKGMTPSTPTIALIYALKSKLDDIKAEGVENRYARHARLNQTVRDWAFAKGFKLFPKDGYGSVSLNCFANNLNYDIAAWNKILKTEHSLVIDGGYGRLKGKTFRISNMGDETDETIASLIKSLDAALAKTPKLAA

SEQ ID NO: 80664 - protein, 118 aa, Arabidopsis thaliana
MASKNMMKNAIALFLTINLVFLVFTKAQAPPPQAPVCPRDSTQFLSCTNVLNLSLILINNQSVLPCCTLVTGLDAATASACICNAVRITIFNFLTINVRVNQVLRLCRIIPPLGFRCP

SEQ ID NO: 80665 - protein, 536 aa, Lactobacillus reuteri
MEKMKFQKITLFSGVMLALNSLIGSGWLFGAGTAAKVAGPAAILSWILGAIIIISIALTYVELGAMFPESGGMSRYAQYSHGPFLGFIAAWANWISLITLVPMEAVASVQYMSSWPWAWANWTHHFMKNGNITTPGLLVVFGFMLIFTLINFWSVKLMTRFTNLISIFKILLPTLTIVMLIATGFHPSNFGHSVTTFIPYGSRSIFEAAAISGIIMSYDAFQTVINMGGEMINPHKNIVRGVLISMIITAVIYVMLQVAFIGAIDPNLLAQKGWHGINYTSPFADIAILLGMNWLAILLYMDAFVSPFGTGVAFVATASRALAAMTHTGHLPQWLGRLERRYMIPRLAMVVDLILAVVMVSLFRNWSLLATVITGSTLIAYLTGPVTVMSLRKMDANLKRPFHPHFMSWLAPFAFVLTSLSIYWTMWPTTVQVIGVILLGLPIYLYYEVKYRHASGLRDLRNSYWMLVYLVFISIVSYIGSEGFGGKDWLKYPWDFVVIIICSLGFYRWAVASRMKKVDPAAEKVNAKVKMPGKDQ

SEQ ID NO: 80666 - protein, 181 aa, Acer saccharum
VTGLLDPPELIKPPKILVIEGLHPMYDERVRDLLDFSIYLDISNEVKFAWKIQRDMAERGHSLESIKASIEARKPDFDAYIDPQKQYADTVIEVLPTELIPDDNEGKVLRVKLIMKEGVKHFSPVYLFDEGSTISWIPCGRKLTCSYPGIKFAYGPDTYFDHEVSVLEMDGQFDRLDELIY

SEQ ID NO: 80667 - protein, 362 aa, Microcystis aeruginosa PCC 7806
MLSKNTIFAILLIFVPLSIAGSLLHWGGTVVFITACLAIIPLAAYMGEATEAIAVVVGPNIGGLMNATFGNATELILAYVALREGFIDVVKATITGSIIGNLLLVMGLSMFLGGLRFKEQEFQPITARLNASAMNLAVVAILLPTAVQFTSTGVGEPVLQRLSVAVAAVLIFVYGLSLLFSMKTHTYLYDVGIAGIEEESAGENPAKPKIWFWSLILLIVTIAVAVESELLVASLEEATEQLGLTALFTGVILLPIIGNAAEHATAVTVALKNKMDLSVSVAVGSSMQIALFVAPVLVIMGYIIGQPMDLNFNPFELVAVAVAVWLANSISSDGRSNWLEGMLLLATYAILALAFFFHPLTA

SEQ ID NO: 80668 - protein, 166 aa, Haemophilus somnus 129PT
MASIEKQTGELQEKLIAVNRVSKTVKGGRIMSFTALTVVGDGNGRVGFGYGKAREVPAAIQKAMEKARRNMITVALNEGTLQHPIKGSHTGSRVFMQPASEGTGIIAGGAMRAVLEVAGVRNVLSKAYGSTNPINVVRATIDALANMKSPEMVAAKRGKTVDEILG

SEQ ID NO: 80669 - protein, 444 aa, Glycine max
  misc_feature (166)..(166): Xaa can be any naturally occurring amino acid
MVKKKVPDWLNSSLWSSSSPSSPPSSAVASPFEQPPPPPPRPPSPAVVTPSEPPPRPPSPPAVHDPLPTQRIDDSPREDHGEGFRSAHDVSRQAQLLAELSKKVVDMSELRSLACQGIPDASGIRSTAWKLLLGYLPPDRGLWSAELAKKRSQYKQFKEEIFMNPXSEITRKMFNSTNCDTGDANCARALLSRSEITHGEHPLSLGKTSVWNQFFQDTEIIDQIDRDVKRTHPDMHFFSGDSQFAKSNQEALKNILIIFAKLNPGVQYVQGMNEILAPLFYVLKNDPDEENAASAEADAFFCFVELLSGFRDNFVQQLDNSVVGIRSTITRLSQLLREHDEELWRHLEVTSKVNPQFYAFRWITLLLTQEFNFADSLHIWDTLLSDPDGPQETLLRVCCAMLVLVRKRLLAGDFTSNLKLLQNYPTTNISHLLYVANKFRVQSV

SEQ ID NO: 80670 - protein, 245 aa, Zea mays
MAESMGKDGGDGELKLLGLWASPFVARAKLALQIKGLSYEYVEEDLGNKSELLLSSNPVHKTVPVLIHNGTPVCESTVIVQYIDDAFAGTGPSLLPADPYQRALARFWAAYLEDKIVTPWRRVFMVKTDEEKAEAMRQTVAAMDALEGGLKECSSGGGGQSPFFGGDSVGYVDVLLGGMVSWVKASEPLSGAKIIDAARTPLLAAWMERFCELDAAKAVLQDVHEVVEYARTVQARVAAATASNQ

SEQ ID NO: 80671 - protein, 363 aa, Dichelobacter nodosus VCS1703A
MGFNCGIVGLPNVGKSTLFNALTQAGVDAQNYPFCTIDPNTGIVHVPDPRLQALANIVNPARIVPATMEFVDIAGLVAGASRGEGLGNQFLAHIRETDAIAQVVRCFEDHDVIHVAGAVNPINDIQVIESELILSDMMSLEKAEQRFTRIAKSGDKDAKLKLDIIKRLQAHLEAGQLARTLPLTAEERLAVKELFLLTMKPMMYVANVDEDCAPDNPHLVAVQEKAAETDAVVVTICAAIEAELAQLEPDEQLELLAEYGLAEPGLNRVIQAGYRLLDLGTYFTAGVQEVRAWTMPKCATAPQAAGVIHSDFERGFIRAEVIAYEDFITFGGEQGAKEAGKWRLEGKDYHVQEGDVIHFRFNV

SEQ ID NO: 80672 - protein, 232 aa, Zea mays
  misc_feature (210)..(210): Xaa can be any naturally occurring amino acid
MAQDLRSQDIKNPIDVAEYLFRRLQQVGVESVHGVPGDYNLVALDYIPKVGLKWVGNCNELNAGYAADGYARVKGISALVTTFGVGELSAVNAIAGAYSEYVPIVHIVGYPSTASQKNGALLHHTLGNGDFTVFSRMSKEISCAVSMLNSQHEAAMLIDNAIRECYLKSRPVYISLPSDMVTKKVDGDRLNTPLDLEYPQNDQEAEDYVXVDVVFEYLHAAKTLSSFVDACA

SEQ ID NO: 80673 - protein, 80 aa, Synechococcus sp. WH 8102
MSQEAILEKVRSIVAEQLSVDAGEVKPESNFQNDLGADSLDTVELVMALEEAFDIEIPDEAAEGITTVGDAVKYIEDKQA

SEQ ID NO: 80674 - protein, 155 aa, Campylobacter lari RM2100
MKRRVISVIVLNEHGVLSRVVGLFSGRGYNIESLTVAPLDDKEFSRINIVTLGDEKVFEQIIKQLHKLIPTYKVIDSSDFIEKETALVKIALNENFAGLDAILKAYNGSVTYSDDEFIVVMASDDAKNIDNFLKTMKKYNPISVVRSGSILMEVK

SEQ ID NO: 80675 - protein, 209 aa, Zea mays
MPGVRQLLPSSPPRLRTERAPRCRVPAFTFPSRLLSSPMAQRDKKVEEPTELRAPELTLCANSCGFPGNPATNNLCQACFLAATASSSASVSPPPPSSSSSPAVLQFDDQQQNPRPRAPAASGPTEEPPRPARASAPAPAPASSSSVRRCQTCRKRVGLTGFRCRCGDLFCGAHRYSDRHDCCFDYRAAGRDAIARDNPVVRAAKIVRF

SEQ ID NO: 80676 - protein, 130 aa, Prototheca wickerhamii
MSATTLEILEKLKAITLLEATELVSQIEKTFGVDASAPAVSGLRPILVEPIKQEDIIEEKTTFDVILEEVPSDKRVPILKVIRALTSLDLKQAKESITDLPKTILQGVSKEESEAAKQQLEAVGGKIKVS

SEQ ID NO: 80677 - protein, 569 aa, Campylobacter lari RM2100
MKELNGSQMICEALKEENVKVVFGYPGGAALNIYDEIYKQTHFKHILVRHEQAALHSADAYARMSGEVGVAVVTSGPGFTNTVTGLATAYSDSIPLVLISAQVANSLIGTDAFQEIDAIGISRPCVKHNYLVKNIEELPKILKEAFYIATTGRKGPVHIDIPKDITAAIGKWHYPKEISMKTYKPTYKGNIKQIKKLVSLIKNAQKPLFYLGGGCVASNASDELRELIHFCQIPAVETLMALGTLRSDDELNLKMAGMHGSYCANIALSECDLLIAVGARFDDRITGKTSEFAKGAKIVHIDIDPSSISKIIEAHFPIVGDIKSVILDTLEELKKESFDNTKYQEWFKTLQRYQQLYPLIYEDSDEVLKPQWVIEECARLAPDARIITDVGQHQMWVAQFYPFNYARQLATSGGQGTMGYSLPAALGAKLAVGEEVVVNFVGDGSFLMNIQELMTASAYKIKVINIILNNSFLGMVRQWQSMFYKERFSNTDLTSQPDFITIAKGFHCEGYNVCNKEEFQKAFKAALESKKTCVLNVAIDRYEDVLPMVPAGGAIYNMILPSYKNKDKK

SEQ ID NO: 80678 - protein, 70 aa, Zea mays
MSDWGPVVIGLVLFVLLSPGLLVQLPGRHHLVEFGNLKTSAVSILVHSIIYFALITLFVIVIGVHITTGD

SEQ ID NO: 80679 - protein, 384 aa, Pyrobaculum aerophilum str. IM2
MFKRFAQRRILTPGPTELPHGVKAALVRETTNPDLDPQFFQEYKQVIELLRPLLGAWQSRVYIWVGEAMLGLEAALANAVRPGTKVLVIDNGVYGSGFADLVKMYGGNPITPGLSWRRSADPSAIERILDKEKDVEVVTLVHCDTPSTVYNNLREIAKIVSSHGAYLIVDAVSSIAADEIRVDDWGVDVLIGGSQKALNAPPGLTILSISKRAWDRALEVARPSFYMNYQIWEEWLEKGGFPYTMSDVLIYALKESLQRIHNEGFESVFQRHKAARAAFRAGIEALGLEPYIERVDDTCPTATAFKTPLPSPELRRFIWEKYGVLFAGSWGPLEREIMRISHMGIQASADSIAASISILGAALRDLGFNVQVGKAVEVAIETFR

SEQ ID NO: 80680 - protein, 487 aa, Streptomyces avermitilis MA-4680
MSKDAVDTARVASRTDVTQSPADAGDAGYSKDLKARHVNMIAIGGAIGTGLFLGAGGRLHNAGPALAIAYLVCGVFAFFVVRALGELVLYRPSSGSFVSYAREFLGEKGAYVAGWMYFLNWSTTGIADITAIALYTHYWSLFTDIPQWVLALIALAVVLAVNLISVKIFGEMEFWFAIIKVATLVGFMLIGIFLLATHHEVGGHTPGLSAVTDHGGIFPHGMMPVVLVMQGVIFAYAALELVGVAAGETAEPEKVVPRAVNSIMWRVGLFYVGSVVLLALLLPGSVYSADQSPFVTVLSKIGIPAAGDVMNLVVLTAAMSSLNSGLYSTGRILRSMAMAGSAPKFTARMNRSQVPYGGILLTCAVCVLGVGLNYLMPTQAFEIVLNVASLGIISTWVIIMICHLVFVRRARAGLVTRPSFRLFGSPVTEIVTIAFLLAVLGLMWNDPEVGRKTLLLIPLVAVLLVGGWFAVRRRVSQAEDRELAQLK

SEQ ID NO: 80681 - protein, 433 aa, Kluyveromyces lactis NRRL Y-1140
MTLSKFNPEHIIKSIYSSPFNQYKNNMGLVLDVSYVTDNIIVCSYPVMKYPKMFYRNSLVDLVTYLDANHGRKNWKIYNLKAEMNDSDYTDDDFAMVLESKHVTPPAGKSEKITSTFRSRKMLEDHCNVSGIKLLFRSNADEIVKPPISVKSHLLRAGWIDHSPPSFLHLQNLIDDIRDTVSRGKVAVIHCKMGKGRSGTLVVAYLMTYLQLPRHEAQSLFLSTRFKTGISKGVTIASQLRYLKYQEMFLRYEAKQREEIIKNLSTIEFKILSIEFTNSIGQYSSEFLKKANNTTVSIKIQSHSSGKSGLIDLFSKQCSTGKGSLRSLTSKQIIVPNINVTFSDIRLSFGIRSKTSQFINNVSHLSSFSSCWLNLYWESVLQSKNLDNDSNYILPKNERFEFYIPWEELDGFKGTSGKGLKLFDSISIRWMLL

SEQ ID NO: 80682 - protein, 227 aa, Kluyveromyces lactis NRRL Y-1140
MSEFINENPDILDETLLPSRKEDITNELFGDALGKITHERKRQLLQIGSVDSPVLKNIGLLDKLLNQQLSLDETVPDLTDIETATESDENTEEEEEEDPIDAQEIYDLIAHISDPEHPLTLGQLAVVNLADIEVHDTNGKDKMAEVIVRITPTITHCSLATLIGLGIRVRLERSLSPRFRITILLKKGTHQSENQVNKQLNDKERVAAACENDQLLGVVSKMLSTCK

SEQ ID NO: 80683 - protein, 498 aa, Euthystachys abbreviata
  misc_feature (1)..(9): Xaa can be any naturally occurring amino acid
XXXXXXXXXSGVSTLEKKNLGRIVQIIGPVLDVAFPRGKMPKIYNALVVKGRDTVGQPINVTCEVQQLLGNNRVRAVAMSATDGLMRGMEVIDTGAPLSVPVGGATLGRIFNVLGEPVDNLGPVDTRTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEAAAKAMNLEMESNLKK

SEQ ID NO: 80684 - protein, 459 aa, Aspergillus nidulans FGSC A4
MSNLPVEPEFEQAYKELASTLENSTLFEQHPEYRRALQVVSVPERVIQFRVVWENDKGEVQINRGYRVQFNSALGPYKGGLRFHPSVNLSILKFLGFEQIFKNALTGLNMGGGKGGSDFDPKGKSDSEIRRFCTAFMTELCKHIGADTDVPAGDIGVTGREVGFLFGQYRRIRNQWEGVLTGKGGSWGGSLIRPEATGYGVVYYVEHMIKHVTGGKESFAGKRVAISGSGNVAQYAALKVIELGGSVVSLSDSKGSLIVKDESASFTPEEIALIADLKVARKQLSELATSSAFAGKFTYIPDARPWTNIPGKFEVALPSATQNEVSGEEAEHLIKSGVRYIAEGSNMGCTQAAIDIFEAHRNANPGDAIWYAPGKAANAGGVAVSGLEMAQNSARLSWTSEEVDARLKGIMEDCFKNGLETAQKFATPAKGVLPSLVTGSNIAGFTKVAEAMKDQGDWW

SEQ ID NO: 80685 - protein, 611 aa, Vitis vinifera
  misc_feature (546)..(546): Xaa can be any naturally occurring amino acid
MKRGFRDFSGAEGAERFEGASPAAEQNLTGEGHSQVWMQQLLHEAAGHVVTVELKSGELFRGSLIECEDNWNCQLENITFTVKDEEVQAHSDFYKTMLLTTVQKMVMCYVLKMLSLTTDEDVLIHENGAPISHGVSDRDGHDKSAGSGVDIVPESGKSQKEMPPLKIDEFGRLVKECASDSDSDDSCYAGKHGKSESCGDAAAQVLEIQSLRPILPVLVLKDSLTREPGIKVHHANIQASKVVAYGAAVQAAILSGEGNEKVQDLLLLDVIPLSLGSETAGGVMTVLIPRNTISEACYENARSIVAFINKFEDDKGFDKSNNSTVFPANSSKGFSNALKWVQEMKEIEEELNEKLSFLEGFAAAFGDQIHTHIEVKPGHNGPSLFAHITLLATRSEIFKNMLDSDGCKAAPSNTITLPELNHEELDSLLEFLYNGTMTAEQAYEAMNNAGHLDSDMIVILNDHRRVSSLTATLDGPIPPIGGPMHELATKVDEYARGMVSGSGSTLFEELGLYYIGPVDGHNIDDLIAILKEVKSTKTTGPVLIHXVIEKGRGYPYAERAADHQLQSRVPFAPQRPDFRDLEGCYGFYRTFPISNLTPEPDPVFHKPPFPK

SEQ ID NO: 80686 - protein, 182 aa, Pseudomonas fluorescens PfO-1
MVFDSFDIKSLIRPVIDFPKPGVIFRDITPLFQSPKALRLVMDSFAHRYVEADFTHIGAMDARGFLIGSVLAYQLNKPLVLFRKQGKLPADVLAEGYATEYGEAFLEVHADSLCEGDSVVMFDDLIATGGTLIAAANLIRRMGARVHEAAAIIDLPELGGSQRLEDMGIPTFCLTQFALTDK

SEQ ID NO: 80687 - protein, 411 aa, Nicotiana tabacum
MNALAATNRNFKLAARLLGLDSKLEKSLLIPFREIKVECTIPKDDGSLASFVGFRVQHDNARGPMKGGIRYHPEVDPDEVNALAQLMTWKTAVANIPYGGAKGGIGCSPSDLSNSELERLTRVFTQKIHDLIGIHTDVPAPDMGTNPQTMAWILDEYSKFHGYSPAVVTGKPIDLGGSLGRDAATGRGVLFVTEALVKEHGKSIAGQRFVIQGFGNVGSWAAKLINEQGGKIVAVSDITGAIKNENGLNIASLLKHVKENRGVKGFNDARPIDPHSILVEDCDVLIPAALGGVINRDNANDIKAKYIIEAANHPTDPEADEILAKKGVVILPDIYANSGGVTVSYFEWVQNIQGFMWDEDKVNAELKTYMTRGFKDVKDMCKTHNCDLRMGAFTLGVNRVARATVLRGWEA

SEQ ID NO: 80688 - protein, 1455 aa, Coprinopsis cinerea okayama7#130
MSVEAVARIAYLSSEVVVDSQLSGPSTSSFSETYRSLEKVAAHKPRVLPTPYGADPGSTLLRYPSDLTTFTAFASSPVVTRLLLHLAEISTRPVVLHLAVQDDLSDVLLLRSAVPFFILSQTPQEAHDNALLSARLARVEQKAVIHAFFSSSSNDHPPVDEIPEDKIFPFLLAKKHPSSPGSPVGHLNGINGINGVNGIANGHVNGHVNGQSAKDDPITTQLVKAYESAALDTLSLVRRPKRALSVRGASDPHTVLFLVGKGDFAPTIEGVSFVTLSLLNPLPASRLSNAIPDSATNVIVLEQVHKWTTKWTPLYLDLVSAIQSHKPDQSVRVYNGILGDLDNVSVPDVLKLIQRAPASGTERLQLGPISTSSPSATTPHIPKHEAAYTRILEHLFSDRLEIANSPALVATQGDIATTPEFALGRVRGQLDARNELVSAVQGLLQDSSLDNDLHSLLSKWVLAKDDGVKSRQLGDQIVAKLEATSPPNPLAQRVLALRQHLPAVSRWIVGSDAWSYDLGSSGLHHAIASKLNVNILILDTLPYTARNSGDPHRRKQDVGLYAMNHGDVYVASVAVFSSYAQVLQAIAEADRFEGPSVVLAYLPYHSEDSSAIDVLKETKLAVDAGYWPLYRWDPSKDAKGLEPFSLDSEAIKKDLQQFLDRQNHLSQLTRSTPAIAAEVVSSLGETIREARKKRAQQSYNDLVSALDAPPLLILYASDGGAAEKKAKRLANRAKARGLSTTITPLDSSSLEALKEEEYVVFVCSTAGQGEPPQNGRNFFKALNAASSRGESILPNLKYTVFGMGDSHYWPRPEDAHYYNKPGKELDARLEKLGAERVADIGLGDDQDADGSETGYKIWEPKLWKALGVDNIDVDEAEPEPITNEHIKAASGYLRGTIAEGLEDTTTGALAPSDTQLTKFHGIYQQDDRDIRDERQAQGVEPAYSFMIRVRMPGGVCTPKQWLQMDQISDEHANGTFKITTRATFQFHGVIKRHLKPAIQDINRVLLDTLAACGDVNRNVICSSIPTLSKLHRQVFEFSKELSDHLIPRTTAYHEIWLDKKLVAGDAVKDFEPIYGEFYLPRKFKIAVAVPPTNDVDVFANDLGFIAIVGDDGELQGFNVTIGGGMGVTHGNKKTYPRAGSLLGFCTPEQGKHVAEKVMIVQRDHGNRVDRKNARLKYTLDRLGLDRYRDEVEKHLGYKLQPVRPFTFDRNIDDFGWHTGEDGRHHFTMFIENGRILDEPGKDYKTGLREIAKIHKGNFRLTANQHVLVSDIADEDLPAIKAVLKKYNLDNLNYSGLRLASSACVAFPTCGLAMAESERYLPVLIDKVEKICEEAGLRHDEIVMRMTGCPNGCARPYLGEVAFVGKAPGSYLMLLGGGYYGQRLNKIYRESVTEPEILAILGPMIKRYALERHEGERFGDWTIRAGYISAVTEGKDWYEGMGGEGEWREVAAGASA

SEQ ID NO: 80689 - protein, 570 aa, Arabidopsis thaliana
MQSAMALSFSQTSFTRPNHVLGSSGSVFSTPRSLRFCGLRREAFGFSTSNQLAIRSNRIQFLSRKSFQVSASASSNGNGAPPKSFDYDLIIIGAGVGGHGAALHAVEKGLKTAIIEGDVVGGTCVNRGCVPSKALLAVSGRMRELQNEHHMKSFGLQVSAAGYDRQGVADHANNLATKIRNNLTNSMKAIGVDILTGFGSVLGPQKVKYGKDNIITAKDIIIATGSVPFVPKGIEVDGKTVITSDHALKLESVPEWIAIVGSGYIGLEFSDVYTALGSEVTFIEALDQLMPGFDPEISKLAQRVLINPRKIDYHTGVFASKITPARDGKPVLIELIDAKTKEPKDTLEVDAALIATGRAPFTNGLGLENVNVVTQRGFIPVDERMRVIDGKGTLVPNLYCIGDANGKLMLAHAASAQGISVVEQVSGRDHVLNHLSIPAACFTHPEISMVGLTEPQAKEKGEKEGFKVSVVKTSFKANTKALAENEGEGIAKMIYRPDNGEILGVHIFGLHAADLIHEASNAIALGTRIQDIKLAVHAHPTLSEVLDELFKAAKVESHATTRTVSEKVVV

SEQ ID NO: 80690 - protein, 212 aa, Haemophilus somnus 129PT
MNQSLLSQFGTSEERVKRAIEAFKRGNGVLVLDDEDRENEGDLIFPAETITVEQMAKLIRYGSGIVCLCITDELCQQLDLSPMVQNNTSINQTAFTVSIEAAQGVSTGVSAQDRVTTIQAAIADNAKPQDLSRPGHVFPLRAKKGGVLARRGHTEAAVDLASWAGHKPAGVICEITNDDGSMARTPEIVEFGKKFNYPVVTIEDLVRYASNK

SEQ ID NO: 80691 - protein, 650 aa, Oryza sativa
  misc_feature (114)..(114): Xaa can be any naturally occurring amino acid
CCCSLFSTMNPIPRKHGMKKAFLKSCSSQRCSKHGPDIRFPFRLSTHDPSCGMPGMQLSCSGHDTILDHPVLGSCKVTAIYYRYRVINAILLVESSSNCPLQKLASTNVSTAVXEPQKKDGATIVGCSKDSIATNQDGIVGPRSCLNLSSHGSQLWYLVPPRTYMSALPPDCTVVAKGIPIPYNYDRNGPNENQYLDISNLKEKANKVINFGETAFTWHLNKITNACQGCEWNGHHCGFSSQRGQAFCQHQDFVYSCSNKSCFVPFSFCFKKQILAHTLLILMEQTNFIYFYTATSSAATLVVLLLMVGTTIYLSLKTRYNEEIHLKVEMFLKTYGTSKPTRYSFSEVKKITRRFREKIGHGGYGNVYKGELPNGVPVAVKMLENSRGDGQEFINEVATIGRIHHANVLRLLGFCSEGTRRTLIYEFMPNDSLEKYIFSQGPNVSREFLVPDKMLDISLGIARGMEYLHQGCNQRILHFDIKPQNILLDYSFNPKISDFGLAKLCARDQSIVTLTAARGTMGYIAPELYSRNFGVISYKSDVYSFGMLVLEMVSGRRNLDPGIDNQHEVYFLEWIYEKVFTGQNLLIGTEMTQDEKYKVRKLAIVALWCIQWNPKNRPSTTQVVNMLTGRLQDLQMPPKPFVSSASESIP

SEQ ID NO: 80692 - protein, 584 aa, Vitis vinifera
MTCSESLICISVSDKRLSRKHLTLIASGNGSVDAVVEGTNPVVVASGNQRKKLRTGEKAVITNDDIIELIPGHYFFKYVTVAGEKSSIPSSHMNSEAIRHFSIPKDNLPLTYRLLRVKDLPAWANTSSVSIRDVIQGDVLIAVLSNYMVDIDWLLSSCPTLAKIPHVLVIHGEGDGTLDHMKKNKPPNWILHKPPLPISFGTHHSKAMLLVYPRGVRVIVHTANLIYVDWNNKSQGLWMQDFPWKVQKELSKGCAFENDLIDYLSVLKWPEFTANLPALGSFNINSSFFKKFDYSNAVVRLIASVPGYHTGSNLKKWGHMKLCSVLQECIFDKEFQKSPLAYQFSSLGSLDEKWMTELASSMSSGSCDDKTPLGLGKPLIIWPTVEDVRCSLEGYAAGNAIPSPQKNVEKEFLKKYWAKWKATHTGRCRAMPHIKTYTRYNGQNLAWFLLTSANLSKAAWGALQKNNSQLMIRSYELGVLFLPSPINRGQGFSCTDNGSPSKNKCGLSENTKSQRTKLVTLTWEGNRSSDSSSEVIPLPVPYELPPKQYSSEDVPWSWDRRYYKKDVCGQVWPRHVQLYSSPDS

SEQ ID NO: 80693 - protein, 88 aa, Physcomitrella patens
MSSDQDLDARAAAGETVVPGGTGGKSLEAQKNLAEGRSKGGQTRAEQLGHEGYTEMGKKGGSATNEMSGGEAAEAAGREIDESKFTNQ

SEQ ID NO: 80694 - protein, 489 aa, Synechococcus sp. WH 8102
MHSVASTPLIPVILCGGTGTRLWPLSRASYPKQYWPLSGEGDATLMQQTQQRLEGLNGLEAPLLICNEDHRFIVAEQMRQIGVEPNAILLEPMGRNTAPAVTVAALQATAGGQDPLLLVLAADHLIRDAKQFRQAVDAGRSAAEAGRLVTFGIVPTAPETGYGYIEAAEPFSGGSLREVPIARFVEKPDRATAEQFLATGRFTWNSGMFLFRASAMLAELERLAPEVVSCCRAALEQDAADLDFLRLEREAFAKCPNVAIDVAVMEKTELGSVLPLDAGWSDVGSWSALWETADRDVDGNVLQGRVINKGSRNCYLRSEHRLVVGLGVENLVVVETDDAVLIADRSKAQEIKSVVKQLEADGSPEGKAHRKIYRPWGAYTGVTEGNRWQVKRISVNPGSSLSLQMHHHRAEHWVVVKGTALVERDGDQQLVGENQSTYIPMGCKHRLSNPGRIPVELIEVQSGEYLGEDDIVRFEDRYGRSDQRIPVQS

SEQ ID NO: 80695 - protein, 514 aa, Oryza sativa
MSSNLAASRRSSSSSSVAAAAAAKRPAVGEGGGGGGGKAAAGAAAAKKRVALSNISNVAAAAGGGGGGGPPGKAGNAKLNLAASAAPVKKGSLASGRNVGTNRASAVKSASAKPAPAISRHESATQKESVLPPKVPSIVPTAALAPVTVPCSSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEVTAPTAKCFLRRFVRVAQVSDEDPALHLEFLANYVAELSLLEYNLLSYPPSLVAASAIFLAKFILQPTKHPWNSTLAHYTQYKSSELSDCVKALHRLFSVGPGSNLPAIREKYTQHKYKFVAKKPCPPSIPTEFFRDATC

SEQ ID NO: 80696 - protein, 131 aa, Physcomitrella patens subsp. patens
SSSQYHVLTVDDSRIDQRVVEKLLMTSSFKVTTVNSALRALELLGLSDSCPSSVKPDINLIMTDYCMPEMTGYDLLKRVKADTSALKEIPVVVMSSENDSIRIERCLAEGAEEFIIKPVQMADVKRLRGHL

SEQ ID NO: 80697 - protein, 631 aa, Dichelobacter nodosus VCS1703A
MISLENVTLARGAKILLRAANLNIHHGQRVGLVGRNGCGKSSLFALLRGELEADQGQVSLPESEWIASVRQETPALAQSALDYVLDGHQRFRAAEQEALRAQQSGQGLAIAHAHELLQQVDAYRLPARAAELLTGLGFAPAQHQLPVAHFSGGWRMRLNLAQALIAPADLLLLDEPTNHLDLDAIVWLQDFLLTYPTTLFIISHDRDFLDALCQHIVHIEGEQLISYRGNYSQFVQTRHEQRLQQDALYAKQAEKRVHLQQFIDRFRAKATKARQAQSRLKALEKLTLTPPSSIEENYALEFPPAEHYPSPVLRLKQAVMGYETPLLKPFTLAINADARIGLLGHNGAGKSTLMKTLAGVLPLLQGERSAHQKAQIGYFAQHQLDRLVSEQTPLWHFQQQQPEASEQELRNFLGAYGFAGEAVQMPVQLCSGGEKARLALALLIATRPNLLLLDEPTNHLDLSMRDNLIRALQTYQGALVLVSHDRSLLRATCDQFYLVDEGVCRVFDGDLDDYRDYLRQKRSEQSSEKTAKINDRQQQKRQEAERRQYLRPYQQSIEKAEKKLDNVHHKQKDLEQALADMSLYTEAEKPRLNALLAEKADADRALLVAEAELMDALEALEAAEKAYKSQY

SEQ ID NO: 80698 - protein, 472 aa, Desulfovibrio vulgaris subsp. vulgaris str. Hildenborough
MNAQSPACHAIILAGGSGTRLWPISRSLFPKQLIALNGDLTLLQETLKRALTHFRPDHIHVVTNEEHVFEVRAQARTLDPRLEAGVIAEPRGRNTLPAILLGLDAAWRATGGETPPTIAVFPSDHMLGDIPRWQAALDEATRLADDGWFVTFGVPPTHPETGYGYIRRGDSIADRSFEVEGFVEKPDHATATAYLKDGRYFWNSGMFVFNGQSLIEAVHAHQSDLGHWWESRGDRPLIEGYTSIPSISVDYGIMEHASRIAVVEADFGWDDLGSWEALYRLGKKDESGCVRRGDTMALDCENSMLFSRGGKLVGIGLKDIVAVQTRDATLVCALDKTQRVKDVVELLKAESSSLAEVHLTVHRPWGSYTVLEEGKLFKIKRITVLPGARLSLQMHHHRSEHWVVVSGAALVQVGETETLLTENQWAVIPRGAMHRLSNPGKIPLELIEVQSGPYLEEDDIVRFEDVYGRKPK

SEQ ID NO: 80699 - protein, 735 aa, Streptomyces avermitilis MA-4680
MSTEPTTIRWEQDETGIVTLVLDDPNQSANTMNQAFRASIAAIADRAEAEKDSIRGIIYTSAKKTFFAGGDLKDMMKAGPSDAQRAFETGTAIKNSLRRIETLGKPVVAAINGAALGGGYEIALASHHRIALDAPGSKIGLPEVTLGLLPAGGGVTRTVRLMGIADALLKVLLQGTQYAPARALENGLVHEVAATHEEMLAGARAFIDANPESQQPWDKPGYRIPGGTPANPKFAANLPAFPANLKKQLNGAPYPAPRNILAAAVEGSQVDFETALVIEARYFTELVTGQTAKNMIQAFFFDLQAVNSGANRPQGVAPRQVRKVAVLGAGMMGAGIAYSCARAGIEVVLKDVSAEAAAKGRGYSEKLCAKAVSRGRTTQEKADALLARITPTADPADLAGCDAVIEAVFEDTALKHKVFEEIEHIVEPDALLCSNTSTLPITALAEGVERQADFIGLHFFSPVDKMPLVEIIKGERTGDEALARAFDLVRQINKTPIVVNDSRGFFTSRVIGHFINEGVAMVGEGIEPASIEQAAAQAGYPAKVLSLMDELTLTLPRKIRAESKRAVEEAGGTWVTHPAEAVIDRMVDEFGRTGRGGGAGFYDYVDGKRAKLWPGLREHFTKPGHEIPFEDMQERMLFAEALDTVRLLEEGVLTSVADANIGSIFGIGFPGWTGGVLQYINGYAGGPGAGAGAGAGLPGFVARARELAERYGERFTPPALLVEKAEKGEHFSDAK

SEQ ID NO: 80700 - protein, 167 aa, Amorphophallus albus
GTADAVRQFIWVFEDPRNKNIEHVLILSGDQLYRMDYMDLVQRHMDTRADITVSCVPVDDSRASDFGLMKIDKVGRIVHFSEKPKGSVLDAMKVDTTIPGLSPYEAKNFPYIASMGVYAFRTEILLNLLRWRYPTSNDFGSEIIPSAVNEYNVQAYLFKDYWEDIGT

SEQ ID NO: 80701 - protein, 430 aa, Candida glabrata CBS 138
MPTINRSTDYTIRGPMGNLHLNPKKFVRTLYAIPFNVENSSSESSLDISYITPNLLVCSYPVTKYPKLLYRNGLDEIVEYLNKHHGKGTWKIFNFKVEKNGSDYDDIDIKNADDKTLYFPNYQRPSSTSCRGQRTTTLNGINSLICRKGWLDHCPPPFLLLQEIIDDMNLHISQSESNVAILHCRMGKGRSGTISIAYMMKYMNCPFEEAKELFMEKRFRMGLSKGVTINSQIRYIRYHELSLYYGINCNSMIVDQIKMSRFQLESITLQAMSGILFSHPYYTAVKISKYNNNRDGLIDLISVQTPEQVSTTKALYFKNSKNITIDINVPVEVSDIKIEFSLVARSHAMSHRITTLASNSNCWLNLYWETVRCSKTNSTNNFLLNELRHEQNNGLKFIFIIRWNELDGTSGTRSKGLRLFSSCILKWSLL

SEQ ID NO: 80702 - protein, 262 aa, Mycobacterium avium 104
MPVLGLGVAELSDDETERAVSAALEVGCRLIDTAAAYGNEAAVGRAIAASGIPRAELFVTTKLATSDQGFKGAMDACEASLERLGLDYVDLYLIHWPAPALGTYVNSFGGMIQSRGNGHARSIGVSNFTEEYLTTVIDLTFVTPAVNQIELHPLLNQEALRKTNAEHNVVTQSYTPLALGKLNDHPTVNSVAAEYGKTASQVLLRWNLQLGNAVIFRSANAEHIASDFDVFDFELAAEHMDAINALNDGTRLRPDPDTYEGS

SEQ ID NO: 80703 - protein, 165 aa, Amorphophallus albus
GTADAVRQYLWLFEEHNVMEFLVLAGDHLYRMDYERFIQAHRETDADITVAALPMDEKRATAFGLMKIDEEGRIIEFAEKPKGEQLKAMKVDTTILGLDDERAREMPYIASMGIYVVSKDIMLELLREKFPGANDFGSEVMPGATSIGMRVQAYLYDGYWEDIGT

SEQ ID NO: 80704 - protein, 113 aa, Olea europaea
LSKKPKEQIVDIDAADVNNDLAAVEYVEEIYKYNKSVENESRVNYYIDSRPEINEKMRAILIDWLIQVHHKFELSPETLYLTINIVDRYLATKTTLRKELQLLGISAMLIASK

SEQ ID NO: 80705 - protein, 383 aa, Coprinopsis cinerea okayama7#130
MSRVRGGHSPARSPSRPHRRRSTRGRSNGDENGNGDGSNDNNKSSSPVPSPGSWNVDRGRSRVRRPSNPFSEDNLRRREEVEAGEGDGFWCLWGGNVLFLLPWVHTKPAPIPSPSSSAADEISGETVAIKMVTRVFEKIQLAKRALREITLLRHFANHENITGLIDVDAVSPDFNEIYIFMEVRRTVLQGWEDSKGADLHQIIKSGQVLTNEHVQYFLYQILRGTMITRMKFIHSAGVIHRDLKPGNLLVNADCELKICDFGLSRGFDAVPDENATRLTEYVATRWYRAPEIMLAFPRYNTAIDVWSIGCILGELLLGKPLFKGKELAGRDYHPKDWERQGQGDLTLTVDCWFTDMVRLKPMSVLYRLGELFHSDAFYLARTR

SEQ ID NO: 80706 - protein, 458 aa, Glycine max
FFLRHAGAGAGSLPPVPAVPGLPVIGNLLQLKEKKPYKTFTQMAHKHGPIYSIRTGASTLIVLNSPLLAKEAMVTRFSSISTRKLSNALKILTSDKCMVATSDYNEFHKTVKRHILTNFLGANAQKRHHIHREAMMENILSQFSEHVKTFSDLAVNFRKIFVTQLFGLALKQALGSNVETIYVEELGSTLSKEDIYKILVVDIMEGAIEVDWRDFFPYLKWIPNRRLEMKIQNLYVRRKAVMKALMNEQKNRMASGKEVNCYFDYLVSEAKELTEDQISMLIWETIIETSDTTLVTTEWAMYELAKDKTRQDRLYEELQYVCGHENVIEDQLSKLPYLGAVFHETLRKHSPAPIVPLRYAHEDTKLGGYHIPAGSEIAINIYGCNMDNNLWENPNEWMPERFLDEKYDHMDLYKTMAFGAGKRVCAGSLQAMLIACTAIGRLVQQFEWELGQGEEENE

SEQ ID NO: 80707 - protein, 540 aa, Parvularcula bermudensis HTCC2503
MIQSGFAALADRLSAVTRTRPSDLDSGQIRIELLSGLTVALALVPEAVAFAFVAGVHPLVGLYAAFMVGLITAIFGGRPGMISGATGALAVVMVSLVAEHGVEYLFATVILMGVLQIVVGALRWGKFIRLVPHPVMLGFVNGLAIVIFMAQLGQFQVPGTAEASGHGMSGGEWLSGLPLAIMLGLVGLTMVIIWGLPKLTTVIPAPLAGIGITAILVILVGIETPRVGDLASIEGGLPSFHIPAVPFTWETLEIILPYAVVLGLIGLIESLLTLNLVGEITQQRGGASKECVAQGMANTATGLFGGMGGCAMIGQSMINVRSGGRMRLSGIAAALFLLSFILFAAPLIEQIPLAALVGVMFMVVIGTFAWHSFRILPKIPRTDALVVVLVTVVTVWQDLAVAVVVGVIVSALAYAWNNARRMHANIVDQPTGRVYKLEGPLFFGSADGFRDLFTPQDDPENVVIDFARSRVVDGSALQAIEDVAAKYEAAGKHLQLRHLSHDCHQLLRKAEQLIVDADDDPEYGIAVDYSVRTGAMGGGH

SEQ ID NO: 80708 - protein, 185 aa, Zea mays
MQNPSGHHPATAAPTSAPSKGKSSAPNPSGNHAATPAPSGTPSKGKSAAAQAAALGHGSSSHHHSAGGGGGGADASATTLKRKRGVFQKDLQHMMYGFGDDPNPLPETVALVEDIVVEYVTDLVHKAQNVASKRGKLLTEDFLYLIRKDLRKLHRATELLSMNEELKQARKAFDVDEETLATTNI

SEQ ID NO: 80709 - protein, 221 aa, Dunaliella tertiolecta
MFRNSAVSALRLGAIAFRRVDPTKVPNAMCRAYTQQNTGNSSSSAGKWAWTAGILGAGLLSSNHAFAAGPSTKERSFIAIKPDGVHRGMISNIISRFEQKGYKLVGIKVIVPGMDLAKAHYAEHEGKPFFNKLTSFLTSGPVVAMVWEGKEVIKYGRTMIGATNPLASAPGTIRGDFCVDMGRNMIHGSDGPESAQREIALWFQPSEIAEYESATQSWVYE

SEQ ID NO: 80710 - protein, 361 aa, Oceanicola granulosus HTCC2516
MGIVGLPNVGKSTLFNALTRTAAAQAANFPFCTIEPNVGEVAVPDARLDRLAAIAQSKQIIPTRMTFVDIAGLVKGASKGEGLGNQFLANIREVDAIAHVLRCFEDGDVTHVEGRVDPVADAQTIETELMLADLESIERRLQNIVRKVRGGDKEAVQQERLLKAAQAVLEDGRPARVVEVDDEDQKAWKMLQLLSTKPVLYVCNVEEEAAGTGNALSAEVAEMAAAQGNSSVVISAKIEEEISQLEAEEAEMFLSEMGLEEPGLDRLIRAGYELLHLQTYFTVGPKEARAWTIREGTAAPQAAGVIHGDFEKGFIRAETIAYDDFVALGGEQPAKEAGKMRAEGKGYVVKDGDVLHFLFNT

SEQ ID NO: 80711 - protein, 632 aa, Candidatus Kuenenia stuttgartiensis
MKVVILAGGKGTRMGSLSQNIPKPMINIANKPILQYQIEIAKRFNLTDIILLTGYKGEVVEDYFGNGENWGVNISCYRETIPLGTAGAVKEVEDYLHDDFLVFYGDVIMDIDLKSVIRYHMKRKPIATLVVHPNDHPYDSDLIEVNNEGKVITFHSKPHKQDIFIRNLVNAALYILSPRIMNFLPKGTYSDFGKDIFPKLVNDGEIIYAYNTPEYIKDIGTLERLEEVERDIVSGKLYRLNKKNKRKAIFLDRDGVLNYEIDLLRTPEELELLPDVPNAIKKINTSEYLSVVVTNQPVVAKGLASEKDIYQIHSKLDTVLGRNRAFLDRIYYCPHHPEKGFHGERIEYKIHCDCRKPNTGMINQAVYDLNIDLDESFIIGDRTVDILTGINAGLKTILVRTGYAGDDGVFQCEPDFIFSNLKESTEFIIDCYDALVNKAKDILSGISINNKRNIIILIAGLSRSGKSTFSKIISTILNKKGIHNTHLNLDNWLVGIQERKDWMAVSERYKYNEIVKDIATLLEGKEIKVNKYNVKTRNIDEHQKSIILKEGEALIIDGVVGLDIEFLRKIADIKIYVEINETMRRKRFFDFYMFKGLTEEEIKKLYVKRQDDEIPIVIQTKNYADYIIPMEK

SEQ ID NO: 80712 - protein, 840 aa, Oryza sativa
MTSTTDHGDKAYSNVITSTCTPGPSPVSTPGAMSALPLPMAGGQHHHPPSMPSNSISIAGASQDQHTPGSYGPSSMNASSDMGSVMTEDEEDLEDYGKGGYHPVHVGDTFSDGRYLIVRKLGWGHFSTVWLAKDNKMKRHVALKVVKSAPHYTETALDEIKLLQRLVSANPSHPGRRHCVSLLDHFRHKGPNGSHVCMVFEVLGENLLGLIKRYQHRGVPPHIVKQIAKQVLLGLDYMHQECGIIHTDLKPENVLICIDDVEAVVEAELRSNPAAVPTKLVGVPPSRGRGGTQTPKRDGIFITGSQPLPSPSSSLGSSPMFDKWAFGMSKIDKPSVSDSENGFRSGASSEAAGSKGGSLVTSKEREGSTDVIGHGISQLSTQASSSLPGDSFGSRTTTGVPQQKGPSLLSLGAPRVPQAPAPAAPSSAAPLAEAAAEPTDSPSPMSMDSPSPTDRQEPTPMDQEMHPPAPAAGDPTTLPPPPPYDPSSLERITVKIADLGNACWVDHHFTNDIQTRQYRCPEVILGAKWGPSADMWSASCMFFELLTGDYLFDPAAGTKYNKDDDHVAQIIELLGDFPKSLAFAGKYSADIFNRRGELRHIHKLRFWPLISVLQEKYLMPYNEANELSSFLMPMLRLHPEKRSGARELLDHSWIEGIVVQGEIEQAMRQAGIDVDALTAGSPSGLSLPPGLTPSEADALKPVGSVSSSPAPLALNMQGLEDAKRRAAQHQADAAAAAAAASQNGASQTTNTSNAASAAMPHSRDPVHALQAEALERSSSSDGAGESHMTIKGLGSEDASASRSVSTPKLTGQAQAGSSSNREAGSPSPQGLPRPVATTVQ

SEQ ID NO: 80713 - protein, 458 aa, Synechococcus sp. WH 8102
MLLPALLSEISSHDFEVAETLIGVLRFVLIFVAARSLAELLVRFELPTILGELLAGVIIGASGLHLLVPPETQVQLSGVFSNVVGGIAHIPPDEIPEIYNESFGALQAVSNLGLFSLLFLTGLESELEELIAVGAQAFSVAVVGVVLPFALGTLGLMGIFHVDPVQAIFAGASMTATSIGITASVFGELGYLRTREGQIVIGAAVLDDILGIVILAVVVSLAAGGTLEIAPIVQLVVAAVLFVVVALVLSQKAAPAFDWVVDQLKAPGGKLIGSYLLLGASCFIATAIGLEAALGAFAAGLIASTSKHRHEIQAAVTPIVGLFATVFFVLVGAGMDLSVINPSDPSARSALVIAGFMFLVAIVGKVVAGWAVFGPQKTNKLVVGLGMLPRGEVGLIFLGLGTAAKLLSPGLEIAILLMVIGTTFLAPVLLRLVLKDKPPEDGNEVPEEFAADPLAGAS

SEQ ID NO: 80714 - protein, 251 aa, Oceanicola granulosus HTCC2516
MYLDRFRLDGKIALITGGNRGIGLATARAMAEAGARCMLSARSETDDSRALVAEGHAFTAGDITDPATPDALVAATLEEFGRLDILVNNAGVADGGAFHDFDDDRLARIMDTNLIAPFRVARAAVRPMLAQGAGSIVNIGSISGFVANKPQLQVAYNSSKAAIHQMTTVMAFEYAGRGIRVNALAPGYIRTRMAEGGMDHPEMSKVWADNTPMGRFGTPEEMASCALFLASDAASYVTGATLVADGGYITH

SEQ ID NO: 80715 - protein, 321 aa, Oceanicola granulosus HTCC2516
MPLAPDSLGPTVAVGEILVEIVATTVGTGFTAPQPLMGPYPSGAPAIFIDQCGRIGGAAAMVGAVGDDDFGRMTLQRLRADGVDVSAVATVPDWPTGSAFVRYRDDGSRDFVFNIATSAAARFGWSDAAAQLMARAGHLHVMGSALSMPAAVEVIARAVDIVAARGGTLSLDPNLRKELALDAATEARFADLVTRADLLLPSGEELELAAGVRGEAAAVAALFARGVGEIVLKRGANGATAFLPDGSRVEAPAFAVTELDPTGAGDCFGGAYVACRRLGMPLETALAYASAAGARNVTVRGPMEGAGTRAQFDDFIRETQP

SEQ ID NO: 80716 - protein, 480 aa, Dichelobacter nodosus VCS1703A
MNADIAVIGLAVMGQNLILNMSDHGFKVVAYNRSRDKTERFLADVKENPNITGAYSLEDLVKQLKRPRKVMLMVRAGAAVDETIEALLPLLTAGDVIIDGGNSNYADTQRRVEKLSAQGILFIGTGVSGGEEGARRGPSIMPGGAEKAWSEVQPILQAIAAKSADGTPCCDWVGSGGAGHFVKMVHNGIEYADMQLIAECYDFMKHLLGLTNAQMGDVFKRWNQSQLKSYLIEITGNILLYRGEDGCDLIDDIYDRAGQKGTGKWTGISALEAGVPLTLITEAVFARNLSALKEDRVTAASIYPHQYSRLDNADLWLSDLAQALLAAKVVSYAQGFMLMQSASALNHWQINLGHVALLWREGCIIRSAFLDKIHAAFAKQPDLVFLGLDDYFKEILHTALPAWRKVVAMAISQGLPVPCLSAGLTFLDGYTRESLPANLLQAQRDYFGAHGYERVSKRGQTFHTDWTKMGGNAVSGNYDA

SEQ ID NO: 80717 - protein, 2101 aa, unidentified eubacterium SCB49
MKKIITILLVIIGVGTSHAQVGIGTPLPNASAQLDIVSNDRGLLIPRVSLSNSVDLTSITNGNVLSLLVFNLATVADVTPGYHYWDGSKWQRVTNEDDVINLIDVNETLTVISQDVSAGTISYLDEDGSTTVLDVAAMIAANETLTSVSFDSLTGIFTYNDEDGVATTLDLSAMISNFETLTFISQDVAAGTITYIDEDGVSTVLDVAALIAQHETLTSSSFDPATGVFTYTDENGVATDLDLSAMISNFETLTFISQDVAAGTITYIDEDGVSTVLDVAALIAQHETLTSSSFDPATGVFTYTDENGVATDLNLSAMISNFETLTFISLDVAAGTITYIDEDGVSTVLDVAALIAQHETLTSSSFDPATGVFTYTDENGVATDLDLSLMVSNFETLTFISQDVTAGTITYIDEDGVSTVLDVAALIAQHETLTSSSFDPATGVFTYTDENGVATDLNLSAMISNFETLTFISQDVAAGTITYIDEDGVSTVLDVAALIAQHETLTSSSFDPATGVFTYTDENGVATTLDLSAMISNFETLTFISQDVTAGTITYIDEDGVSTVLDVAALIAQHETLTSSSFDPATGVFTYTDENGVATDLNLSAMISNFETLTFISQDVAAGTITYIDEDGVATVLDVAALIAQHETLTSSSFDPATGVFTYTDENGVATDLNLSAMISNFETLTFISQDVAAGTITYIDEDGVATVLDVAALIAQHETLTSSSFDPATGVFTYTDENGVATDLNLSAMISNFETLTYFSLDINAGTITYIDEDGVATVLDIAALVAQYESLTTLVDNGDGTITYTDENNVQTIINMAAGPAGADGASAYQVWLDAGNTGSVQDFLDSLVGADGATGASAYQEWLDAGNTGSVQDFLDSLVGATGATGQDGATGPQGPTGAAGATGPQGTTGADGATGATGTAGQDGATGPQGPTGATGQDGATGPQGPTGATGQDGATGPQGPIGATGAAGQDGATGATGAAGQDGATGPQGPTGATGQDGATGPQGPTGATGQAGAAGPQGPTGPQGPTGANGADGATGAAGQDGATGPQGPTGAAGQDGATGPQGPTGATGQDGATGPQGPTGATGQAGAAGPQGPTGPQGPTGANGADGATGAAGQDGATGPQGPTGAAGQDGATGPQGPTGATGQDGATGPQGPTGATGQDGATGPQGPIGATGAAGQDGATGATGAAGQDGATGPQGPTGATGQDGATGPIGPQGPTGADGATGTAGQDGATGPQGPTGANGADGATGAAGQDGATGPQGPTGAAGQDGATGPQGPTGATGQDGATGPQGPTGATGQDGATGPQGPIGATGAAGQDGATGATGAAGQDGATGPQGPTGATGQDGATGPIGPQGPTGADGATGTAGQDGATGPQGPTGAAGQDGAAGAAGPQGPTGPQGPTGANGVDGATGAAGQDGATGATGTAGQDGATGPQGPTGATGQDGATGPQGPIGATGAAGQDGAAGPQGPTGATGPQGPAGDSATNINTTLSLVDGELVYENEDSNNANVNLISGDDNNAIVSDANGALFVDVQEPWNIQDGTVGATGNTQDIYQAGKVAVGFTDADGVSDKQFEVKGDYVAESTYTDNGTNTYTGMYTQEDYSIMFASDQSYKDPSASIFGGDYYSVFFAQPKAVFALANAPDAISEMVIGPGSATVSPQVRLQSRYGLTGDPAASKEVGLYGTEESLNIFIKNAGTTQKMIRLTPDNGIQFDHGDKETYNFPENRGAVNQVLTTDGATGNDIAQLSWKDISELTEGDATDDAWIDDTANSMIKLGSKSDGDPREADFVVLDEKGYVGIGTDSPAELLDIRGTAATNGDADFDMTSFGDVNSTTLHMRRAAGTAADPAAQRAVSNLTDALPTTVAIEGQGFDGANYQTGARITLALDDPSTNSGPGDMPGEISLLTTPDGTSTPETRMNIKSDGKIGVNTVEPTNQLHVKAEPTEDPVRLEGLQTSSDNADKVVVADANGVLKTVANNAPNFFYMPAVIFDTSTTGTGLTRDLYDDYNKQFSGIAFNVAHGANGASVNYTGGLVGNTSAPTTISTYANTALNYYVSYYDQAVFANVSISDTGVLTYDIISNATSSSFMNIIFVIK

SEQ ID NO: 80718 - protein, 451 aa, Zea mays
TRPLSSSSIVKPPPSFHKPSQKGHTGKDAAFSRLLLGSTLLLLSPPRLRSARHQIARQRSQRRRSFRCASLGSCCRPPAIWRGPFGRQVEVGRGDRFLAAGGMDSHAAVSSSVGSGDGAAQPRRNSRKPKYSKFTQQELPACKPILTPKWVISVFVLVGVIFVPIGIVSLRASHQVVEIVDRYDDACIPANVTEKLAYIQNDSIPKTCTRNLTITKDMKQPIFVYYQLDNFYQNHRRYVKSRNDAQLRDKSKASDTTNCDPEAKTVDGKPIVPCGLIAWSLFNDTYTLIHNNKTLRVDKKDISWKSDRDHKFGSDVFPTNFQKGPLQGGKILNPKIPLSEQEDLIVWMRTAALPTFRKLYGRIHVDLKENDTITVQLENNYNTYSFSGKKKLVLSTATWIGGKNDFLGLAYLTVGGICFVLAFAFTLLYLIKPRKMGDNNYLSWNRPTLGR

SEQ ID NO: 80719 - protein, 123 aa, unidentified eubacterium SCB49
MADLKDFAEQLVNLTVKEVNELATILKDEYGIEPAAAAVAVAAGGGAGEAAEEQSEFDVILTAAGGSKLAVVKLVKELTGAGLKDAKDLVDNAPSPIKEGVSKDEAEALKAQLEEAGAEVELK

SEQ ID NO: 80720 - protein, 181 aa, Triticum aestivum
  misc_feature (32)..(32): Xaa can be any naturally occurring amino acid
  misc_feature (58)..(58): Xaa can be any naturally occurring amino acid
  misc_feature (132)..(132): Xaa can be any naturally occurring amino acid
MGVLPWSCRCGLNPTPSKNKGRARASSSPSSXRAMPMRVLTVGKKRSQGTQLLVEEHXGEKLGHYCDVEDTLIKSNPKLTSDVKVQIEAEDASMMQQLKAEDFVVVLDENGERVSCPSRLADLIGDAGNTGXSSRLNILVIGGPYGLGIQVRERADATIRLSSLVLNHQVALIVLMEQLYR

SEQ ID NO: 80721 - protein, 237 aa, Opitutaceae bacterium TAV2
MISYEQFVSQADQVKAQIAAACARAGRHASEVELLAVTKTHPVEAVEYAARYGLRSVGENRVQEGVEKRAHSTAPVRWELIGHLQSNKARLAAAHFERIQSVDSEKLLVQLDRVAEALGRTLAVLLQVNAGRDEAKFGVELEAAPRLLDVALTMPHLRIDGLMTIAPLSEDPDVARRTFDTLRGLRDSLVARSGMPLRELSMGMSGDLEAAIAAGSTCVRVGTALFGARPPMGPAHG

SEQ ID NO: 80722 - protein, 134 aa, Nicotiana tabacum
PAFDVTVRAENPNNKIGIYYRKGSSVTVLYSDVNLSNGEFPAFYQPTNNVTVFKTPLKGSNVLLGSAVRTALRNEQKQGKVPFRVDIKAPVKIKVGAVKTWEITVKVKCDITVDTLTEKSKIVSKHCKYSVRLW

SEQ ID NO: 80723 - protein, 440 aa, Kluyveromyces lactis NRRL Y-1140
MTVKKRTGNTSRGGSATSTPQKQHRETTSRTRLVEDYKKHSKVEVKKDSKLYNFAVRTIWTFVMIAGFFIILASGHFWCVVLILGCQIATFKECIAVTGQSGREKNLPLTKTLNWYFLFTTIYYLDGKSLFKFFNDTFVKYTVLNFVASNHKFISYCLYVLGFVIFVCSLRKGYLKFQFASLCVTHMVLLLVVFQAHLIINNVLNGLIWFLLPCGLVIVNDIFAYLCGITFGRTKLIEISPKKTLEGFLGAWFFTAIASVLLTRLLAPYYYMTCPVTDLKTNFFTALSCELNPVFVPQDYRLPPIIFEKIGVDVITIKPVYLHALNLATFASLFAPFGGFFASGLKRTFQVKDFGDSIPGHGGITDRVDCQFLMGSFMNLYYETFISENRITVGTVVSTILMNLDTNQIIELIHTLNKALYDNGVMNKDVYEKITDLYNI

SEQ ID NO: 80724 - protein, 121 aa, Coprinopsis cinerea okayama7#130
MSAQQSQGIQTLLEAEKEAAKIVQQARQYRVQRLKDARAEASREIEEYKKAKEAEFRAFESSHAGTTSVAQSTVDRETEEKLAVINESYDRNKDAVVTKLLDRVVLVHNELHRNLKKPGSA

SEQ ID NO: 80725 - protein, 490 aa, Triticum aestivum
MKAPRRSDTDAQLEEEIPIHKSRLTLWRTSAAIRSASTSYAMLRACGAAAPASVPALVRARLARPASAVASSSSALEELAADRKGLAKVVKKGKTQIFRDGSPMVYSGAVDRIIGRPPPRTGDVVLVADGSEKPIGWGVYNSVSMFCVRLMQLEEEAKRDPASALNMERLLEERLCSAVDLRGSLGFPSTNTNAYRLINSEGDRLSGLIVDIFADVAVIASSAAWVEKYRQQIQSLVSKVSDVNHIKWRSSTDILKEEGLDMSEQKEPAPSSYSGTVKVMENGIIYLVSMEGQKTGFYADQRESRHFISTLSKDQRVLDLCCYSGGFALSAAKGGATNVTGIDSSGSALDLANENILLNKLDAERISFLKEDATTFMKGAISRNELWDLVILDPPKLAPRKKVLQSASGMYRSLNALAMQVVKPGGLLMTCSCSGAMTQSGLFLKTIQGAASMAGRKVTVLRQAGAACDHPIDPSYPEGQYLSNYLLRVM

SEQ ID NO: 80726 - protein, 75 aa, Nicotiana tabacum
LAEYTEFTGNFPAIAAQCLQKLPSSNNKFTYNCDHHTFNFLVEDGYGKFSFYLSVLASPFCIVFSIFYTFFFSSI

SEQ ID NO: 80727 - protein, 390 aa, Silene latifolia
VSFKLKSDTDLFEIIKCKTAVSALEVSPDGKQFSVTSPDRRIRVFWYKTGKLRRVYDESLEVAQDLQRSDAPMYRLETIDFGRRMAVEKQIEQTETAPQPNAVFDESSNFLIYSTLLGIKVVNLHTNKVSRILGKVEGNDRFLKIALYQGDRSNKRVRKMPLAAANANESKEPLIDPTLLCCAFKKHRIYLFSRREPEEPEDVTKGRDVFNEKPPADELLAVSELGKSATTSLPDNVVIHTTMGDIHMKLYPEECPKTVENFTTHCRNGYYDNLIFHRVIKGFMIQTGDPLGDGTGGQSIWGREFEDEFHKSLRHDRPFTVSMANAGPCTNGSQFFITTVATPWLDNKHTVFGRVIKGMDVVQALDKVKTDRNDRPYQDVKILNVTVPKS

SEQ ID NO: 80728 - protein, 421 aa, Vibrio parahaemolyticus RIMD 2210633
MRFIMSVNFADLGIEQQLVETLNNMNIVTPTPVQEKSIPHVLEGKDLLAAAQTGTGKTAAFGLPIIQAVQQKKRNGTPHALILVPTRELAQQVFDNLTQYAEHTDLRIVCVYGGTSIGVQKNKLEEGADILIATPGRLLDHLFNGNVNISKTGVLVLDEADRMLDMGFWPDLQRILRRLPNDKQIMLFSATFEKRIKTIAYKLMDSPVEVEVSPANTTAETVKQMVYPVDKKRKRELLAYLIGSRNWQQVLVFTKTKQGSDELAKELKLDGIKAVSINGDKSQGARQRALDEFKQGKVRALIATDVAARGLDIQELEQVVNFDMPFKAEDYVHRIGRTGRAGKSGLAVSLMSRDEEYLLRAIETLLDQRLPQEWLEGFEPSLIEEVEPERDGGGRRKSRSSEKRKLKAKLAIHKNRGKHRK

SEQ ID NO: 80729 - protein, 183 aa, Oryza sativa
  misc_feature (32)..(32): Xaa can be any naturally occurring amino acid
  misc_feature (35)..(35): Xaa can be any naturally occurring amino acid
  misc_feature (46)..(46): Xaa can be any naturally occurring amino acid
  misc_feature (50)..(50): Xaa can be any naturally occurring amino acid
  misc_feature (67)..(68): Xaa can be any naturally occurring amino acid
  misc_feature (71)..(71): Xaa can be any naturally occurring amino acid
  misc_feature (77)..(77): Xaa can be any naturally occurring amino acid
  misc_feature (79)..(79): Xaa can be any naturally occurring amino acid
  misc_feature (81)..(81): Xaa can be any naturally occurring amino acid
  misc_feature (84)..(84): Xaa can be any naturally occurring amino acid
  misc_feature (89)..(89): Xaa can be any naturally occurring amino acid
  misc_feature (93)..(93): Xaa can be any naturally occurring amino acid
  misc_feature (114)..(114): Xaa can be any naturally occurring amino acid
  misc_feature (120)..(120): Xaa can be any naturally occurring amino acid
  misc_feature (122)..(122): Xaa can be any naturally occurring amino acid
GETTTPHRRIESAAAAAAAAAAAAIGIHNHVXGIXAHWAKNFAFLXYFKXVYGRDKPLPKWTDADVXXFIXSDPVYXPXLXAMXESRKXFALXGALVWGAHLRGIPLKFSKGPXRVFSLXTXFPGRIGPSDLKVGRNHWLPLLQKTEPGGPKGSTCWEQGPRKTKIELSNFHHGKINFPPWEF

SEQ ID NO: 80730 - protein, 183 aa, Rhodospirillum rubrum ATCC 11170
MFIQTERTPNPASLKFLPGKAVLPGGGRDFADVGAAGPSPLARRLFAIDGVTGIYLGADFITVSKAEAEDWQVIKPLVLGAIMEHFTSGEPVLIAGTAAESAGSAEDDEVVRQIRDLLETRVRPAVAQDGGDIVFDRFQDGVVYLHLRGSCSGCPSSTATLKHGIENMLRHYIPEVEAVEAVL

SEQ ID NO: 80731 - protein, 473 aa, Oryza sativa Japonica Group
MAVALEAGRRKRAAVVVLGDIGRSPRMQYHSLSLANQAGMEVDIVANGGSDPHLLLRENPSIHIHEMKSVQLTGILKISGALTLLLKAAIQFIILIWYLCFKIPRPDVFIVQNPPSVPTLAAVKLASWLRGAKFIVDWHNFGYTLLGLSHGRSHIIVKIYFWFEKHFGRMADGAFCVTKAMKHELDQKWGINATVLYDQSPEFFHPASLTEKHELFSRLGNSICSAMGNDDCISVEKEVEDRNTTVFTSWVDGEIFLKPNRPALVVSSTSWTPDEDFSILLEAALMYDRRVAATLGEDDSMDEGKLWIDIKNGKQFVYPRLLFIITGKGPDRMKYEEQIKRLKLRRVAFRTMWLASEDYPLLLGSADLGVSLHTSSSGLDLPMKVVDMFGCGLPVCAASFSCIDELVKINNNGLLFSTSSELADELMMLFKGFPEECDDLKSLKVGALNTGSSSKWSTEWERYALPLVNQVIG

SEQ ID NO: 80732 - protein, 154 aa, Chlamydomonas reinhardtii
MALQATSQLARHVISKTLGGAFATKAADVVPTFDWKKVPVPSTTAKDIPVTVKGATPAGDLRATSGLGLGDGIKNHTDKWLDGDKKSPMEYINEVAPIKVKGLVVASYGSDDPALGCPVEYINLKGTSLENPAVCKYTGNRYYSDDWKGGAAHH

SEQ ID NO: 80733 - protein, 323 aa, Vitis vinifera
MEEKCAIAKDVTELIGNTPMVYLNNVVDGCVAHIAAKLEMMEPCSSVKDRIGYSMINDAEEKGLITPGKTVLIEPTSGNTGIGLAFIAAAKGYKLILVMPSVVTLERKMVVLAFGAELYLTDIAKGIQGVFDKADEILQNTPNGYILNQFENPANPKIHYETTGPEIWKGTGGKVDILVAGIGTGGTVTGAGHFLKEKNPEIKVYGIEPAESAVLNGGNPGSHKIQGIGAGIIPKVLDTELFDEVIQISSDEAIETARLLALKEGLLVGISSGAAAAAAIKLAKSPENAGKLITVIFPSFGERYLSSVLFDSIRDEAENMKFD

SEQ ID NO: 80734 - protein, 191 aa, Escherichia coli O157:H7 EDL933
MQKVKLNNGIEMPLLGFGVFQMTDAAECERAVIDAINTGYRLIDTAASYQNEPQVGNALKQSGIARNELFVTTKLWLQDTSYEGAKAQFERSLNRLQLDYVDLYLIHQPYGDVHGAWRAMEELQQAGKIRAIGVSNFHPDRLADLIAFNNVVPAVNQVEVNPFNQQLHAVPWMQSRGIQPEAWAPFAVTGR

SEQ ID NO: 80735 - protein, 456 aa, Streptococcus pyogenes
IKEKEETKTVNKTKQNKTKQNKTKHSLLCRYGLTSAAALLLTFGGASAVKADGEGIRKTQEKLSELQEQFPKVEDIYKDNNLLKQTSTYKYLEQLDKILKDYLKELNGGLHHLKGDQGEPGEPGEPGERGQRGETGPAGPQGPAGPVGPVGPAGKDGTQGPRGDKGETGEQGQRGETGPAGPQGPAGPVGPVGPAGKDGTQGPRGDKGETGEQGQRGETGPAGPQGPAGPVGPVGPAGKDGTQGPRGDKGETGEQGQRGETGPAGPQGPRGDKGETGEQGQRGETGPAGPQGPAGPVGPVGPAGKDGAKGDRGETGPAGPAGKDGEAGAQGPMGPAGPQGPRGDKGETGDKGEQGPAGKDGERGPVGPAGKDGQDGLPGKDGKDGQDGKDGLPGKDGKDGQDGKDGLPGKPAPKTPEVPQKPDTAPHTPKTPQIPGQSKDVTPAPQNPSNRGLNKP

SEQ ID NO: 80736 - protein, 584 aa, Symbiobacterium thermophilum IAM 14863
MLRKTKIVATIGPASEQVEVLTRLIEAGVDVCRLNFSHGTLDEQRRRIENIREAGRRVGKDVAIMIDLKGPEIRIGTFENGKVTLRDGDLFTLTTEPCVGNQERVWVQYPGIVHDVAEGGYLLLDDGNLTFQAVEVTPTEIRCRVIVGGVLSDRKKVNLPGTKVSLPALSEKDIEDIRFGVEMGVDFVAGSFIRKAQDVLEIRRVIEEAGGHQQIISKVESQEGFDNLEAILQVSDGLMVARGDLGVEVPTEEVPLMQKRMIERANAMGKPVITATQMLESMVNRPRPTRAEASDVANAIMDGTDAIMLSAESAAGKYPVEAVRTMATIARRTEEALDHSQLMARRGRFGRMDSVTEAISHATVTTAHDLGATAIVSATTSGFTARMVSKYRPGCPIIAVTPDPRVARQLRLVWGVFPVVEPVASGTEDLTQRAVEGALVSGLVKNGDLVVITAGLPVGVKGTTNLLKVHTVADVLAQGTGIGRQPVTGRAVIVRSEEDLARVQPGDILVSRLTDADCVPAMERAAGIITEEGGLTSHAAVAGISLGKPVIVGAEGATRRIPDGAIITMDVAHGLVLRGEATVK

SEQ ID NO: 80737 - protein, 294 aa, Escherichia coli O157:H7 EDL933
MEGLTVEFSVLSNNLKMPMMGFGVFQVTDKNVCKQSVLNAIRTGYRLIDTAAVYGNEDAVGEAVREAISEGLCTREELFITSKLWVQDMLNQDTAAAGIEASLKKSGLEYFDLYLLHQAMRDYFSAWRALEDAYEEGKLKAIGVSNFYPHVLANFCETVRVKPMVNQVELHPYFAQPEALATMKYYNVQPEAWAPLGGGRHKPFENNLLQSIADAHQKSISQVILRWNIQRGVVVIPKSTHQQRIEENFAIWDFSLTEKEMAQISSLDLGYVGESVKHFNPEFVRGCLAVKIHD

SEQ ID NO: 80738 - protein, 404 aa, Symbiobacterium thermophilum IAM 14863
MTGITPQRVESGYAVGSCVDESPVSGPGRRANRMAVTREQVLDALKVVNDPELHKSIVDLDMVKDIQIDGGHVAVTINLTVPGCPLKHRFERDVEAALKQVPGVERVTTHFGAMTDAERAAVAAKVRGSSAPHADARPSTMALATRTTIIGVASGKGGVGKSTTTVNLAVALKKLGYSVGIIDADIYGFSIPRMMGNMSRPEALDDQMLLPVWAHDIPFISAGSLVNEDQAIIWRGPMLGKMVEQFLVNVQWGKLDYLLIDLPPGTGDVALSVAQMLPGTDLVLVTTPQAAASQVAARVGSMAARTKQRVVGVIENMAYFLCDECNKKHFIFGKGGGQALAASLGCEVLSQIPLTPDVRLGSDVGDPIVADKEDHPAAQAYLEAARKLAQLAPPKVWSDELRVL

SEQ ID NO: 80739 - protein, 386 aa, Solanum lycopersicum
MADMNQHPTVFQKAANQLDLRSSLSQDVHARYGGVQPAIYQRHFAYGNYSNAGLHRGQATQDLSLITSNASPVFVQAPQEKGFAAFATDFLMGGVSAAVSKTAAAPIERVKLLIQNQDEMLKAGRLSEPYKGIGDCFGRTIKEEGFGSLWRGNTANVIRYFPTQALNFAFKDYFKRLFNFKKDRDGYWKWFAGNPASGGAAGASSLFFVYSLDYARTRLANDAKASKKGGERQFNGLVDVYRKTLKSDGIAGLYRGFNISCVGIIVYRGFYFGMYDSLKPVLLTGNLQDSFFASFALGWLITNGAGLASYPIDTLRRRMMMTSGEAVKYKSSLDAFSQIVKNEGPKSLFKGAGANILRAVAGAGVLAGYDKLQVLVLGKKYGSGGA

SEQ ID NO: 80740 - protein, 332 aa, Escherichia coli
  misc_feature (1)..(1): Xaa can be any naturally occurring amino acid
  misc_feature (109)..(109): Xaa can be any naturally occurring amino acid
  misc_feature (166)..(166): Xaa can be any naturally occurring amino acid
  misc_feature (194)..(194): Xaa can be any naturally occurring amino acid
  misc_feature (279)..(279): Xaa can be any naturally occurring amino acid
  misc_feature (318)..(318): Xaa can be any naturally occurring amino acid
XKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLXDPLDGSSNIDVNVSVGTIFSIYRRVTPVGTPVTEEDFLQPGNKQVAAGYVVYGSSTXLVYTTGCGVHAFTYDPSLGVFCLCQERXRFPEKGKTYSINEGNYIKFPNGVKKYIKFCQEEDKSTNRPYTSRYIGSLVADFHRNLLKGGIYLYPSTASHPDGKLRLLYECNPXAFLAEQAGGKASDGKERILDIIPETLHQRRSFFVGNDHXVEDVERFIREFPDA

SEQ ID NO: 80741 - protein, 497 aa, Coccidioides immitis RS
MAGLLSSLSSVTLVAVAAITVILFLALVYFFIPPASFPRNIPAIPFYYALLPLVKDGDQEALYHTYLEPLFEQHGAAKIFFGGRWNILVQRPSYIAEVFKYEDTYAKSGNQKKIPYSVLAEYTGDNIISSHGENWKLYRSILQPPLQQDQDPGPIWRNSRLLISLLLEEQKTSPHGSVLLPQLLQRFTLANLSEGLLGTSFQTLQQKDAALHKFQMMLKPLIFDPVFLNFPFLDHFNFPSRQRARRLARQFANELCQTVQRGHQHAHTDKSTSNVGCSVIGAFEQGILSEKQFRNNMVSVFLAGHENPQLLLVSMMFLLGEHQEIQERVREEVLSLGEDELPYSVLQSAPFLTSVIYETLRMYPPISQLINRRTTKPVLLGGKIPLPAGTYIGYNAYATNRDKQSWGADADEFKPERWGRTVDEINVTFRKANAKGAFISFHGGRRACLGQKFAMFEARIAMAEILRSLRWKIDPTWPRRMTPVSGLNQNHDAMDEN

SEQ ID NO: 80742 - protein, 515 aa, Opitutaceae bacterium TAV2
MPAAAAHRHPFLQGLSKHRGAPPTVIVIFGASGDLTARKLIPAIYNLGFDNLLPADFHLVGYGRKEIPDTEFRELATSAIKEFSRRELNADVWARVADRTSYVAGAYDDPEAFKRLAAHIAALEKKLGRELQTLFYISTPPSVFEPILQNLGAAGLASKYLGQPNHTKVIIEKPFGKDLASALELNGTIRRVFEEHQVYRIDHYLGKETVQDLLVQRFSNAIFEPLWNRNYIDCVQITVAEEVGVGTRGGYYEQSGCLRDMIQNHTMQLVALTAMEPPVSLDAEAVRDEKVKLLKAIQPLHLGSGPASDVARAQYAAGMTAGKQARGYLEEGGIAQQSATETYAAIRLSINNWRWQGVPFYLRSGKRMARRVTEIAVQFKRPPGTLFAGGGFDLAPNTLSFQIQPDEGLNLILNGKVPGLETRTQPVKMNFRYSATFGSNTPEAYERLVLDAMIGDGTLFIRGDEAATSWKLYTPVLEAWAAAGRDGMDTYAAGSWGPASADALLAREGHLWRQP

SEQ ID NO: 80743 - protein, 369 aa, Oryza sativa
  misc_feature (193)..(193): Xaa can be any naturally occurring amino acid
MSTSGSESDSVAAKRSMKPKYSKFTQQELPAWKPLYTPGIVIGAFSLIGIIFIPIGLVSIAASQEVVELVDKYDGECVTANDKVGFIQDTKTDKACTRTITVPKPMKGPIQVYYQLENFYQNHRRYVKSRSDKQLRSKEFSSVIKTCDPEAISEGGAPIVPCGLIAWSLFNDTFTFSVNKKTVQVNKKNIAWXSSDRTIKFGSDVFPENFQKGGLIGGGQLNEKLPLSEQEDLIVWMRTAALPTFRKLYGRIETDIMASDEITVVIQNNYNTYSFGGTKALVLSTTSWIGGKNNFIGFAYVAIGTISFLIALAFVGLNMVKPSTLGDPSYLSWNKENPRLCPMIMRAGMFMCSCPIGFVCSLGLKLCGL

SEQ ID NO: 80744 - protein, 174 aa, Glycine max
  misc_feature (37)..(37): Xaa can be any naturally occurring amino acid
  misc_feature (86)..(86): Xaa can be any naturally occurring amino acid
  misc_feature (143)..(143): Xaa can be any naturally occurring amino acid
MVPSVISSPAETTVNRAGAGMADPLTALKSMDGCPTXNTLIDFTSFASNGGRAQNMQAWPPVDNKKYETLYYLPDLDPAQPAKDGXYLLRTGWTPRLELELEHGFWCREHNRPPEHYDGRYWTMWKLPIMTYTDAYHASKDLXEANTAYPNGFIRIIRFNTVRQVHHMNLIDYK

SEQ ID NO: 80745 - protein, 338 aa, Glycine max
MVSDSIAAVPIPSAANTRNPGKKKRTNRSAKLKQYKIDARREQWLSQGAVKSKGYKDGLDDDGHAPPPSPAVVKHSVEPLNTRRRGEEDDGLIHHDSDSESPTNCPAGVLCGTDSGTNFTGSSSGGSSSSSSSSSSSSGGCCSGNVTEVEEEEEGDDDDDDDDGCLDDWEAMADALAADDKRENPCPDSPPVVSPSEGSNLGSPNSKPESGRLFPWGSGNSRAWRADDAFRPQSLPNLSKQHSMPNPDRRGVPWGRAPTPSSCPICCEDLDLTDTSFMPCLCGFRLCLFCHKRILEEDGRCPGCRKPYECEPVETEASVLGDSLTLRLARSCSMIERS

SEQ ID NO: 80746 - protein, 352 aa, Vitis vinifera
MAVGTASEAETKKKSGFEIQALTSWLLKQEQAGVIDAELTIVISSISMACKQIASLVQRASISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDSTLDSTEQRCVVNPGSNLLAAGYCMYSSSIIFVVSIGTGVFAFTLDPMYGEFVLTQENIQIPKSGKIYSFNEGNYQLWDDKLKKYIDDLKDPGPSGKPYSARYIGSLVGDFHRTLLYGGIYGYPRDKKSKNGKLRLLYECAPMSYLVEQAGGKGSDGHQRILDIQPVEIHQRVPLYIGSVEEVEKLEKYLA

SEQ ID NO: 80747 - protein, 198 aa, Acer saccharum
VTGFLDPPELIKPPKILVIEGLHPMYDERVRDLLDFSIYLDISNEVKFAWKIQRDMAERGHSLESIKASIEARKPDFDAYIDPQKQYADTVIEVLPTELIPDDNEGKVLRVKLIMKEGVKHFSPVYLFDEGSTISWIPCGRKLTCSYPGIKFAYGPDTYFDHEVSVLEMDGQFDRLDELIYVESHLSNISTKFYGEVT

SEQ ID NO: 80748 - protein, 368 aa, Marsilea quadrifolia
QTAASRPLSVKATATEIPSKVHKSSSKNVVRIGINGFGRIGRLCLRVALARDDIEVVAVNDPFIDTKYMAYMFKYDSTHGIYKDEIKAVDESTLQIGGQRVKVFGKRDPSEIPWGSAGADFVVESSGVFTTIEKASSHLKGGAKKVIISAPSADAPMFVMGVNEETYKPDMQIVSNASCTTNCLAPLAKVVDQEFGIVEGLMTTVHATTATQKTVDGPSGKDWRGGRGAAQNIIPSSTGAAKAVGKVLPQLNGKLTGMAFRVPTPNVSVVDLTCRLEKGASYDDVKAAVKAASEGSMKGILGYTEDDVVSTDFVGDSRSSIFDAKAGIALNKNFIKMVTWYDNEWGYSNRVVDLISHIAAVVAANKGN

SEQ ID NO: 80749 - protein, 120 aa, Vitis vinifera
MFLNHIRDIKDPEHPYSLEELKVITEDAIEVDDKRSYVRVTFTPTVEHCSMATVIGLCLRVKLLRSLPSRYKVDIKVAPGTHATEAAVNKQLNDKERVAAALENPNLLDMVDECLAPSYG

SEQ ID NO: 80750 - protein, 369 aa, Vitis vinifera
MGGTIPTGSSRILFSNSPSSVSCLSPHHLLSRFNNTTRGQYHTRKKNEFEIENLTTWLLKQEQDGIIDAELTIVLSSISLACKRIASLLQRSSISNLTGGQGTINVQGEDQKKVDVISNEVFCNCLRSSGRTGIIASEEEDVPVAVEETYSGNYIVVFDPIDGSANIDTSLTTESIFGIYGPDEQCLFDIDDDSMLDQTKQKCVVSVCQPGSNLLAAGYCLYSSSVVFTLSIGKGVFAFTLDPTFGEFVLTHADIKIPRSGKIYSFNEGNHELWDDNLKRYLHHLRQPGPNGKPYSGRYIGCLVGEIHRMLLYGGIYGNPKNMNSKKGNLRLLYECAPMSYLVEQAGGKATDGNQRILDIQPTEVKIKK

SEQ ID NO: 80751 - protein, 303 aa, Vitis vinifera
MAELQPPESTVNAGLVGVAIAPAVPAAVENLSTSLAPKRQRRPSVRLGEIGDQPAATLSYDSQARRVKPWRFHKDYGQASKASKTRPLTNLVNGGECHETLETEERSFAGDGNLDSAVFGNRKAKRRGATKRVRSNWATKFDDGAEGDEKFSGREDDEEEYRDFDPEGSESLLKEQSPVHSVDNVALDLWHGHRRPVRARVSESREHDAVELDAMPDSDSRDRKCRTSADRNLTANRLLDDGVRTWLFGLGLGRYAPVFEIHEVDFEVLPLLTLEDLKDMGINAVGSRRKIYTAIQNLRKGFT

SEQ ID NO: 80752 - protein, 219 aa, Haemophilus somnus 129PT
MDQLSMKKMAAQAALQYVKPDSIIGVGSGSTVNCFIEVLGTIKETIKGAVAASKASEELLLRQGIEVFSANDVSGLDIYVDGADEINPQKMMIKGGGAALTREKIVAALAKKFICIVDSSKQVDVLGSTFALPIEVIPMARSQVARKLVALGGSPEYRENVVTDNGNVILDVYNFKIMNPIEMEKELNNVAGVVTNGIFALRSADIVIVGTPEGTKIIE

SEQ ID NO: 80753 - protein, 505 aa, Helianthus tuberosus
MEIPYLLTTTLLLLFTTLYLLLRRRSSTLPPTIFPSLPIIGHLYLLKPPLYRTLAKLSAKHGQILRLQLGFRRVLIVSSPSAAEECFTKNDIVFANRPKMLFGKIIGVNYTSLAWSPYGDNWRNLRRIASIEILSIHRLNEFHDIRVEETRLLIQKLLSACNSGSSQVTMKFSFYELTLNVMMRMISGKRYFGGDNPELEEEGKRFRDMLDETFVLAGASNVGDYLPVLSWLGVKGLEKKLIKLQEKRDVFFQGLIDQLRKSKGTEDVNKKKTMIELLLSLQETEPEYYTDAMIRSFVLVLLAAGSDTSAGTMEWVMSLLLNHPQVLKKAQNEIDSVIGKNCLVDESDIPNLPYLRCIINETLRLYPAGPLLVPHEASSDCVVGGYNVPRGTILIVNQWAIHHDPKVWDEPETFKPERFEGLEGTRDGFKLLPFGSGRRSCPGEGLAVRMLGMTLGSIIQCFDWERTSEELVDMTEGPGLTMPKAIPLVAKCKPRVEMTNLLSEL

SEQ ID NO: 80754 - protein, 645 aa, Debaryomyces hansenii CBS767
MILEKLFKVVQKMSGENYDISSINLAKLFNKSTSNQYDKEAIIDQTYAKTQLDENRIDAEAKVIKDRGVYRVEASKELMDNSKNGKLMKAVLGISIVMCAWAVDLDSSVTYSLAPWATSHYQKHSEGLGALTTANGIIAAISKPVYAQICNTLSRPTTYVISVVLYTVGYIIVAASNTFSAYIVGLALGAAGTSGIRFINSLIAADLTVLKWRSLATAILSAPYIINTWYAGYIVQDLGTSNWRWGYGMFTIIMPVVVCPATYILIFSQQKAHKLIPEDDRALYEQLFSFRKNWKTFIWRLIIEADVLGLLLLGFGFALLLLPFSLQSGAKGGWNNPSMIAMMVIGGVLVIVFFLWEILLAPFPITPRRVLNRTVICCIVIDFFYQFAGMLPLQYLSSYVWIVQNWSNRDWTYYNNTLTVALCVFGLVAGVLYRVTHRYKVFQIFGVLLETVSQGFMINGTEARTDTLLLVWHSICSGAAGGFNVVASATALLAAVPHRDLAVAMSILSLWSLIGQSIGGAVSTAIWGLKMESEFRKYLPSSVSDEQVTGYFHSITAIREDFDWGSDERDGAIKAYKVICYYFFAIAAALQVIRFVAVMLQTNYYLGDTQNAVEFSDETQISNEVERKNVEKSNQKWYVAIYDIW

SEQ ID NO: 80755 - protein, 753 aa, Rhodospirillum rubrum ATCC 11170
MADETNRNLDREALLFHITGRPGKIEIAATKPLTTQRDLSLAYSPGVAAPCLAIQRDPTTAYDYTAKGNMVAVISNGTAVLGLGDLGALASKPVMEGKAVLFKKFADVDGIDLEVDTRDVDEFVNCVRYLGPTFGGINLEDIKAPECFIIEQRLRALMDIPVFHDDQHGTAIIAAAGLINALDLSGRDIGDAKMVVNGAGAAAIACVELVKAMGMRSANVTLCDSKGVVHRGRSDLNQWKSAHAIDTEARSLQDAMRGADVFLGLSVKGAVTAEMVATMAPQPIIFAMANPDPEITPEDVLSVRDDAIIATGRSDYPNQINNVLGFPYIFRGALDVRARTINDEMKIAAARAIAALAREDVPDEVAAAYSGRRLRYGRDYIIPVPFDPRLIAAISPAVAEAAMRSGVARKPIIDIIGYRRELSARLDPTAASLQALSAQVINNPKRVAFAEGEEEKMIRAALSYRNAGYGTPILIGRAEKIAATMAAMGLGGLEGMEIQNAKLSTQTKPYTDYLYGRLQRHGYLYRDVQRLVNSDRNVFAASMVMLQDADAMVTGTIRHFHSCLSDITKVIDQTPGELVFSVTLLIARGRTVFIADTNVHEAPSAQELADIAIQTAALARRMGHEPRVALLSYSTFGAPLGRTPDRPRQAVALLEDRKVEFEFDGEIGVHVALDPDLLKLYPFCRLSAPANVLIMPGLHSANISSKLMQKMGGATTIGPVLMGLSRPCQIVPMDATVSDIVHMATLAAAEAGR

SEQ ID NO: 80756 - protein, 284 aa, Zea mays
MARRCPHNRLTWPPAQPDSIHAAAPASTGVASRCTHRWCQGGDLTPTYKEASRAAPFPASARGEIGRRRSRGGERWTRRSSASTTATAAPVDADIERLPVDLLAHILSLLSPFRDLSMYVRRHPPHLAAVLCYKFVTWTRSAALLPCRADVRAGGVSRRWRWAVERSLASRRRLSFAGQRTGDDTAARLVRAAVNLRDLDISRSCWGCRITDDGLIKISSADCVGNLTSISLWGLAGITDKGVVRLVSRAYSLQHLNIGGTFITDESLYAVANSCANLKFMGSW

SEQ ID NO: 80757 - protein, 167 aa, Vitis vinifera
MGSGTGNFLKVVLKNIDVLAGPVVSLAYPLYASIRAIETKSPVDDQQWLTYWVLYSMITLFELTFAKVIEWLPFWPYAKLIATCWLVIPYFSGAAYVYEHFVRPLFVNPRTVNIWYVPRKKDVFSKPDDILTAAEKYIQENGPDAFENIINRVDRESKSRGSNYAIF

SEQ ID NO: 80758 - protein, 403 aa, Oryza sativa Japonica Group
MDATAIGNGALHSNGAGADTKGKPIKCKAAVAHGPGEALVMEEVEVAPPARMEVRLKVLFTSICHTDLSAWKGENELQRKFPRILGHEAAGVVESVGEGVEDLAPGDHVVPIFTGECGACTYCESSKSNLCKTYRVNPFKSTMVTDGGTRFTMIDRSSGARNPVYHFLNTSTFAEYTVIDSACAVKINPKAPLEKMSLLSCGVSTGVGAAWNTANVSKGSTVAIFGLGAIGLAVAEGARLRGASRIIGVDINPEKFSKGKEMGITDFINSKASGKPVHEVIMEMTDGGVDYSFECTGITDVLREAFVSTHDGWGLTVVLGIHATPRMLPLHPMELFDGRRITGCVFGDFKGKSQLPEIVEKCMQGEININFDGFITQELPFADINKAFQLLEEGKSLRCLLHV

SEQ ID NO: 80759 - protein, 113 aa, Schizosaccharomyces pombe
ASQIQMLAFGGIIGTGLFLGIGSSLAESGPASILISFSVLGVSVYCTMLALGEMSVYMPVAGSFCTYVGRYVDEALSFSLTWNYWLNDTIALASHVLATRLVVDFWLIPTEGD

SEQ ID NO: 80760 - protein, 214 aa, Zea mays
MAATRASPVLLLLLTVQLSLLFRLPDSPSTLALALAAEPEQQNAKQHRQPALLVQSTCNSTSFYDLCISALAADPASSTADVLGLGAIAVSAAANNASGTAAFLGNASDAAATPQADRALLRACAGKYAAARDALVQARASLAEQAYDYAFVHVSAAGEYPAVCRTLFRRRQQQQRGASRSAYPAELAKREEALRRLCTIALDIISLLQNQETY

SEQ ID NO: 80761 - protein, 266 aa, Mycobacterium avium 104
MNALARLRGRKVVPQRSDGELDAMAAAGAVVAAALQAVRAAAVAGVSTLSLDQIAESVIRDAGAVPSFLGYHGYPASICASVNDRVVHGIPSGAEVLAPGDLVSMDCGAVLDGWHGDAAITFGVGALDPADEALRQATRESLEAGIAAMVPGNRLTDVSHAIELGTRAAETRHGRAFGIVEGYGGHGIGRQMHMDPFLPNEGSPGRGPLLAPGSVLAIEPMLTLGTGKTVVLDDQWTVITTDGSRAAHWEHTVAVTDAGPRILTLG

SEQ ID NO: 80762 - protein, 191 aa, Wolbachia endosymbiont of Drosophila simulans
MTDYDLIVIGGGPGGYKCAIAAAKLGLKVACIDKNSIFGGTCLRVGCIPSKALLHSSYQYAHTKNDLSKLGIKIKDASFDLKEMLGYKDARVQELGKGIEYLFNLHKITKINGLASFDQGNLEVSVEGKVLKTKNIVIATGSDVISLPGINIDEKNIISSTGALSLTEVPKKLVVIGAGAIGLEMSSVGAG

SEQ ID NO: 80763 - protein, 520 aa, Helianthus tuberosus
MEIPYLLTVVLLLLTTLYLLLFTTLLLLFTTLYLLLRRRRSSTLPPTIFPYLPIIGHLYLLKPPLYRTLAKLSAKHGPILRLQLGFRRVLIVSSPSAAEECFTKNDIVFANRPKMLFGKIIGVNYTSLAWSPYGDNWRNLRRIASIEILSIHRLNEFHDIRVEETRLLIQKLLSACNSGSSQVTMKFSFYELTLNVMMRMISGKRYFGGDNPELEEEGKRFRDMLDETFVLAGASNVGDYLPVLSWLGVKGLEKKLIKLQEKRDVFFQGLIDQLRKSKGTEDVNKKKTMIELLLSLQETEPEYYTDAMIRSFVLVLLAAGSDTSAGTMEWVMSLLLNHPQVLKKAQNEIDSVIGKNCLVDESDIPNLPYLRCIINETLRLYPAGPLLVPHEASSDCVVGGYNVPRGTILIVNQWAIHHDPKVWDEPETFKPERFEGLEGTRDGFKLLPFGSGRRSCPGEGLAVRMLGMTLGSIIQCFDWERTSEELVDMTEGPGLTMPKAIPLVAKCKPRVEMTNLLSEL

SEQ ID NO: 80764 - protein, 394 aa, Microcystis aeruginosa PCC 7806
MDLLEYQAKEIFAQVGIPILPSQPIQEPGGLKRLNIPYPVVLKSQVRAGGRGKAGGVKFVANTIDAIAAAHAIFHLPIAGEYPEVILAEARYNPQQEIFLAILLDYHLQRPVLLGASQGGMDVDSLLATMQKVVIEERFSPYLCRQLAVSMGLRGSLIESISQILEKMYSLFVSKDLDIIEINPLGINEAGEVMALDGKISVNDAALARHLDLLALTPPQLQSPWSIIDQTGQIAVISNGQGLMSTVWDALASKGARLAAWLILEERLELEQLNEQIEAGLQQFQLLPDLKVVIVDIVSYPDFGQKAIESISNYYRSYSPLSPSRGSGERTIRATRQERQTLQPRSFLNPSLPQIIFRVLADSKAIDLSQSLADVNFHWLEPLEEVVTAAIKLA

SEQ ID NO: 80765 - protein, 641 aa, Vitis vinifera
MYAAYAAILVSVYHHSNYLERSISNEGDYERHALMERLTLMDNEDCYNQLRMGKDAFARLVTILRGTGRLRNNAHSNVEEQVAKFLHIVGHNLRNRTMKFYFKRSSETISRHFHQVLRAIISLDDVFLKQPDGLKCPQEIKDNTKFWPYFKDCIGAIDGSHFRVKVSNDVVQRYRGRNSHMFYLVGKDLRQTSRILDNALVRDFDKLIVPQGKYYLADAGFQLKTGFLTPYRSTRYHLKEYSVHQPENAREVFNLRHSSLRNAIERAFGVLKKRFPIIASGTEPHYPVDTQSDIILACCILHNYLMGVDPDERLIAEVDKELFSEEAEFESMMEHSAGFEVHKSVSEKRNLTWIDEMDNFLVDRLMEQMHKGQKIGEVFTKTAYAMVAREIGENFELSCNSEHIKNRMKTFKKNFYAAQEVLQNGSGFGFNESTQMIEATTEVWTTYTKAHPGASQLRHKPIRNYDKLSILLGKDRATGSLAAGAKERQLRWAQEQNLDDTIPLGSSQHGIRDETFAYVENEATTETSFSSADASVSAPKSNKETKKRKAKYADIVSEELRSIRVGMDAVVAALDRSNLQNYTEEQLFEEIAKVGGMSDVSHMKAYQALTGDVSAARAFLACPIDRRRGKAELVKQFSKLW

SEQ ID NO: 80766 - protein, 1013 aa, Yarrowia lipolytica CLIB122
MNDSVSTPLVKKEDSLGLDDEATVLRRPSMNSTFPQISPPAMMALSSQHATHELDFPNIQPKRESPDNPNNTNDGGEQVKLEEPLPPLMDEIESGDDDSSRVSAYARLDFESFTFYVQTLQVVLGRRVENSSSMVDVHLGDTKAISRKHAKIFYNFGTQRFELSVLGRNGAFVDDVFVETGSTVPLKDGTKVQVGTIPFSFVLPSLPDHTTGSPTPINPADALSMRSNNIRVLSRQGSPAIVSPRKKSTGSSNSKQSTKSATGSPGTPVLDPLDYNLPTEVTEANASSSSVNLFEQENSKYTENMDVKYDSDKYSDKYDLPLDDMDLDDAVDASLSDLQPVYPTGSQYNMPSQQQHQHNQHQQSNMQPGNMFQQQKPQSKPRKQPKREYQLHEIPEEYRTKPNFSFSHLIATALEQAPDKGVSLAEIYRSIQEIFPYYKYCPHGWQNSVRHNLSSSKTFRKVSKEGKGWLWGIDREWCAERDRQKRKSTLSKNKSMRPDSHIPGSAPNPAFSNFSVNNFDSGEVKMYSPDTNTYGTQIDLNSHNTDAHGGQTMTFDQNKNDGGVNVIDFSSANFTLDNNASTSSSSAGSSSQPRGGQEIKFMPGSGPNGVIDFSSQPKARQKTIAEMAQEIQLQNSGSQQRMYQSPYQSQTTPAGGMGQQNTSSQQARAQAGSSAGGKATAPKLGKDAMKILALLQQKISQQFQQQLGGKAPSSALITNALAIAIAQATKKNPSGGVNALQSLLNGDNQQQLNQIVMAAYNAVKTKQDAQGGGNSSNSRQPTPQQSTPQQSTLQIKQERPMSTQQQGQSQFSTQTQFQSQSPAPQYSPPAQASPQISQPQMSQSPQIVTSGTPGASGSMPGSATASPAPAPAPVQAPVPVQTQAPAQHTTAPQARPAVPGTSSAVPTPSASSAPATAPAGSSSSPATAKPAGGLTSLSNSDTTIAQVLEQASKISNPSPAVQAALKQLRAHAEKYGADIPIGSLGKLPKPGDKRKAEDPPSAHEQPAKKPLNN

SEQ ID NO: 80767 - protein, 367 aa, Vitis vinifera
MESQVSCIGFNSNADSLKVQTTIFGTPCIGNSSSLQLSFGRIGRLVLRVATSRDDIDVVAVNDPFVDAKYMAYMFKYDSTHGVFKGTIKVLDESTLEINGKQIKVTSKRDPSEIPWGDYGIDYVVESSGVFTTTEKASAHIKGGAKKVVISAPSADAPMFVVGVNETSYKPSMNIVSNASCTTNCLAPLAKVVHEEFGIVEGLMTTVHATTATQKTVDGPSMKDWRGGRGASQNIIPSSTGAAKAVGKVLPELNGKLTGMAFRVPTPNVSVVDLTCRLKKSATYEDVKAAVKYASEGPLKGILGYTDEDVVSNDFVGDSRSSIFDAKAGIGLSASFMKLVAWYDNEWGYSNRVLDLIEHMALVAASK

SEQ ID NO: 80768 - protein, 535 aa, Oceanicola granulosus HTCC2516
MAVLGSAISPRSEAFAANRAAHEAAMAPVREAAALAEAGGGDRARARHTGRGKILPRERVARLLDPGSPFLEVGLFAAHGLYDGAAPAAGLIAGIGRVAGREVMVVCNDATVKGGTYYPMSVKKHLRAQEIAEANRLPCVYLVDSGGANLPNQDEVFPDRDHFGRIFFNQANMSAKGIAQIAVVMGSCTAGGAYVPAMSDVTIIVREQGTIFLAGPPLVKAATGEVVSAEDLGGGDVHTRLSGVADYLADDDAHALALARQAVAGLNLTKPAQLDLAPPEPPLYDPDEILGVVPADLRTPYDIREVIARIVDGSRFDEFKARYGATLVCGFAHVMGMPVGIVANNGVLFSESAVKGAHFVELCSQRRIPLVFLQNITGFMVGRAYEAGGIAKDGAKLVTAVATTRVPKITLLVGGSFGAGNYGMCGRAYAPRFLWSWPNSRIAVMGGEQAAGVLATVKRDAIERGGGSWSDAEEAAFKAPTIAQFERQSHPLYASARLWDDGIVDPRKSREVLALSLSAALNAEIEATRFGVFRM

SEQ ID NO: 80769 - protein, 302 aa, Yarrowia lipolytica CLIB122
MTVPKVKLSNGLEIPAIGFGSGTKWKRPPGEKEERELIDAVVSAINAGHLHIDTAEFYGTEKQIGEAIKESGVPRKDIFLTSKTLFGLLADDPIESISNQLKTLQTDYFDLFLIHVPPNDDINYDLAKAWGVLEQLYEKGLAKAIGVSNHSPAELETIIKVAKIKPHVNQIEFHPLLQEPTPGIVDFCKQHDIVVEGYSPLASNELEGEKPLDAVVANVAKNHNVSPGSVLLRWATQKGIVPITTSANAGRQKEALAIFDFKLSDGEVEEISKVGAESPRYQRLPIPSHKHYYPAEEGEAKI

SEQ ID NO: 80770 - protein, 344 aa, Aspergillus oryzae
MEFIRAEILGTTFETTSRYANVQPVGLGAFGLVCSAYDQITQQHVAVKKMMNPFANASIAKRTYREVKLLKQLRHENLIGLCDIFISPLEDIYLVTELLGTDLGRLLRARPLDNKFAQYFMYQILRGLKYIHSAGVIHRDLKPSNLLVNENCDLKICDFGLARVQEPQMTGYVSTRYYRAPEIMLTWQRYGKMVDIWSAGCILAEMLRGKPLFPGKDHIHQFFLITEVLGNPPPEVVQKITSGNTQRVVNSLPNQEPRPLRAVFHEFDNDVISLLEQLLLFDPDKRLTAETALQHPYLAPYHDPDDEPAALEKFDWSFNDADLPIDTWKLMMCVAIGSAKCAPN

SEQ ID NO: 80771 - protein, 189 aa, Haemophilus somnus 129PT
MNTNLLVINNHDSFTYNLVDLIRRLGTPFKVVNVEDLSLVEIENFSHLLISPGPDVPHAYPQLFDLLEKYHQSKSILGVCLGHQTLCEFFGGKLYNLQNVRHGQAKQLKVRSNSRLFRNLPLTFQIGLYHSWAVSPENFPEDLEITAICDDEVIMAMQHKTLPIYGVQFHPESYISEFGKQIIQNWLSN

SEQ ID NO: 80772 - protein, 415 aa, Emericella nidulans
MAEFIRSDILGTTFETTSRYANLQPVGLGTAGVVCSAYDLISEQVVAIKKMMKPFHSTSVAKRTYREVKLLRHLRHDNLINMSDIFISPLEDVYLVTELLGTDLHRLLNGKPLESKFAQYFTYQILRGLKYIHSAGVIHRDLKPGNLLINENCDLKICDFGLARVQEPQMTGYVSTRYYRAPEIMLTWQRYGSKVDLWSVGCILAEMLLGRPLFPGTDHINQFWLITDLLGNPPDEVIDRITTNNTRRVVKSMAKRNPRPLKEILPAAEDAALNLLDNLLVFDPDRRISAEQGLMHPWMAPYHDPTDEPVATEQFDWSFNDADLPLDTWKIMIYSEVLDFFQLTTNAEPSGEQSQNQSQSQSQAFTSSQDLQLASMLNLGEGELLPDFAATIDPNKFGSVDYLMDGQSLDPNSFS

SEQ ID NO: 80773 - protein, 295 aa, Staphylococcus aureus subsp. aureus NCTC 8325
MPLKETEGIVEVSIKEEKEHVSVKLAMAQLGGAPQLDLQMAVVNALKENGAKTVGIRFETLPEEKVNQFKPKEENKPKTIEGLLSQNNPVEFIAIASGKGGVGKSTVAVNLAVALAREGKKVGLVDADIYGFSVPDMMGIDEKPGIKGKEVIPVERHGVKVISMAFFVEENAPVIWRGPMLGKMLTNFFTEVKWGDIEYLILDLPPGTGDVALDVHTMLPSSKEIIVTTPHPTAAFVAARAGAMAKHTDHSILGVIENMSYFESKETGNKEYVFGKGGGTKLADELNTQLLGELP

SEQ ID NO: 80774 - protein, 217 aa, Bordetella petrii
MQRFTDFYASMHGGASVTPTGLGYIPMVIEQSGRGERAYDIYSRLLRERLIFLVGPVNDNTANLIVAQLLFLESENPDKDISLYINSPGGSVYAGMAIYDTMQFVKPDVSTLCTGLAASMGAFLLAAGKKGKRFTLPNSRIMIHQPSGGAQGQASDIQIQAREILDLRERLNRILAENTGQPVERIAVDTERDNFMSAEDAVSYGLVDKVLASRSEG

SEQ ID NO: 80775 - protein, 516 aa, Cryptococcus neoformans var. neoformans
MFQKVSDKFHRKQQSTTLPGKTQQVPNPTSPVLAKANSQAQQAYSLPQDHSPMEGIQRDSPPIQQPMATEKAPIVGSSASTSLPTLSVQDGTLPLTPGAQGMQTGTIDGHRQLQSPVSRSSSAGEDKMREKARDAQEQAAQSQANLHHATQQARVAAINAAATQAALETAAQLPATARVPVSGGGVEQGQARRKTAGRYALSDFLIERTLGTGSFGRVHLVRSRHNGRFYAVKVLNKEKVIKMKQVEHTNSEREMLVRVRHPFLVNLWGTFQDVNNLYMVMDFVAGGELFSLLRKSQRFPNSVAKFYAAEVALALDYLHSLDIIYRDLKPENLLLGADGHVKVTNFGFAKYVPDITWTLCGTPDYLAPEVVQSKGYNKSVDWYALGVLIFEMLAGYPPFFTEDGNPMKLYEKIIAGKVRYPTYFDALAKELLKNLLIGDLTKRYGNLRAGSSDIFAHGWFAEVDWDKLYRREIPAPYVPKIDGEGDASQFDRYQEADVSAYGKVGNGPYDHFFTEF

SEQ ID NO: 80776 - protein, 178 aa, Chlamydomonas reinhardtii
MVLSFGLTYYVCIFAELLFPTYASLKAIQSPGKLDDTQWLTYWVVYAFISTFESVGSIILQWIPLYYEIKLLFVLWMIAPQTQGARKIYEDHIMPLLKKYGDKIDPVFARAEQALESQYVNHLAKYVDKHGPAVLDQALAQAQKHGTVVAGMAQAAYQEQLKKAASGQPGAAAFSGAH

SEQ ID NO: 80777 - protein, 654 aa, Cryptococcus neoformans var. neoformans JEC21
MTRDFDSLFFTGPIFVDYSFTARHLESFLSSFPPQVSHAMSSASTPTAPYLEDLVRNSLDQTLPWVVQKYGGTSVGKSLDNITKIVGSYIDNGSKVAIVCSARSTQTKSLGTTNLLLQASREALQPALSSSGDGRSGSMSGTATPFYPKRVGSGFFGKDQSTSMVSSVSSLSQLEPQLGRSGSPSPFQSSSSRSPPRSPATPSQDSSVSQEPAFHATVDLIKKGHLEAARASLKEGPLRDELEEEIERDCESLRSFLYAAQIIDEISPRSQDSIVGTGERLACKIVAAALRDRGVDSELVVLDNIVDASMSAASEAISVDAGDQGVAQLGQEFYDQLSFRLGERLRECGQRVPVVTGYFGPVPGSLLAQIGRGYTDLCAALCAVGLKASELQVWKEVDGIFTADPRKVPSARLVPIITPDEAAELTYYGSEVIHPFTMEQVIRARIPIRIKNVENPSGAGTVIYPDLGFPRGLDTEPPKAERIVEGVDERMPTAVTIKDEIIVLNIHSNRKTLSHGFLARIFGTLDRAGVVVDLISTSEVHVSMAMQDFLNRKRLERLVKDLEKIGEVTVSKDMAILSLVGRNMRNAIGSAGLMFASLARAMINIEMISQGASEINISCVIENKDAIKALNVIHESCLSYPRSPATEMAGLQLQ

SEQ ID NO: 80778 - protein, 368 aa, Triticum aestivum
HEGIYILTKAADGKLSWHAFDPLCSRWQRLPLMPGVARGGSRLGGLVSAGIRISGAIRGLLRQEDWLDKIPFCACAVGTVDGCLYVLGGFSRATAIKSVWKYDPAVNLWQEVSSMSTARAFGRTGLLNNKLYVVGGVIREETGLAPLQSAEVFDPATGIWADVPSMPFSKAQTLPTAFLADLLKPVATGIVSFGGKLYVPQSLYSWPFFVDVGGEVFDPATDSWSDMPVGLSEGWPGRQAGTKLSAVVDGDLYALEPPTCSDSGKIKMYDPNEDTWKAVVSQVPVGDFAESKCPYLLAGFLGKLHLVIKDANSMISILQTDALKPMDATGSTCQNPDVSWEQGDDVWRMVGSKKFAAAELVSCQALSI

SEQ ID NO: 80779 - protein, 495 aa, Schizosaccharomyces pombe 972h-
MAFSLVSILLSIALAWYVGYIINQLTSRNSKRPPIVFHWIPFVGSAVAYGMDPYVFFRECRAKYGDVFTFVCMGRKMTAFLGVQGNDFLFNGKLADLNAEEAYSHLTTPVFGKDVVYDIPNHVFMEHKKFIKSGLGFSQFRSYVPLILNEMDAFLSTSPDFGPGKEGVADLLKTMPVMTIYTASRTLQGAEVRKGFDAGFADLYHDLDQGFSPVNFVFPWLPLPRNRRRDRAHKIMQKTYLKIIKDRRSSTENPGTDMIWTLMSCKYRDGRPLKEHEIAGMMIALLMAGQHTSAATIVWVLALLGSKPEIIEMLWEEQKRVVGENLELKFDQYKDMPLLNYVIQETLRLHPPIHSHMRKVKRDLPVPGSKIVIPANNYLLAAPGLTATEEEYFTHATDFDPKRWNDRVNEDENAEQIDYGYGLVTKGAASPYLPFGAGRHRCIGEQFAYMHLSTIISKFVHDYTWTLIGKVPNVDYSSMVALPLGPVKIAWKRRN

SEQ ID NO: 80780 - protein, 336 aa, Synechococcus sp. WH 5701
MLTPAVTSFLTAERVEQDSKPHDTRRLRLFSGTSNPALAHEIASYLGVPDGPRVIKRFADGELYIQIQESIRGCDVFLIQPTCAPVNDHLMELLIMVDACRRASARQITAVIPYYGYARADRKTAGRESITAKLVANLLAQSGVDRVLAMDLHSSQIQGYFDIPCDHIYGSPVLVDYLSARDLGEMVVVSPDVGGVARARAFAKRMHDAPLAIIDKRRSDHNVAESLTVIGDVAGKTAVLIDDMIDTGGTICQGARLLRREGARRVLACATHAVFSPPAIERLSEPGLLEEVLVTNSIPISDERSFPQLKVLSVAKMLGEAIWRIHEESSVSSMFR

SEQ ID NO: 80781 - protein, 385 aa, Vitis labrusca
MDDAKISELKQFVNSVKSDPSILHNPSLSFFKSYLQSLGARIPAKPDKCGCGTSDHGEHVDAKKTNLCSEDDKFEDDIVESDIELDDTDVVEPDNDPPQKMGDLSIDVTEENQDAAQMLKSKAMEAISEGKLDEARDNLTEAIMLNPSSAILYATRASVYVKLKKPNAAIRDADAALKINPDSAKGYKIRGMARAMLGLWEEAATDLHVASRLDYDEEIALVLKKVEPNARKIEEHRRKYARLCKERELRKYGHQKQQQQAQPHDPEAAAALKDGQVMAIHSSSELETKLKAASKTSRLAILYFTATWCGPCRYISPVFTSLSGKYPKVVFLKVDIDGAQDVAVSWNVSSVPTFFFVKSGKEIDKVVGVDKSALETKIAQYAGQS

SEQ ID NO: 80782 - protein, 239 aa, Zea mays
MKKRPSTDFMKTIQKDVNPSMRAILIDWLVEVAEEYRLAPDTLYLTVNYIDRYLSGNEINRQRLQLLGVACMLIAAKYEEICAPQVEEFCYITDNTYFRDEDPALHLEFLANYIAELSLLEYSLLSYPPSLIAASAIFLARFVLQPTKYPWLLPDENDTVLVADTRYIWKQNSTLAHYTQYKPSELSECVKTLHRLSSVGPGSNLPAIREKYSQHKYKFVAKKQCPPQIPAEFFRDAAC

SEQ ID NO: 80783 - protein, 490 aa, Escherichia coli O157:H7 EDL933
MSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPSLEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCNAAFEQKILARVERIRAGDVFDPQTNFGPLVSFPHRDNVLRYIAKGKEEGARVLCGGDVLKGDGLDNGAWVAPTVFTDCSDEMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 80784 - protein, 853 aa, Opitutaceae bacterium TAV2
MRSIMFRLFRNRRFAKIYLSCLAAFFVVAFFVRPSMAQSIGDASTAAGHAAKEAFKYFGLFSDPKYTTLEIWSLLAVLGIAVLGLLYAIMLARQVRDADQGTPRMQAIAAAVREGANAYLSAQFRKIGPLIIIITIILFFTTQSHEMAFKIGRAGAFLVGSLFSWAVGFVGMRLATTGNLRVAAAARRSYGEAMQLGYRTGTVTGMLTDGLGLLGGTLIFLAYGEQAYEALLGFGFGGTLLALFMRVGGGIYTKAADVGADLVGKIEKNIPEDDPRNAATIADNVGDNVGDCAGMAADIFESYEVTIVAAMILGLASFGHKGVIFPLLVRGIGVLGSIISTYTVKAGPNDTSDTALKSVHRGFWIGSFISVLGFVILGAYYLKFDAAYLAQNPTAVPGFPGGDPTALPVWATFGLENTDMRPVLTCFIGVILAIALNKVTSYFTHTTHSPVQGLAKSCQTGHATNIIQGFAVGYESTVATVGVIASSILLSYLCYVGTPPLFVAYGIAMTGIGMLTLTGNTISMDVFGPVADNANGIGEMGYDPEEMEKQEKGSYRKARQILADLDAVGNTTKAETKGIAIGSAVIAAVSLFASFIAVIAVGSEDKISQMTTEQYLLEAGKLTVAHPMVFIGFLIGGAVPFLFSSMLIRAVGRAAFLIVKECRVQFRDKEIWAGTKKPDYGRVVDICTATAQKELVGPGFLAILTPIAVGFLLGTQALGGFLAGMIIVGQLLAVFMANAGGAWDNAKKLIEDGHYGGKGSEAHKAAVTGDTVGDPLKDTAGPAINPLIKVMNMVSLLCLGLVIKYNVLTASEGHNGRVIGVIVALVCAIAIGWAIWQSKREMKEAVELQKEFN

SEQ ID NO: 80785 - protein, 186 aa, Triticum aestivum
GLNALGVETDKGGRILVDKRFMTNVKGVYAIGDAIPGPMLAHKAEEDGVACVEFIAGKEGHVDYDTVPGVVYTHPEVASVGKTEEQVKASGVAYQVGKFPLLANSRAKAIDDAEGLVKVVAEKETDRILGVHIMAPNAGEIIHEAVLALQYGASSEDIARTCHAHPTVSEALKEACLQTYLKAIHI

SEQ ID NO: 80786 - protein, 248 aa, Mycoplasma pulmonis UAB CTIP
MKKLLIIGNWKMNKTYDEARDFINAFSNAYALNGAKISENIEYGIAPSFTNMSLFNKELLEKTNINLVAQNINENRSGAFTGEISAQMLKSINAKYVIVGHSERRQNYRETNKIVNQKAKAAIENGLIPIICVGESLEEYEAGKTKAVIKKQIKQSLEALDLSKIVVAYEPIWAIGTGKVATAEVAQQICKFIRSITSKDLIIQYGGSVSPSNIENLMKQEDIDGALVGGASLEVDSFFELITFNALK

SEQ ID NO: 80787 - protein, 365 aa, Pinus sylvestris
CQSARTLQPVRATATEAPPRVQRSSGKERTKIGINGFGRIGRLVLRVALSKEDIEVVAINDPFIDAKYMAYMFKYDSTHGVYKGSLKIVDDTTLEIDGHRITVNSKRDPSEIPWGNYGAEYVVESSGAFTTTEKASAHLKGGAKKVVISAPSADRPMFVVGVNEGSYKPEMSIVSNASCTTNCLAPLAKVVNEEFGIAEALMTTVHATTATQKTVDGPSMKDWRGGRGAGQNIIPSSTGAAKAVGKVLPELNGKLTGMAFRVPTPNVSVVDLTCRLEKPASYDDIKAAMKAASEGSLKGILGYTDEDVVSNDFVGDARSSIFDAKAGIALSSTFVKLVSWYDNEWGYSNRVVDLISHMALVASRK

SEQ ID NO: 80788 - protein, 524 aa, Yarrowia lipolytica CLIB122
MNYYEILQVEKTATDADLKKAYRKQALLLHPDRNHGNVEEATAKFAVVQAAYDVLSDSQERAWYDSHGMSMGGGGSGGSGEDGVHIYTTTEDVMRWFDPLMFANVDPESSSNFWATASSIFNQLAQEEREAAMDADVDSPILPAFGNSKSSWQHETRVFYDNWINFSTVKQMAHKDMYREKDAPDRRVKRAMQGHNKKARDAAKKEYNDAVRAFVRFIRKRDPRVKLQAQQAKEASLSGGKTAAEAQAYRARMANMAKRQEEERRYKEQAWQKVVEDEENPTAVVGEDEEEGESEVEDIWECVVCDKEFKTEQMLQSHEQSRKHAKALHKLRREMRKEGLDLGLDETPEPEAEEEEDEVGPELADEEEKEEEIPSKPEKQVNAFALLAEEGDGDEEKDDDDEEENDVEGGVEGYIEEEEGKKVISESIEPSKHEEEESLEALLAKLNGSSLSDNEELDAAKGSKKVGKARAKRNKKNENTADFASTCGVCNTVFDSRTKLFDHIEKSGHAVPVAKPKKGRKNKR

SEQ ID NO: 80789 - protein, 257 aa, Vitis vinifera
MDWDRTLFHNSLIALYLIAPPTFISLRFLQAPYGKHHRSGWGPTVPPSLAWFLMESPTVWLTLLIYPLGDRSSNPRSLILISIYLFHYIHRTLIYPLHLRNSTAAKRNGFPVSVALMAFGFNLLNAYLQARWVSHYANYEDDGWFWWRFWVGLVIFLDGMLVNVRSDLALVGLKSQGGGYKVPRGGWFELVSCANYFGEVVEWLGWAVMTWSWVGLGFLLYTCANLVPRARANHKWYLEKFGEDYPKGRKAVIPFLY

SEQ ID NO: 80790 - protein, 427 aa, Microcystis aeruginosa PCC 7806
MSPETLLEPTLVDPTPNLNPNQPFDPDSFNSYVMNTYGRFPIAIAKGLGCLLWDTSGKQYLDFVAGIATCTLGHAHPALIEVVSQQIQKLHHVSNLYYIPEQGELAKWIVDHSCADKVFFCNSGAEANEAAIKLVRKYAHTVLDFLEQPVILTAHASFHGRTLATITATGQPKYQKDFEPLMPGFAYIPYNDIEAVENAIADLDEGNRRVAAIMLEPLQGEGGVRPGDIEYFQRLRQICDENNILLVFDEVQVGVGRTGKLWGYENLGVEPDIFTSAKGLAGGIPIGAMMCRKFCDVFEPGSHASTFGGNPFACASALTVLQTIERDHILQNVQQRGEQLRSRLRVIASQYPHLFVDVRGWGLINGLEINSESELVSSTIVNAALTEGLLIAPAGPKVLRFVPPLIVSETEVDEAMDKLEVAIAKVV

SEQ ID NO: 80791 - protein, 264 aa, Dichelobacter nodosus VCS1703A
MNADAIIPIPYLNNRVYMTTPTYPQAETAAAIAANLAEIRQRIVRAAEECQRDPNSIRLLPVSKTVNAQRLRLAHSCGMTILGENKVQEAYDKWQELQDTDLKWAIIGHLQTNKAKYVARFASEFQALDSLKIAEELDKRLQQENRQLDVFIQVNTSNEPQKYGISPENAEDFVRQLEAFRSLRLRGLMTLAIFSSDKDTVRQCFIRLRQLRDQLQQINPDIAELSMGMSGDFELAIAEGATTVRVGQALFGARQQPDSYYWPN

SEQ ID NO: 80792 - protein, 357 aa, Zea mays
MMMANAKLHKQALLPPRSPFPTAAPYADRGPIARPQVGATHHRHGHHQRTSSESFIEEQPPSWLDDLLNEPETPAARQSGRAGHRRSSSDSFALFDGGAAGAGAYANGFEGMGRGGGQPAPWGGVQEYYAKLAPIGRAHGRPWEQGMPNSAGFRHGGGLPMPTKDKVGGHHGPPKVSREHDHGMDKRTDDAGHDQKVGAKEGVPPKHAQSEADNKRAKQQYAQRSRVRKLQYIAELESRVQALQIFMFDSCSQKGVEVSAEMEFLSQQNIMLDLENKALKQRVESLAQEQLIKRFQQEMFEREIGRLRTIYQQQQQQQAPALVRSNSRDLDVQFANLSLKHKDPNTGRDALSGPLRT

SEQ ID NO: 80793 - protein, 697 aa, Bordetella petrii
MSAHTSRRPSRNCSPCGWTPRPPATRSCCWPASNWPRAGSAPAFFQYLQASGPYLSVIRASGLTLRRGTKVLLDGADFVVHPGERVGIVGKNGAGKSSLFALLTGALDLDAGNIDLPAGWRIASVQQELAADAQPAREFVIDGDTHLRHLQAQRAALRDDQGTQIAEAESALVEAGAWSAASRAEQLLAGLGFKPHEWMQPVASFSGGWRMRLALARALMAPSDLLLLDEPTNHLDLDAMLWLEKWLAAYSGTVLLISHDTEFLDAVARAILHFDHGKLVRYRGGYQDFLTQRAERLRQTNLAHERQAREAARLQGFIDRFKAKASKAKQAQSRVKALARMEALAPLHAEAGIDIRIPSPDHMPDPLLALEHLSAGYTDAAGQAVPILRDVTLMVRAGSRIGVLGANGAGKSTLIKTLAEELPVQAGERRASRGLAIGYFHQHQLDMLDLDATPLAHLARLAPDTREQELRNYLGGFGFSGDAATGLVGPMSGGEKARLALALIVWQKPNLLLLDEPSNHLDVETREALAAALAEFSGSMLLVSHDRHLLRTTVDSFWIVADGAVREFDGDLEDYRDWLAARNAEEKAADAAAREPAGATETVNRKAQRRLEAEQRQRLATLRKPLEAELAKVEAGMEKTRAALQKLDDIIADADLYSDARRAERQQVMAEHGELGKHMQLLEERWLELQEALEDIQ

SEQ ID NO: 80794 - protein, 501 aa, Silicibacter sp. TM1040
MTETTPQYDYDLIVIGSGPSGRTAAIQAAKLKRRVLVIDRKDRLGGVSVHTGTVPSKTLRETVLNLTGWRERSFYGRAYRVKDQIKAEDLKARLHMTLDHEVDVLEHQFNRNHVDMLAGMAHFTGPNEVEVEVEAGDTTRVTGEKFLIATGTRTYRPDSVPFNGTTVVDGDEFLEMAEIPRSLIVVGAGVIGVEYATMFSALDVRVTLIEPRDTFLDFIDRTLIQEFTHQIRENGVDLRLGSAIESIEDEGSHIEVTLENGRHVRGEMLLFAAGRMGNTDRLNLKAVGLETDHRGRLEVERKTYQTKVSHIYATGDVIGHPSLASTSLQQGRVAACHAMDVPTVPESPWFPYGIYSVPEMSTCGMSEEELKERGVPYEVGIARFRETSRGHIMGLEHGMLKMLFSLKTRRVLGVQIVGEGATELIHIAQAVLNLKGTVDYFVQNTFNYPTLAEAYKIAGLDAFNRMPIPDEYKDLRAPSKAKKAPAKKTETKSAAKDKAPE

SEQ ID NO: 80795 - protein, 338 aa, Vibrio parahaemolyticus RIMD 2210633
MKVLVTGGMGYIGSHTCIQMIEAGMTPVILDNLYNSKSTVLERIEKVRGVKPTFIEADIRDKAALVEALKVHNIEAVIHFAGLKAVGESVEKPLEYYDNNVNGTLVLVDAMREAGVKSLVFSSSATVYGDPASVPITEDFPTSATNPYGRSKLMVEECLTDFQKANPDWSITLLRYFNPVGSHPTGELGEDPQGIPNNLMPFISQVAVGRREFLSVFGSDYPTKDGTGVRDYIHVMDLSDGHVAALEKVGSKAGLHIYNLGTGNGYSVLEMVKAFESACGKNVPYQLVERRPGDIAECWADPSKAMNELGWKASRTLEEMTGDTWRWQSNNPQGYPDA

SEQ ID NO: 80796 - protein, 762 aa, Oryza sativa
MAILSDVATEVLIPIAAIIGIGFSIAQWVLVARVKLAPSQPGASRSKDGYGDSLIEEEEGLNDHNVVAKCAEIQNAIAEGATSFLFTEYQYVGVFMSIFAVVIFLFLGSVEGFSTKTHPCTYSKDKECKPALFNALFSTVSFLLGAITSVVSGFLGMKIATYANARTTLEARKGVGKAFITAFRSGAVMGFLLASNGLLVLYIAINLFKMYYGDDWEGLFESITGYGLGGSSMALFGRVGGGIYTKAADVGAGLVGKVERNIPEDDPRNPAVIADNVGDNVGDIAGMGSDLFGSYAESSCAALVVASISSFGINHDFTGMCYPLLVSSMGIIVCLITTLFATDFFEIKAVKEIEPSLKKQLIISTALMTVGIALVSWLALPYKFTIFNFGEQKEVTNWGLFLCVSIGLWAGLIIGYVTEYYTSNAYSPVQDVADACRTGAATNVIFGLALGYKSVIIPIFAIALGIYVSFTIAAMYGIAVAALGMLSTIATGLSIDAYGPISDNAGGIAEMAGMSHRIRERTDALDAAGNTTAAIGKGFAIGSAALVSLALFGAFVSRAGVKVVDVLSPKVIIGLIVGAMLPYWFSAMTMKSVGSAALKMVEEVRRQFNTIPGLMEGTGKPDYANCVKISTDASIKQMIPPGALVMLTPLIVGTLFGVQTLSGVLAGALVSGVQVAISASNTGGAWDNAKKYIEAGASEHARSLGPKGSDCHKAAVIGDTIGDPLKDTSGPSLNILIKLMAVESLVFAPFFATHGGILFKLF

SEQ ID NO: 80797 - protein, 286 aa, Schizosaccharomyces pombe 972h-
MSETISDPYPLTNPNAPLGHPGHLNSTQQATLDSMRLELQKLGYTERLDDATLLRFLRARKFNLQQSLEMFIKCEKWRKEFGVDDLIKNFHYDEKEAVSKYYPQFYHKTDIDGRPVYVEQLGNIDLKKLYQITTPERMMQNLVYEYEMLALKRFPACSRKAGGLIETSCTIMDLKGVGITSIHSVYSYIRQASSISQDYYPERMGKFYVINAPWGFSSAFNLIKGFLDEATVKKIHILGSNYKSALLEQIPADNLPAKLGGNCQCPGGCELSDAGPWHEEQWMNKN

SEQ ID NO: 80798 - protein, 1116 aa, Schizosaccharomyces pombe 972h-
MAADIGSQSSGSLEERFEQSLHLQNVDKQDWSLNSVLQFLKLYKFNKEWEDVFIKSRIEMDLFINLADQSKAEEFAFKNKLSKESAIQLSSCIRKTLLAPSSTRVPSKNSSYETLTYSAKDSSDDVFTETNSGFRSSNQNSSLKSFQSVPDSNVNVFGGFGGSVVDNNELLSTGKNSHQTTSLNLEGSPINLHAYKGTVTSIINDDSRNINKKTLSKQPVSEHKEKQTSFLRRFRVPGFSRDKDKTKDCPSSNSNPFHLASSNVKTLDASLDQGEWVPRIHRLESQIGLISKKKSFVLATMDDMKFTVVDITNVQNATQLRKLIAKSMYLDISIDQFDLFLTEVGGAQYIEILDDRKLDIARLYSDEFGTIKFFVKPSQNEESGMDSDTYLSFGTKSSSTYKADDDSIYHRKEDFKKQPSYPVLTSDFEITDAGPNLSLSGHQPDNKYYKGFSSAPNLAVVPELPSRRFRGFEKIRGAKGEMATKILDATEAQSEKNKFTVCRPHKKVTLKMPLNSGSSAPQSPSSNTSASVLTRNFVAHRDPPPPPTETSSLRRKNTLTRRPSIRHARSSPYIDTGHNEASKFSHTSFDPKASSKSSNSLKESVEALSEIPFEDAPALDESDLSGDPFWAIQPKQSSSQVPKENHHNIQSKLSINTEAATDLKANELSSPKTPEYCRGDDRSISLSPLSYRLRKSKHIRESPPSSKVINSGNWEVRPSADDLYEDVDRFFPRYDLDKVLVVDQSRMVSSPSKVSIRPKMKSVRLLAREASEARKEIRHNARRNKSGNLLRRSSTKLWGSRIVELKPDTTITSGSVVSQNATFKWMKGELIGNGTYGKVFLAMNINTGELIAVKQVEIPQTINGRHDQLRKDIVDSINAEISMIADLDHLNIVQYLGFEKTETDISIFLEYVSGGSIGRCLRNYGPFEEQLVRFVSRQVLYGLSYLHSKGIIHRDLKADNLLIDFDGVCKISDFGISKHSDNVYDNDANLSMQGSIFWMAPEVIHNDHQGYSAKVDVWSLGCVVLEMLAGRRPWSTDEAIQAMFKLGTEKKAPPIPSELVSQVSPEAIQFLNACFTVNADVRPTAEELLNHPFMKCDEEFNFKDTNLYDMLCKRKS

SEQ ID NO: 80799 - protein, 380 aa, Dimocarpus longan
MSSTVGQVIRCKAAVAWEPGKPLVIQEVEVAPPQAMEVRLKILFTSLCHTDVYFWEAKGQTPLFPRIFGHEAGGIVESVGEGVTDLKPGDQVLPVFTGECKECRHCKSEESNMCDLLRINTDRGVMLNDGKSRFSINGQPIYHFVGTSTFSEYTVVHVGCLAKINPAAPLDKVCVLSCGISTGLGATLNVAKPKKGSTVAIFGLGAVGLAAAERARIAGASRIIGIDLNPMRFDEAKKFGVTEFVNPKDYDKPVQEVIAEMTDGGVDRSVECTGNINAMISAFECVHDGWGVAVLVGVPNKDDAFKTHPMNVLNEKTLKGTFFGNYKPRSDLPSVVEKYMNKELELEKFITHEVPFSEINKAFEYMLGGVGLRCIIRMDA

SEQ ID NO: 80800 - protein, 505 aa, Mycoplasma pulmonis UAB CTIP
MENKKNKKVILVVIDGLGLRKEKIGNAFELAKTPFFDKMFKEFPWSFIQASGKFVGLPEGQMGNSEVGHLNIGAGQIVYTGLSLINKDLEEKNFINNKAFLEVIEDVKKNNSTLHLMGLVSPGGVHSLEDHLFEIIDVAYQKGLKKVSVHVFGDGRDVAPRSIKSSFEKLEKITNKYNYDIASISGRFYSMDRDKIFERTEKAYEALLGNSNSKFDNWSEFLNKQYSQEISDEFFIPSINASKNVNFVKDGDSIIFFNFRPDRARQLTHLLIGSSLYDFKPKKPVKINKFCSMMKYEGIETLIAFEEMEIKNPIGKVAEKAGLKQLRLAETQKYAHVTYFMDGGVDIEYKNSKRIMVESQKVRSYADHPEMSAKGITDELIKNAKDFDLTILNYANPDMVGHTGVLTSTIKAVEILDYELSRLVDFAQKNNITVFITADHGNAEVTEDDKGNPQTKHTSNPVMLITSDKNLKLKDGKLANISPTILDYLDIEKHEDMNEESLIIK

SEQ ID NO: 80801 - protein, 1142 aa, Ashbya gossypii ATCC 10895
MGDKNNNVTSLRGDRIGPWKLGETLGAGSTGKVLLAQNTETGQIAAVKVISKSVFNAQGSTFVGSNDPDVLPYGIEREIIIMKLLNHPNVLRLYDVWETAQDLYMVLEYVEKGELFNLLVQRGPLPENEAVRFFRQIIIGISYCHALGIVHRDLKPENLLLDHKFNIKLADFGMAALESKDKLLETSCGSPHYAAPEIVSGLPYHGFESDVWSCGVILYALLTGRLPFDEEDGNIRNLLLKVQSGKYEIPGEDEISPEARDLIVQILTVEPEQRIKTREILKHPLLQKYPSIKDSKSIRNLPREDTYLNPLDHNDGTIDQAILQNLVVLWHGRDKNEITMKLKEPGANLEKTFYALLHRFKFENEQQQLKQQQIAKRISSTSSSPQQNIVKSSSRRSINNILSTPKKKRSSAINVSSAHKRPVSIQKLNDCGTLNPTSPSKKRSLSNRKLSAVLAGSNSSSPSRKRMSVGQDAPPVPTAVLRDYNKRASRASKRLSFLPSKRGSITTKIIATYAKLSEDNDWEYIDREAKRTSSDFATLIDNIFEHEKYEQIRREKEELERKVREAKEREERERRARAEAERRKREEEERRRRREVEELIRQRELQKSLEEQVARLKAEVAATKQEKRISLAQEQHVRSISEPMERKGTRPSKRDSFLALQNNINSLLKRRTLSLETRPISRLDPGIRLSEENTILEDDLECNEDRLRVEKNILETIRRSKFLGSQYDIDKELQRVRREKLEKVNMRKSQDRKLEPGLHSRQEQRFVSDGTTVTSSHEDSESIILPKNVTAIGVLKDEESEPRKLSEVKIPQFTRRSKHFSASSKRLSVLSMYSTKVSYTNLADYLNNDVQLKSLQPSAPTSIKIPQEPEFMFESAGQENRYQAAAPTDTYLERPKVGVEGDHEPGEPVELIELDDSEDRSKQYSEEDIAKVKLPILPPLDHLNKPNGLGIYQAPAPPKEPLGQPVMKSMIPDDIKIKCVPNQLSPRRRATERAPEKKLTKTVPERVIAAETFPPPNTKKKPSFFKKFSREKMHSDCDVQLDTTVGDSKMFRALNKLLNGWTSYGLKEVRSMPASYTITGKLSSDNILSLRSTAFEIVILSVADTGSSVKFTKKSGSKKTFTRLVNEIEKILEKESVLVLAS

SEQ ID NO: 80802 - protein, 628 aa, Desulfotalea psychrophila LSv54
MEHFLLQLFIFLAAASIAVPIAKKLGLGSVLGYLIAGIIIGPFGLSLIGDIEEVMHFTEFGVVMMLFLVGLELKPSLLWQMRIPILGMGGAQVVLSSLAIGGVALFFLPWQQAVAIGLILSLSSTAIVLQTLREKGLMNTSPGKSIFSVLLFQDLAVIPMLAALPLLATVTIHDNKHHASALFNINLLPGYLQISATLLAILSIFFLGKFASRPIFRTIAATRVREVFVAAALALVVGISLLMTVVGLSPALGTFLAGVVLADSEYRHELESDLEPFKGLLLGIFFISIGSSLNFTLIGENILLIALLTIGLISLKWFVLVGTGFIFKMAKKERSFFGIALAQGGEFAFVLFQFTKINGVLPTQTIDPLISAVAISMFLAPLLLLAHDKFVSSNQREEAQRDTDTIDHSGQKVILAGFGRLGTDLGRFLISAGVKPVILDHDAANVDVLRKFGFEVYYGDITRLDLLEAAGAAEAELLIITIGDINKSRNLIELVAKHYPHLKIAVNASDRSSAYELMDLGITQIRRETFGSALALGQDSLEMLGFDPYDTHKLMRIFKKNDEVTMPELYKTHREDQNQYISMYQKQNEDLEELMTLDLDNDMEGFDKAWTSGNPQEYIPSAEQKKQL

SEQ ID NO: 80803 - protein, 609 aa, Ashbya gossypii ATCC 10895
MPRDTGLPSGSSTGAVLVDGELKDIKSGKVVTTETTEFFEKTSAQKSDFEYLEGDDTRFKRFLSSFKRAHGSGGTDTEGGGGQNAKHENLKQTIKSRHMIMISLGTGIGTGLLVGSGTALHDGGPAGSAIGFLIMGLCVYCVIQAAGELAVCYTSLAGGFNAYPSFLIDPALGFATAWVYCLQWLCVFPLELVTASITIKFWPGSRSVNPDIYVAIFYVLIIVINFFGARGYAEAEFFFNSCKVLMMIGFFIVGILINTGAVGTSGYIGGKYWRDPGSLGGRTHFDHFKGIVATLVNAAFSLGCSEFVALTAAEQANPRKSIPAAAKKMIYKIFVVFLGSVILIGFLVPKDSHELMGSNDSDLHVSPYVIAVRMHGVNVVPSFINAVILLSVLSVGNSAFYSSSRLLHSLAEQNYAPKIFKYIDRAGRPLMAMIISILFGTICFVAASPKEEEVFKWLLAISGLSQLFTWSTICLSHIRFRRALAVQGYSTDELGFKAQTGIIGSYVSAIMMVLALIGQFWVSLVPMGATEPDAESFFTGYLAMPMFLLFYFGYKIWNKDWRLFIRADQIDLVSHRRIFDADVLKQEDIEYRAKLRNSSIWHRIANFWC

SEQ ID NO: 80804 - protein, 504 aa, Desulfotalea psychrophila LSv54
MAEKLQYWVDNQWRRSKTTSYADLYNPSTGEVTAQVAHCTAEEVEEAIASAAAAYPGWAATPVGKRVQIFFRMKMLVDQHLEELTDILCREQGKNRAESMGDVLKVNEVIEFACGAPHLMKGPSLFNVSNGYDTVQQMRPLGVFAGIVPWNFPAMIPHGWMAPICMVTGNTMVLKAASYVPRTAMRLMELWQEAGLPPGVLNLVTANRTEAEILLRHPEIKGVSFVGSTTVGRHIYETATANGKRVQALCAAKNHALVLEDCNLERTAQGIINAFCGCAGARCMALPVIVVQESIADKLVERITYHAKKLTMGKAWLPETGMGPIVNAGHKKSILDWIARGITEGADLVLDGRRPVVAAGCENGYFIGPTIFDNVTPEMSIGSEEIFGPVLSVKRVKDFAEGIALMNANPYANGSVIYTESGFHARNFVAQTDGGMVGINVGIPVPVGIFGFTGQKKSFYGDLHTMGQDGFRFYTEQKTVTSTWFSKAKTTAKVDTWDGTMNMG

SEQ ID NO: 80805 - protein, 267 aa, Pseudomonas fluorescens PfO-1
MSVPAFGLGTFRLQGQVVIDSVSTALELGYRVIDTAQIYENEADVGEAIAASGIARDKLFITSKIWIANFAKDRLIESLKASLQKLQTDYLDLTLIHWPSPEDQVPVEEFMGALLEAKRLGLTRQIGVSNFTIDLMKQAIAAVGAENIATNQIELHPYLQNRKVVEFAQSQGIQITSYMTLAYGEVLKDPLIVQIAERLQATPAQVTLAWAMQSGYAVIPSSTKRANLQGNLGAMALTLSDADMALIATLDRGHRLTSPKGIAPQWD

SEQ ID NO: 80806 - protein, 536 aa, Oryza sativa Japonica Group
MDRVLLSSQLSSQTVVNTRVQQGSGGINSIGFAVIRKGSLKLRCYAIGGLGGGENLNDPLKESNNGPVLQGFNGSSASFRTVGAKITQETGDFFVSDAEGDPDKPTDGFSSIDEAIGALHEGKFVIAVDDESGDNEGDLVMAATLADPESIAFMIRNGSGIISVGMKEEDLTRLMIPMMSPIAEIEDISAAASTVTVDARVGISTGVSAADRAKTIFTLASPDSKPTDLRRPGHIFPLKYRNGGVLKRAGHTEASVDLVALAGLRPVSVLSTVINPVDGSMAGMPVLKQMALEHDIPIVSIADLIRYRRKREKLVELIAVSRLPTKWGLFRAYCYQSKLDGTEHIAVAKGDIGDGEDVLVRVHSECLTGDILGSARCDCGNQLDLAMQLIDKAGRGVLVYLRGHEGRGIGLGQKLRAYNLQDDGHDTVQANVELGLAVDSREYGIGAQILRDMGVRTMRLMTNNPAKFVGLKGYGLAVVGRVPVISPITKENQRYLETKRTKMGHVYGSDLPGNVPEEFLNPDDIAGDQDEDDTHN

SEQ ID NO: 80807 - protein, 627 aa, Arabidopsis thaliana
MAHSQVAYLIPLKADLKEDNSSPRITLSEGPNIIGRGNVSIVDKRLSRKHITIIVSTSGSASLSVDGTNPVVIRSSGDGERKKVKPSEEVSVCNDDLIELIPGHHFFKLVLLNGRAAKKARKAEDDVEAIRRFCPPNEKLPSTFRLLSVDALPDWANTSCVSINDVIEGDVVAAILSNYMVDIDWLMSACPKLANIPQVMVIHGEGDGRQEYIQRKKPANWILHKPRLPISFGTHHSKAIFLVYPRGVRVVVHTANLIHVDWNNKSQGLWMQDFPWKDDDKDPPKGCGFEGDLIDYLNVLKWPEFTANLPGRGNVKINAAFFKKFDYSDATVRLIASVPGYHTGFNLNKWGHMKLRTILQECIFDREFRRSPLIYQFSSLGSLDEKWLAEFGNSLSSGITEDKTPLGPGDSLIIWPTVEDVRCSLEGYAAGNAIPSPLKNVEKPFLKKYWARWKADHSARGRAMPHIKTFTRYNDQKIAWFLLTSSNLSKAAWGALQKNNSQLMIRSYELGVLFLPSPIKTQGCVFSCTESNPSVMKAKQETKDEVEKRSKLVTMTWQGDRDLPEIISLPVPYQLPPKPYSPEVINVFTGIVIFRCSMVMGPRLLEERCVWTSLAKIVDDSFSSSMT

SEQ ID NO: 80808 - protein, 252 aa, Streptococcus pyogenes MGAS8232
MSRKPIIAGNWKMNKNPQEAKAFVEAVASKLPSTDLVDVAVAAPAVDLVTTIEAAKDSVLKVAAQNCYFENTGAFTGETSPKVLAEMGADYVVIGHSERRDYFHETDEDINKKAKAIFANGLTPIICCGESLETYEAGKAAEFVGAQVSAALAGLSAEQVASLVLAYEPIWAIGTGKSATQDDAQNMCKAVRDVVAADFGQEVADKVRVQYGGSVKPENVKDYMACPDVDGALVGGASLEADSFLALLDFLN

SEQ ID NO: 80809 - protein, 349 aa, Zea mays
MEARRTGRDLLASFVLAALAAQAFVAVVESRASPAEKASQGDDVKKPDCVPGMDPRSFPGIGSGHGGGITPVTPSHGGSTGTPSHGGTTLPSPSHGGSGGDLPSPSHGGTTLPSPSHGGSGGDLPSPSHGGTTLPSPSHGGSGSTPTSPSTGGSPSHGGSGSSPTAPSTGGGYGGSPSHGGGAYGGSPSTPGSGGAYGGGSPSPAHGGGAYGSSPTPAYGDAPSHGGIGTSSPTPFDPHSFGSLPGSCDYWRSHPMEIWSAIGGRFPGTSSSMGTMGHFFGAAGRVGGTDVSIQDALANTRSDGAGALLREGAAALLNSMTRSGFPYTTEQVRDTFAAAAAAAAGGSDG

SEQ ID NO: 80810 - protein, 399 aa, Arabidopsis halleri subsp. halleri
MEQGSLSTSFPQHTPKAPKNSVLNSIKIVIFCNKLNLLLPFGPLAILVHYMIDSKGWVFLLTLVGITPLAERLGYATEQLACYTGPTVGGLLNATFGNVTELIISIFALKNGMIRVVQLTLLGSILSNMLLVLGCAFFCGGLVFYQKDQVFDKGIATVNSGLLLMAVMGILFPAVLHYTHSEVHAGSSELALSRFSSCIMLIAYAAYLFFQLKSQSNSYSPLDEESNQNEETSAEDEDPEISKWEAIIWLSILTAWVSLLSGYLVDAIEGASVSWNIPIAFISTILLPIVGNAAEHAGAIMFAMKDKLDLSLGVAIGSSIQISMFAVPFCVVIGWMMGQQMDLNFQLFETAMLFITVIVVAFFLQEGSSNYFKGLMLILCYLIVAASFFVHEDPHQDGI

SEQ ID NO: 80811 - protein, 148 aa, Arachis hypogaea
MASKRILKELKDLQKDPPTSCSAGPVAEDMFHWQATIMGPADSPYTGGVFLVSIHFPPDYPFKPPKVAFRTKVFHPNINSNGSICLDILKEQWSPALTISKVLLSICSLLTDPNPDDPLVPEIAHMYKTDRAKYEATARSWTQKYAMG

SEQ ID NO: 80812 - protein, 65 aa, Brassica napus
  misc_feature (18)..(18): Xaa can be any naturally occurring amino acid
  misc_feature (38)..(38): Xaa can be any naturally occurring amino acid
  misc_feature (54)..(54): Xaa can be any naturally occurring amino acid
PGLSQDCFIPPADLRSSXLLTEACKYSDREEKGKSSIXLAAHRAKVAALEKGKXGNDHPVWHIDV

SEQ ID NO: 80813 - protein, 454 aa, Janthinobacterium lividum
MTAVGITEPQELKRGLKSRHIQLIALGGAIGTGLFLGIAQTIKMAGPSVLLGYGIAGVIAFLIMRQLGEMVVDEPVAGSFSYFADKYCGHLPGFLSGWNYWVLYVLVSMAELTAVGIYVQYWWPGVPTWVSALIFFCVINAISLLNVKAFGEMEFWFALVKVVAIIGMIVFGAYLLASGDAGPQASVANLWQHGGFFPNGWQGLVMAMAVIMFSFGGLELVGITAAEADDPSTTIPRATNQAIYRILIFYIGALGILLSLYPWQNVVTGGSPFVLIFHALDSNLVATALNVVVLTAALSVYNSGVYCNTRMLFGLAKQGNAPRALLHLNRRGVPLVALGVSALATGACVVVNYFMPGEAFEVLMGLVVSALIINWAMISWIHLRFRAQKKIEGKTTLFQSLGYPFTNYLCLVFLAGILVIMYLTPGLRISVYLIPVWLAALGVGYWIKQSKAKA

SEQ ID NO: 80814 - protein, 215 aa, Chlamydomonas reinhardtii
RPLQAPEPADILVSELLGSFGDNELSPECLDGAQRFLAPGGISIPQSYTSFLAPVTTHKLHHDVKAYKDLEHFETPYVVRLHRHYLLAPTQPLFTFVHPNTDAPIDNSRYDSLVFSRDPADGAAVLHGFAGYFECALYKDVLLSIHPPSHSVNMFSWFPIFFPLREPVYVPAGGEVGVQVWRCCAPHKVWYEWALSAPVAGPIHNVNGRSYWVGL

SEQ ID NO: 80815 - protein, 756 aa, Zea mays
MTVTPRITVSDGRLTVRGRTVLTGVPDNVSAAHAAGAGLVDGAFVGAHAGEAKSHHVFTFGTLRDCRFLCLFRFKLWWMTQRMGVSGRDVPLETQFMLVEVPASDGDGDDAPAYVVMLPLLEGQFRAALQGNDRDELQICIESGDKAVQTDQAAHMVYLHAGDNPFDTVTAAVKAVEKHLQTFHHRDKKKLPSFLDWFGWCTWDAFYTDVTADGVKNGLQSLSKGGAPPRFLIIDDGWQQIASENKPDPNVAVQEGAQFASRLTGIKENTKFQTKPDGDGDGEQAAGGLKRLVAETKDAHGVKQVYVWHAMAGYWGGVTPTAGTAMERYEPALAYPVQSPGVTGNQPDIVMDSLSVLGLGLVHPRRVRDFYGELHAYLASCGVDGVKVDVQNIIETLGAGHGGRVAITRAYHRALEASVAHSFPDNGCISCMCHNSDMLYSARQTAVVRASDDFYPRDPASHTVHVASVAYNTVFLGEFMQPDWDMFHSLHPAAEYHGAARAIGGCPIYVSDKPGNHNFELLRKLVLPDGSVLRAQLPGRPARDCLFSDPARDGASLLKIWNLNKCGGVVGVFNCQGAGWCRVTKRTRVHDASPGTLTGTVRADDVDAIARVASDGGGWDGETVVYAHRTRELVRLPRGVALPVTLGPLQYEVFHVCPLRAVVPGVSFAPVGLLDMFNAGGAVEECDVISDAGGKAMALRVRGCGRFGAYCSREPARCLLDSAEVEFSYDIDTGLVSVDLLVPEQELYLWTLEIMI

SEQ ID NO: 80816 - protein, 537 aa, Silene latifolia
HLKFWKKKPIGIEFAKHFRSHLGPIEGLAVSIDGLLCCTISNEDTLKVYDVVNFDMMVMIRLQFIPGAVEWVYNHGDLKAKLAVSDRNSPYVHIFDVRAGSNEPIISKKIHVEPVKVMKYNAVCDSVVSADTRGIIEYWDPATLEFPVSFKLKSDTDLFEIIKCKTAVAALEVSPDGKQFSVTSPDRRIRVFWYKTGKLRRVYDESLEVAQDLQRSDAPMYRLETIDFGRRMAVEKQIEQTETAPQPNAVFDESSNFLIYSTLLGIKVLNLHTNKASRILGKVEGNDRFLKIALYQGDRSSKRVRKMPLAAANANESKEPSIDSTLLCCAFKKHRIYLFSRREPEEPEDVTKGRDVFNEKPPADELLAVSELGKSATTSLPDNVILHTTMGDIHMKLYPEECPKTVENFTTHCRNGYYDNLIFHRVIKGFMIQTGDPLGDGTGGQSIWGREFEDEFHKSLRHDRPFTVSMANAGPCTNGSQFFITTVATPWLDNKHTVFGRVIKGMDVVQALDKVKTDRNDRPYQDVKIFNVTVPKS

SEQ ID NO: 80817 - protein, 123 aa, Neisseria perflava
MAITKEDILEAVGSLTVMELNDLVKAFEEKFGVSAAAVAVAGPAGAGAAAAEEKTEFDVVLASAGDQKVGVIKVVRAITGLGLKEAKDIVDGAPKTLKEGVSKAEAEDIQKQLEEAGAKVEIK

SEQ ID NO: 80818 - protein, 476 aa, Microcystis aeruginosa PCC 7806
MSEFDYDLIIIGAGVGGHGAALHAVKCGLKTAIIEAKDMGGTCVNRGCIPSKALLAASGRVRELADSDHLKSLGIAIGGVNFDRPTIADHANNLVSKIRGDLTNSLKRLKVDTIHGWGKIAGPQKVSVIGDSGEKIYTAKDIMLCPGSVPFVPPGIEIDHKTVFTSDEAVRLETLPKWIAIIGSGYIGLEFSDIYTALGCEVTMIEALDSLMPGFDPEISKIAERVLIKPRDIETYVGVLAKSIKPGNPVAIELVDAKSKEAIEILEVDACLVATGRIPATKNLGLEFVGVELDKRGFIAVNDKMQVIQDGEPIPHLWAVGDATGKMMLAHAASGQGVIAIENICNRPKTIDYRSIPAAAFTHPEISYVGLTEPQAEVLAQQEGYKVASVKTYFKGNSKALAEGETEGIAKVVYRQDTGELLGVHIIGIHASDLIQEAANAIAERKSVHELAFRIHTHPTLSEVLDEAYKRAEVAA

SEQ ID NO: 80819 - protein, 293 aa, Bacillus cereus ATCC 14579
MKKVRKAIIPAAGLGTRFLPVTKAMPKEMLPIVDKPTIQYIVEEAIESGIEDIIIVTGKGKRAIEDHFDHSFELEQSLLEKGKHEMLEKVQASSKINIHYIRQKEPKGLGHAVWCARKFIGNEPFAVLLGDDIVQAETPCLRQLMDQYEGTQSSVIGVQTVPENETHRYGIIDPVEQNDRRYQVRQFVEKPEQGTAPSNLAIMGRYVLTPEIFMFLENQQTGAGGEIQLTDAIQRLNEVQRVFAYDFKGTRYDVGEKFGFIKTTIEMALQNEELNVELMKYMKELVKKEEVHS

SEQ ID NO: 80820 - protein, 328 aa, Physcomitrella patens subsp. patens
MCIRAWSRAERNGASLFADHPRVEIPEQNIDSPTATGKGPTVFVWDMDETLIVFQTLLDGQYVELFDGSKDSHKATQLGRRWERLVLEVCDEYFFYQQTEEFNHPNVDSLQEYDDGINLDEYKFEDMSLTPPLDAEDLQKLRYLYRYISQLYEQGLETFLSPEQAKEWDDLYEETDSFTDGWLSSALQDELRETASCNKSTESTSESTAASSNSFNYLVTSGTLIPTLAKCLLFKLSPYFKPSNIFSSREVGKLQCCRWIRDRFLDRNTFPKFCAIGDGPDEREAARILTWPFVTISTDPNSSDQLPMLSITAIQNLMKSVYRDSEDS

SEQ ID NO: 80821 - protein, 288 aa, Ashbya gossypii ATCC 10895
MTDINKLISEAQNLMDRGNHGGAVQKLTTAAGSNPDQSQVSSIESLIGKMTNHVMGNANTRDGGGGGIASQLFSSLTANSQGSPQAQLGKLALLSKVFGGNSGGGGFNLGSVASLFSGGNGSGAAGAAGAGLGAAGLASLASSMFGGNQGQHHQGQQQGQQQGQQQGQQQYQQGGPGYNSGGQQGGNYGQGGNFNFSGHFDPNANQSGYGNQGQGGYGQQGQGGYGQGQGGYSQQGQGGYGQQGQGGYGQQGQGGYGQQGQGGNGHGQNQGGGSGNGLANLVGSFFGK

SEQ ID NO: 80822 - protein, 285 aa, Triticum aestivum
  misc_feature (8)..(8): Xaa can be any naturally occurring amino acid
ASKNSFQXVVSIGRLQHRNLAPLLGYCRRRGELFLVYKYMPNGSVDKYLHGREGKPILNWAQRWHIIKGIASCLVYLHEEWEKVVIHRDIKASNVLLDGDMNGRLGDFGLARLYDHDADPQTTHVVGTIGYLAPELGHTSKATPLTDVFAFGVFILEVTCGQRPVNPNLEDSQVLLVESVLDQWNKGSLLDAVDKQLGGNYNADEACVALKLGLLCSHPFANARPTMRQVMQYLDGDMPLPEMSPTDLSFQMMTIMQNEGFDQFIMTYPSSTASIDSTSVLTVGR

SEQ ID NO: 80823 - protein, 224 aa, Haemophilus influenzae 86-028NP
MTTNKDHFMAKIQLVAQANLPTEYGIFKMVGFEFPDTKKEHVALVMGDISNADEPVLARIHSECLTGDALHSLKCDCGFQLATALKQIQEEGRGVLIYHREEGRGIGLINKIRAYSLQDKGMDTIEANLALGFKADERNFEVCADMFELLGVKKVRLMTNNPEKVETMKKAGINVVERVPLNVGENRYNTKYLDTKAKKMGHYIVHNNDEQHLMTCPHCQEEII

SEQ ID NO: 80824 - protein, 183 aa, Mycoplasma pulmonis UAB CTIP
MSKIVVNIEIQKDSNIKYEYDRKRGKIVVDRILRGDFRYPANYGYLEDALDWDGDELDVLVYSQEKFLPGTSLNARIVGAMKMIDDGETDTKLIAVHDDDYRLENIKALEDLDSKWLEEIKYFFSNYKNWKRPGITKVSGFENTSWALKEYQECKDLMREYGHLPKKEFISKMMKMHPEKYEI

SEQ ID NO: 80825 - protein, 1457 aa, Arabidopsis thaliana
MVTATASTPFSLSSSVVFTRRRNFKRFPVCASLSPEVSPLLRAAHHTVDNYVKSGMIIGLGSGEASDFAIRYLGQQLGSGSLHNVVGVPMSARSASEAAKYGIPLEYYRDGVQIDFAFHDADAVEENTLIAVIGRRRSSQEDDYILKQKSIVKVADEAVFMIKEEQYKAGLEGSIPVLVQSLNWLAIAEEIDDLYLGDAEVWRRASVENEGPLGGDFPIVTSDGHNILDVIFTTPIRSLADLATSLDKIDGVVDHGLIIKTRCTVVIAEETVVRSVTLQTSALEGGVRTYGQTLQKIFRFRKRNKNISSSLSSSSPPSSLSQNWLHPVFLSFRGEDVRKGLLSHIQKEFQRNGITPFIDNEMKRGGSIGPELLQAIRGSKIAIILLSRNYGSSKWCLDELVEIMKCREELGQTVMTVFYDVDPSDVRKQKGDFGKVFKKTCVGRPEEMVQRWKQALTSAANILGEDSRNWENEADMIIKISKDVSDVLSFTPSKDFDEFVGIEAHTTEITSLLQLDLEEVRMIGIWGPAGIGKTTISRVLYNKLFHQFQLGAIIDNIKVRYPRPCHDEYSAKLQLQKELLSQMINQKDMVVPHLGVAQERLKDKKVLLVLDDVDGLVQLDAMAKDVQWFGLGSRIIVVTQDLKLLKAHGIKYIYKVDFPTSDEALEIFCMYAFGEKSPKVGFEQIARTVTTLAGKLPLGLRVMGSYLRRMSKQEWAKSIPRLRTSLDDDIESVLKFSYNSLAEQEKDLFLHITCFFRRERIETLEVFLAKKSVDMRQGLQILADKSLLSLNLGNIEMHNLLVQLGLDIVRKQSIHKPGKRQFLVDTEDICEVLTDDTGTRTLIGIDLELSGVIEGVINISERAFERMCNLQFLRFHHPYGDRCHDILYLPQGLSHISRKLRLLHWERYPLTCLPPKFNPEFLVKINMRDSMLEKLWDGNEPIRNLKWMDLSFCVNLKELPDFSTATNLQELRLINCLSLVELPSSIGNATNLLELDLIDCSSLVKLPSSIGNLTNLKKLFLNRCSSLVKLPSSFGNVTSLKELNLSGCSSLLEIPSSIGNIVNLKKVYADGCSSLVQLPSSIGNNTNLKELHLLNCSSLMECPSSMLNLTRLEDLNLSGCLSLVKLPSIGNVINLQSLYLSDCSSLMELPFTIENATNLDTLYLDGCSNLLELPSSIWNITNLQSLYLNGCSSLKELPSLVENAINLQSLSLMKCSSLVELPSSIWRISNLSYLDVSNCSSLLELNLVSHPVVPDSLILDAGDCESLVQRLDCFFQNPKIVLNFANCFKLNQEARDLIIQTSACRNAILPGEKVPAYFTYRATGDSLTVKLNQKYLLQSLRFKACLLLVEGQNKWPNWGMNLVTSREPDGHIVLYTPSSHLQGPLLMENLYTFEFELVVTSSEFVLEFRADRYKCADQYESKSPSCKPFWRDFPIVISNGQNILDAILKTPMPSINQ

SEQ ID NO: 80826 - protein, 494 aa, Oryza sativa Japonica Group
MAALLLWLSWLLLSLLSIYLLDLLAHSRRCLPPGPRPLPLIGSLHLLGDLPHRSLAGLAKTYGPLMSLRLGAVTTVVASSPEVAREFLQKHDAVFATRSTPDATGDHARNSVAWLPPGPRWRELRKIMATELFSTRRLDALHELRQEKVAELVDHVAGLARDGTAVDIGRVAFTTSLNLVARTIFSHDLTSLDDHGASKEFQRLITDVMEAVGSPNLSDFFPALAAVDLQGWRRRLSGLFARLHRLFDAEMDHRRLHGMKEKDGDFLEVLLRLAARDDDTARLDGDTLRSLFTDLFTAGSDTSSSTVEWAMAELLQNPISMAKLCDELRRVVGSRRRIEESEIGQLPYLQAVIKETFRLHSPAPLLLPRQATRTIQIMGYTIPKGTRVLINVWAMGRDEDIWPEAGKFIPERFLERTIDYKGGDLELIPFGAGRRICPGMPLAVRMVHVLLASLLIHFKWRLPAEVEGNRIDMTEKFGVTLAKANHLCAMAAPT

SEQ ID NO: 80827 - protein, 146 aa, Ashbya gossypii ATCC 10895
MSRQLIRTLRVGSMCASKWNPQLSAEQLRVLRDRGTERPHTGTYLYNKSTGIYHCANCDVPLYSSSAKFDSGCGWPAFYQEVRPGALRYIRDSSLGMERVEIRCSACDGHLGHVFEGEGFAQRLGLPKDVRHCVNSCSLRFRGEGN

SEQ ID NO: 80828 - protein, 346 aa, Glycine max
MFNCEQSKIQSLAGQHSDILESLSPNVRKRVEVLREIQGQHDELEAKFFEERAALEAKYQKLYQPLYTKRYEIVNGTTEVEEGAVKETAPDNEEDQEKGVPAFWLTAMKNNEVLAEEISERDEGALKYLKDIKWSRIENPKGFKLDFFFDTNPYFTNSVLTKTYHMIDEDEPILEKAIGTEIQWHPGKCLTQKILKKKPKKGSKNAKPITKTENCESFFNFFNPPQVPEDDEDIDEDVAEELQNQMEQDYDIGSTIRDKIIPHAVSWFTGEAIQGDEFGDLEDDEDDEDIEEDDDEDEEDDDDDDDDDDDEEESKTKKKSSAPKKSGRAQLGDGQQGERPPECKQQ

SEQ ID NO: 80829 - protein, 397 aa, Zea mays
MRERLVAMMNPAAGAASRSKIKDMSAEVVDNNPYSRLMALQRMGVVENYERIRDYSVAIVGIGGVGSVAAEMLTRCGIGRLLLYDYDTVELANMNRLFFRPEQVGMTKTDAAVQTLSGINPDVVLESYSLNITTVKGFETFLASLKAQSSHERSTGVDLVLSCVDNYEARMVVNQACNELGQTWMESGVSEDAVSGHIQLLVPGETACFACAPPLVVASGVDERTLKREGVCAASLPTTMGVVAGLLVQNALKYLLNFGQVSPYLGYNSLKDYFPAMEMRPNPQCLNPACVHRQKEYMESKPARDAAAKTKMEAEASTENECPVHLDNEWNISVLDDEETETSSIRNTPDILPEGLVRELPDADSYAGPAAPVSSSAIDDDDDLEELQRQLDALNAS

SEQ ID NO: 80830 - protein, 300 aa, Opitutaceae bacterium TAV2
  misc_feature (3)..(3): Xaa can be any naturally occurring amino acid
RIXTEISRRQPVRINCDRYRQPRAIKLCEKNGADMSRVTFYDHPTNDAWCRDHGPIFVKHTQTGEVALTDWAYNAWGDKYPPYDLDNQIPPGIARALGLRRFENDMVLEGGSIDVNGDGLLLTSEQCLLNKNRNPRLSREQIEQNLRDYLGVTDILWLGEGIIGDDTDGHIDDMTRFYKPDGFITCVEPNTYDKNHALLAANLERLRGFRTPAGGKFDIVELPMPKPFGFQRQRVPASYANFLIINDAVLVPTFRQNKRDREACAIIATCFPNREIVPIDCYHLIWGLGTLHCISQQQPA

SEQ ID NO: 80831 - protein, 450 aa, Flavobacteria bacterium BBFL7
MIQTINPYNGKELEKYQEDNSKAIEEKLNKAQEQFVQWRLTSYEHRSELILKVAELLRKNTDQYALKMTREMGKPITQSRSELEKCAWLCEYYAANAESHLKNEYVNTDHLKSYVAYEPLGVVLAVMPWNYPFWQVMRFIVPALMAGNVGVLKHASSVMGSAVLMEDIFIEAGFPKGCFTNLVVGSKAVENIIKNPIVKAVTLTGSKPAGSAVASTAGSEIKKTVLELGGNNALVVFKDADIEQSVETCVAARYQNTGQSCIAGKRLLLHEDIADVFMEKFKTAVKDLKVGNPENDETYIGVMSREDLAEELEDLMNKSIEMGATLELGGKRDKAFFEPTILTGVTKDMPVFKEETFGPLMAVTTFKNDDEAVELVNDSEFGLGVSLFTLDLEKAEKLVSRFDDGAVFVNAKVASHPALPFGGTGISGYGRELSHFGIREFCNIKTVVID

SEQ ID NO: 80832 - protein, 162 aa, Arabidopsis halleri subsp. halleri
VDEEEHAGHVHVHTHASHGHTHGSTELIRRRIVSQVLEIGIVVHSVIIGISLGASQSIDTIKPLMAALSFHQFFEGLGLGGCISMAEMKSKSTVIMATFFSVTAPLGIGIGLGMSSGLGYRKESKEAIMVEGMLNAASAGILIYMSLVDLLAPDFMNPRLQS

SEQ ID NO: 80833 - protein, 552 aa, Glycine max
MGRKEKQNAKAIDEEHDVVNFNGASTPSLVFSSDDDEANQDLSLKIVEKAMRIRAAKHAPNDDVSSPFSQKSELAVPLNDVVSDLPSAIADSEVTEKKKTAKLKREAAGDQSVVIAEEQEMEETSNATENHEFVEGSPVLIGHNMVLRKLLRGPRYFDPPDSSWGACFNCGEDGHAAVNCSAAKRKKPCYVCGGLGHNARQCTKAQDCFICKKGGHRAKDCLEKHTSRSKSVAICLKCGNSGHDMFSCRNDYSPDDLKEIQCYVCKRVGHLCCVNTDDATPGEISCYKCGQLGHTGLACSRLRDEITSGATPSSCFKCGEEGHFARECTSSIKSGKRNWESSHTKDKRSQKENDYMGNRSASNDMVGARRKKRSPTEERGFSTPKKSKSRGGWTAEYPTEERGFTTPKKSKSRGGWTTEHPTEERGFTTPKKSKNRGGWTSEHPLEQKDYTTPKKSKSRGGWMSEHPEEFFPPMSSRSNGYRSLGTPSSRNNKIHSFGGGSHTPSYKSSKVWNDHAGTSMSQGSARSNHHRFSASRFGNSSSDGHGRNYNWW

SEQ ID NO: 80834 - protein, 267 aa, Arabidopsis thaliana
MSQHNILEALNVRVVGTGDRILFLAHGFGTDQSAWHLILPYFTQNYRVVLYDLVCAGSVNPDYFDFNRYTTLDPYVDDLLNIVDSLGIQNCAYVGHSVSAMIGIIASIRRPELFSKLILIGFSPRFLNDEDYHGGFEEGEIEKVFSAMEANYEAWVHGFAPLAVGADVPAAVREFSRTLFNMRPDISLFVSRTVFNSDLRGVLGLVRVPTCVIQTAKDVSVPASVAEYLRSHLGGETTVETLKTEGHLPQLSAPAQLAQFLRRALPR

SEQ ID NO: 80835 - protein, 353 aa, Haemophilus influenzae 86-028NP
MKLSKTFLFITALCSATPTLAIQNSTSSSGEQKMAMENTQNIREIYLAGGCFWGMEAYMERIHGVKDAISGYANGNTGKTSYHMIGLTDHAETVKVTYDANQISLDKLLKYYFKVIDPTSVNKQGNDRGRQYRTGIYYQDGADKAVIEQALAQLQTKYKKPVQVEVQPIKNYIVAEEYHQDYLKKNPNGYCHIDITKADEPVIDEKDYPKPSDAELKAKLTPLQYSVTQNKHTERSFSNEYWDNFQPGIYVDVTTGEPVFSSNDKFESGCGWPSFTKPIIKDVVHYETDNSFNMQRTEVLSRAGNAHLGHVFDDGPKDKGGLRYCINSASIKFIPLAEMEKAGYGYLIQSIKK

SEQ ID NO: 80836 - protein, 243 aa, Haemophilus influenzae 86-028NP
MIELSHEEELRYNRQIILKSVDFDGQEKLKASKMLIVGLGGLGCAASQYLAAAGVGNLTLLDFDTVSLSNLQRQVLHCDTRLNMPKVESAKIALEQINPHINIETINAKLDEEKLAEIIPHFDIVLDCTDNVEIRNQLDRQCNHAKIPLISGAAIRMEGQVSVFTYEPNTPTYRDLSKLFGQNVLSCVEAGVLAPIVGIVGCIQALEAIKVRLKIGKNLCGRLLMIDGFSMNIREIKLPTNME

SEQ ID NO: 80837 - protein, 711 aa, Staphylococcus haemolyticus
MIKLINSYFFESISEGNTYRGDFLKNNNSKRQFSIRKFTIGVVSIVAGITFFVSEHDVQAAEQQSSHLSQESVLSHSKPSDQDANVSSKESEIDKNINKVDDAQSYSQQNEQQSSKAENKEIQNSTQAEQVEKQEQPASNQTANHSSKESSINNQESHNKQQPSDDKTPNIKPEKIEKVDNHKRIQDQYQDKNKQVDNNQSNNSQLNQKEHPNSSNNKQQKQRLDVKPQNDNQQLQSRNDVKEKLDNQPIEQKDTKLQSNNKSKDNTTSVKSHSQQHKPHSLKTQSHLTPGQKVNTNISTNPTQQQTTNQNIKPKNTDEATIKSNQYKNKYPVVLVHGFLGLVGDNAPALYPNYWGGTKFPVKKRLEKLGYDVHEASVGAFSSNYDRAVELYHYIKGGKVDYGAAHAAKTGHDRYGKFYQGIMPDWEPGKKIHLIGHSMGGQTIRLLEHFLRHGNQEEIDYQKAHGGEISPLFTGGKDNMISSITTLATPHNGTPAADKLGNTDFVKVYLIRIGRLSGNKYSHIDLGFSQWGFKQRPDESYIDYVKRVANSKIWKTQDSAVYDLTTEGSEKLNQMTSINPNIVYTSYTGLDTHTGPLGNENPNIRQFFLFDLTSRLIGRDDNVNVRKNDGIVPVSSSLFPTNQAAKTVGMTSPTTDKGIWQVKPVMNGWDHLDFVGLDATDYKRIGEELSQFYLGIINNLIRIEDIDGIKH

SEQ ID NO: 80838 - protein, 586 aa, Synechococcus sp. WH 7805
MSQSSVESATESTTARLPKAEQRKLDSHHLRDPLLDELSNELPYFSEDALQLLKFHGSYQQDDRDKREKGKEKTWQMMLRLRSPAGRIPARLFLAMDDLSNRLGDGTLRATTRQAFQMHGIPKGDLKEVIGTIVENMGSTLAACGDINRNVMAPAAPYAKGAYPAARQLADEIADVLSPEAGEASYLELWIDGDLSYRINPSRMVKAARSRQRDVGVFSGSDDEPLYGDTYLPRKFKVAVTVPGDNSVDLLTQDIGLVAFTDATGALIGCNVYVGGGMGRTHNKEETFARIADPLGYVAANDVLDLVQSILALQRDHGDRQIRRHARMKYLVHDRGVSWFKSELTQNYFRGELKSLRNEPKAKLTDYLGWHRQQPGIWFVGIPLLCGRLEGAFKAGLREIVDRYQLELRLTPNQDVLLCNIGSSQRNSVRDALSNLGIKTPEAPPPLARHAIACPALPTCGLAITESERILPRVLERLDAQLSRLEIEKSLLFRMTGCPNGCARPYMAELALVGSGVNQYQLWLGGSANLQRLAKPFLQRMPLDELESTLEPLFVSWKQAGGRRGFGDHVSQLGDERVAELLTSAR

SEQ ID NO: 80839 - protein, 100 aa, Triticum aestivum
  misc_feature (84)..(84): Xaa can be any naturally occurring amino acid
MSSRSPPPRDRRMRTERTSYRDAPYRRDRDGRRGPSRSASDLGNNCKRPGHFARDCPNVSVCHACGLSGHHWQLNVLPKNLCWXNCKEPWGTRVKWPAPN

SEQ ID NO: 80840 - protein, 264 aa, Streptococcus pyogenes MGAS8232
MENMFSLQGKITLITGASYGIGFEIAKAYAQAGATIVFNDIKQELVDKGLAAYRELGIEAHGYVCDVTDEAGIQQMVSQIEDEVGVIDILVNNAGIIRRTPMLEMAAEDFRQVIDIDLNAPFIVSKVVLPSMIAKGHGKIINICSMMSELGRETVSAYAAAKGGLKMLTKNIASEFGEANIQCNGIGPGYIATPQTAPLRERQADGSRHPFDQFIIAKTPAARWGTTEDLAGPAVFLASDASNFVNGHILYVDGGILAYIGKQP

SEQ ID NO: 80841 - protein, 489 aa, Yarrowia lipolytica CLIB122
MTDTSNIKPVADIALIGLAVMGQNLILNMADHGYEVVAYNRTTSKVDHFLENEAKGKSIIGAHSIKELCALLKRPRRIILLVKAGAAVDSFIEQLLPYLDKGDIIIDGGNSHFPDSNRRYEELNEKGILFVGSGVSGGEEGARYGPSIMPGGNKEAWPHIKKIFQDISAKADGEPCCDWVGDAGAGHFVKMVHNGIEYGDMQLICEAYDLMKRGAGFTNEEIGDVFAKWNNGILDSFLIEITRDIFKYDDGSGTPLVEKISDTAGQKGTGKWTAINALDLGMPVTLIGEAVFARCLSALKQERVRASKVLDGPEPVKFTGDKKEFVDQLEQALYASKIISYAQGFMLIREAAKTYGWELNNAGIALMWRGGCIIRSVFLADITKAYRQDPNLENLLFNDFFKNAISKANPSWRATVAKAVTWGVPTPAFASALAFYDGYRSAKLPANLLQAQRDYFGAHTYQLLDGDGKWIHTNWTGRGGEVSSSTYDA

SEQ ID NO: 80842 - protein, 333 aa, Streptococcus pyogenes MGAS8232
MSKLLLVGEPLIRVSPNQFQPLTNACDAQLFFGGSEVNIARTLGGFGLEARLFTALPDNPVGHAFHQFLKQSGVDMTLTTWQGNRVGLYYLENGFGCRASQVYYDRCGSSFSALDKDSLDLAAIFEGIRHFHFSGISLALGKKTQDLIEILAREAKKRDICVSFDLNFRSSMIAVADAKRLFSHFAQYADIIFGMEPLLLDSDDFDMFDRNKADTTTIRERLAGLYQRYQLQAIYHTERSNDAQGSNRFKAYAYDGQFYESCEVTTPVLQRVGSGDAFVAGLLYQLLEGNEKQCNLDLAVATASLKCTVAEDQLYHSVQQVEAVLANQRDVQR

SEQ ID NO: 80843 - protein, 365 aa, Triticum aestivum
MESSSPSVPFPLLQAPVESTYRACTIPYRFPSDNPRKATPVEIQWIDLFLKSVPSFRQRAENDPTVPDAPAKAEKFAQRYTDMLEELKKNPESHGGPPDCILLCRLRELILRELGFHDIFKKVKDEENAKAMSLFEGVVQRNDEIEDGEKRAENLIRGILAGNIFDLGSAQLAEVFAKDGMSFLASCQNLLSRPWVIDDLDAFKSKWTKKSWEKAVIFVDNSGADIILGILPFARELLRRGTKVILAANDMPSINDITYLELVEIVNKLKDENGKLAGVDVSDLIVANSGNDLPVIDLSSVAPELAYMASDADLVILEGMGRGIETNLYAQMRCDSIKIGMVKHPEVAQFLGGRLYDCVFKFNEA

SEQ ID NO: 80844 - protein, 421 aa, Hordeum vulgare
MGKNGNLCCFSLLLLLLAGLASGHQVLFQGFNWESWKQSGGWYNMMMGKVDDIAAAGVTHVWLPPPSHSVSNEGYMPGRLYDIDASKYGNAAELKSLIGALHGKGVQAIADIVINHRCADYKDNRGIYCIFEGGTSDGRLDWGPHMICRDDTKYADGTANLDTGADFAAAPDIDHLNDRVQRELKEWLLWLKSDLGFDAWRLDFARGYSPEMAKVYIDGTSPSLAVAEVWDNMATGGDGKPNYDQDAHRQNLVNWVDKVGGAASAGMVFDFTTKGILNAAVEGELWRLIDPQGKPPDVMGWWPAKAVTFVDNHDTGSTQPMWPFPSDKVMQGYAYILTHPGTPCIFYDHFFNWGFKDEIAALVAIRKRNGITATSALEILMHEGDAYVAEIDGKVVVKIGTRYDVGAVIPAGFATSAHGKD

SEQ ID NO: 80845 - protein, 503 aa, Silicibacter sp. TM1040
MSDLAVNLDKLAGFLEEYRKSGITNLIGGEARPAASGQTFETTSPVDESVICSVARGGSEDIDAAAQAAKAAFPAWRDLPATERKAILHRIADGIVERAEEIALCECWDTGQALRFMSKAALRGAENFRFFADRAPSARDGQMLPSPTLMNVTTRVPIGPVGVITPWNTPFMLSTWKIAPALAAGCTVVHKPAEFSPLTARILAEIAHDAGLPPGVWNLVNGLGEEAGKALTEHPDIKAIAFVGESKTGSMIMAQGAPTLKRVHFELGGKNPVVVFDDADLDRALDAAIFMIYSLNGERCTSSSRLLIQDSIAEAFEAKLLARVNSIKVGHPLDPQTEVGPLIHKTHFDKVTSYFDIARHDGATVAAGGSRHGDTGWFVKPTLFTGATNQMTIAREEIFGPVLTAIRFTDEDEALNIANDTQYGLTAYVWTNDVTRAMRFTNQLEAGMIWVNSENVRHLPTPFGGVKASGIGRDGGDWSFEFYMEQKHIGFATGHHKIPRLGA

SEQ ID NO: 80846 - protein, 368 aa, Desulfovibrio vulgaris subsp. vulgaris str. Hildenborough
MRYTTIPMVPGPVTLHPDVLAALARDYPSGQVDEAFMPLYTHTGVALGALMGTANDVVLMTGEGMLALWGALKSTLRPGDKVLSVGTGVFGDGIGDMAASIGCEVCKVSLPYDETIGATREALAPIEEAIARFRPHMLTAVHCETPSGTLNPLAALGDLRRELGVPLFYVDAVASVGGAPVEADAWGVDLILGGSQKCLAAPPSMSFVGVSPAAWERIEEVGYQGYDALAPFRNVQRQGRCPYTPYWHGIAALAAGAEAILREGMDNVFRRHAEVAAHCRKRIAELGLSLWTAPDAVNSPTVTAVNLPVGISWPRWKQALLERDLAITGSFGPMAGKVFRIGHMGTQAHFDLVDAALDVIAGTLHGMR

SEQ ID NO: 80847 - protein, 299 aa, Triticum aestivum
MATESPFRADVLKGKAALVTGGGSGICFEIAAQLARHGAHVAIMGRRREVLDKAVAALRSEGLRAVGFQGDVRNQEDAARVLASTVEHFGKLDILVNGAAGNFLASPEDLTPKGFRTVLEIDTVGTYTMCYEALKYLKKGGPGRGPSTGGLIINISATLHYTASWYQIHVSAAKAGVDSITRTLALEWGTDYEIRVNGIAPGPIGGTPGLRKLAPDEMGKGKREMMPLFKLGETQDIAMAALYLASDAGKYVNGTTLVVDGGLWLSHPRHIPKEEVKELSKVIEKKVRASGVGVPSSKL

SEQ ID NO: 80848 - protein, 340 aa, Schizosaccharomyces pombe 972h-
MFKRRRNPKGLVLNPNASVKSSDNDHKEELINNQKSFESNVEAFMEQCAHMNRRPAWISDLDNSSLEVVRHLGEGNGGAVSLVKHRNIFMARKTVYVGSDSKLQKQILRELGVLHHCRSPYIVGFYGAFQYKNNISLCMEYMDCGSLDAILREGGPIPLDILGKIINSMVKGLIYLYNVLHIIHRDLKPSNVVVNSRGEIKLCDFGVSGELVNSVAQTFVGTSTYMSPERIRGGKYTVKSDIWSLGISIIELATQELPWSFSNIDDSIGILDLLHCIVQEEPPRLPSSFPEDLRLFVDACLHKDPTLRASPQQLCAMPYFQQALMINVDLASWASNFRSS

SEQ ID NO: 80849 - protein, 446 aa, Oryza sativa Japonica Group
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQAFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 80850 - protein, 165 aa, Streptomyces anulatus
MTTKVYFDITIDDAPAGRITFNLFDDVVPKTAENFRALATGEKGFGYAGSSFHRVITDFMLQGGDFTRGDGTGGKSIYGEKFADENFQLKHDRVGLLSMANAGKNTNGSQFFITTVLTPWLDGKHVVFGEVADDDSMALVRKIEALGSSSGRTSAKVTIAESGAL

SEQ ID NO: 80851 - protein, 470 aa, Desulfovibrio vulgaris subsp. vulgaris str. Hildenborough
MSANIGKIVQVIGAVVDVEFPSGQLPNILNALDIKNPNNTDAPDLVCEVAQHLGDNIVRTIAMDATEGLVRGMEASDTGKPIMVPVGKASLGRIMNVVGRPVDELGPINADKSLPIHRAAPEFTEQNTKVELLETGIKVVDLLIPFPKGGKMGLFGGAGVGKTVILMEMINNIAKQHGGISVFAGVGERTREGNDLYHEMKDAGVLEKAALIYGQMNEPPGARARVALTALACAEYFRDVENQDVLLFVDNIFRFTQAGSEVSALLGRMPSAVGYQPTLGTDLGALQERITSTTKGSITSVQAVYVPADDLTDPAPATTFSHLDGTLVLSRQIAELGIYPAVDPLDSTSRILDPNVVGVEHYGVARQVQQVLQKYKDLQDIIAILGMDELSDEDKLTVARARRIQRFLSQPFHVAETFTGTPGVYVKLEDTIKGFMGILNGDYDHLAEGDFYMVGGIEMALEKYKKRQEQ

SEQ ID NO: 80852 - protein, 292 aa, Oryza sativa
KIGTFGYGPLNGPFNWATLAAENEACKAGANQSPINIDDSVTIMTEKPKINIPEQEVEFENLGTTIEVIVNGTTTVAGSDFQLVQFHMHTPSEHHINGEYHPLEVHMVHQGVADPTQIAVVALMFQVASGESSSIIKSLASSVSTISTPGTKVAIPGGIDFTDVLAKVESSQMLQYSGSLTTPPCAEGVTFMIVKDPLDISVADFNAIKSVVKFNSRYIQNSLGQVNMLEVGNRAGTAEAFPAPPVVQPGEAVANGTEPVRAMTVGQRFTVTELHGQPTAIAAVVVARKRKY

SEQ ID NO: 80853 - protein, 120 aa, Magnaporthe grisea 70-15
MGWFGSSKPEETQTPVPVSEFSGMAAPSSTTGALSASQSASIKEALMKQIQTESNTANVRMLMENVNSTCFEKCVPTPGSSLSGSETACVQACTEKYIQAWNVVNASYLRRIQQEAAKAR

SEQ ID NO: 80854 - protein, 62 aa, Methanococcoides burtonii DSM 6242
MIPVRCFTCGKVIAGSWEEYKRRTGEGEDPATVLDDLKFVRYCCRRMFLAHVELVDTMAPYQ

SEQ ID NO: 80855 - protein, 572 aa, Glycine max
MEAGRKSVSLRREFCKYGSTIGFDHHSTRSFDVEVGGSRNHHLSRSGVERFHVEKEEGEIYVEHELASVVPPPEKKRKFSPIIWDLAVKEERVSSKSRISQIAALSPPRPSLPSSPGAYVVDCGNVMEEFLPDSRSYKQDVEEENDVQGWTIKKSRWDCDDVPSPRGADEKQKHGKVSSSPEIGGGSSESTITRSSGSNGRDHYSGASSDDTDSEKDFLLDSMVDVEEQSDDDYSLSDSDETGGLMHGQRNINMLQSCRSVCEFEMIKKINEGTYGVVYKARDKKTGELVALKKVKTNIERDGYPMSSLREINILLSFNHPSIVNVKEVVVDDFDGTFMVMEHMEYDLKGLMEVKKQPFSMSEIKSLMRQLLEGVKYLHDNWVIHRDLKSSNILLNHDGELKICDFGLSRQYGSPLKPYTPLVVTLWYRAPELLLGAKEYSTSIDMWSVGCIMAELIVKEPLFRGKSELEQLDKIFRTLGTPDEKIWPGLSKLPGAKANFVKQPINTLRKKFPAASFTGLPVLSELGFDLLKRLLTYDPEKRITAEDALLHDWFHEAPLPKSDFKPIFPSWQ

SEQ ID NO: 80856 - protein, 625 aa, Haemophilus influenzae 86-028NP
MTNNMNNYPLLSLINSPEDLRLLNKDQLPQLCQELRAYLLESVSQTSGHLASGLGTVELTVALHYVYKTPFDQLIWDVGHQAYPHKILTGRREQMSTIRQKDGIHPFPWREESEFDVLSVGHSSTSISAGLGIAVAAERENAGRKTVCVIGDGAITAGMAFEALNHAGALHTDMLVILNDNEMSISENVGALNNHLARIFSGSLYSTLRDGSKKILDKVPPIKNFMKKTEEHMKGVMFSPESTLFEELGFNYIGPVDGHNIDELVAMLTNMRNLKGPQFLHIKTKKGKGYAPAEKDPIGFHGVPKFDPISGELPKNNSKPTYSKIFGDWLCEMAEKDAKIIGITPAMREGSGMVEFSQRFPKQYFDVAIAEQHTVTFATGLAIGGYKPVVAIYSTFLQRAYDQLIHDVAIQNLPVLFAIDRAGIVGADGATHQGAFDISFMRCIPNMIIMTPSDENECRQMLYTGYQCGKPAAVRYPRGNAVGVKLTPLEMLPIGKSRLIRKGQKIAILNFGTLLPSALELSEKLNATVVDMRFVKPIDIEMINVLAQTHDYLVTLEENAIQGGAGSAVAEVLNSSGKSTALLQLGLPDYFIPQATRQEALADLGLDTKGIEEKILNFIAKQGNL

SEQ ID NO: 80857 - protein, 118 aa, Glycine max
ALRNTEGIVEEHTEEELMDAMVQADSTGMFICPHTGVALAALIKLRNRGVIGAGERFLLVSPAHGLKFAQSKIDYHSGLIPGMGRYANPLVSVKADFGSVMDVLKDFLHNKSPDFNKS

SEQ ID NO: 80858 - protein, 322 aa, Methanococcoides burtonii DSM 6242
MDLMDEIKKRSVYVDKGIGEFLPISHPEELYRASRYLPDAGGKRLRPAVLMLSTEAVGGDPMSVIPAAVALELVHNFTLVHDDIMDNDDVRRGMPAVHVKWGSEGAILAGDTLYSKAFEILSVMEKDPERILKCVALLSRTCTEICEGQWMDIEFENRDTVSEEEYLEMVEKKTSVLYGAAAKVGALLGGASDEVADAMYEFGRLVGISFQIQDDVIDMVTPEDILGKVRGSDLIEGKRTLIAIHALNHGVELEIFGKGGSVSPEQIDEAVSILEDSGSIKYAQDLSTETLERGKRMLDILGDSEAKEILLAVADYMVTRNY

SEQ ID NO: 80859 - protein, 564 aa, Bordetella petrii
MARGYAIGRAVVMGAASLEVAHYRIAPEDVAAESERLTQALARAQDDLLQMADSLPADAPRELGAMLNVHRLLLADPLLAEQTRALIAERHYNAEWALAAQGQILGEQFDAMEDEYLRERGADVRQVIERVLQVLSGSTAMLPDAGALDGDDPLVVVAHDISPADMLRLRGGRFAAFVTDLGGPTSHTAIVARSMGVPAVVALGNVRELVRDGDTLVVDGAAGVVLVNPGPVMLQEYRDRHVAYMAERAELALLRDERAVTLDGIDIVLNANIELPDEAAAALAAGAQGIGLFRSEFLFMGRQSLPDEEEQYQAYASVVRVMGGRPVTIRTLDIGADKTLDDEATVATNPALGLRAIRYCLAHPEMFATQLRAILRASAHGHVRLLLPMVTHMHEVTAALAAIESARRELDASGHAYAERLEVGAMVEVPAIAIAIEPFAQALDFLSIGTNDLIQYTLAIDRGDHDVASLYDPLHPAVLRLVANTINAGARVGKPVAVCGEMAGDARLTRLLLGLGLTEFSMHPQQLLDVKREIRRAHSNDLRVKVAAALNRALPVDLDLLDQG

SEQ ID NO: 80860 - protein, 851 aa, Aspergillus oryzae
MSPPQLPNHHHMVVLQGDFVQIPEFNLPEPYTYTKTVYPQTTLANLHERIYDASILVLCAFPVDATALSEEKSRTDNDNAGFPSSSVLEGSPVTSAQSFTTRSLLVGLIIGALITFSNTYFGLQTGWISTMAMPSALIGFSVFKVFSKHLSYPFTPIENVLIQTVAGAVGTMPLGCGFVGVIPALEFLIRDGEDGPSGDGGVGEGGPLKLSFWKLVIWSLGVCLFGVVFAVPLRKEVIVREKLRFPSGTASALMLRVLHGSGQSDEKAKGRVSDNTGLGRDEEEEAPILSRVSEESGTGTLLRKTTLEEESSDKKDWRSKMRLLVGAFAVSGVYTLFSYFVPQVRDIPIFGLSLAHNWLWTLNPSPAYVGQGIIMGPSTCMHMLFGAVLGWGILSPFAKARGWAPGPVDSWDDGSKAWIVWVSLAIMLADSIVSLGWLVLRPAVKHAPKLKAKLLSSRLWRRVSSRGSAEYHPHDYISYSALSPISEESSIPSHLPALLAGMQAEAADEEDAPPSQLISTRTVLILLPLTLILNVVCMHFVFGDVMSPLLSSLATLLAVLLSIMGVRALGETDLNPVSGISKLTQLLFSLATPASHFSRRTALVTNLLAGAVSESGALQAGDMMQDLKTGHLLGASPKAQFYGQMIGSLVGAVLSTAVYKMYVNVYEVPGPMFQTPTAYVWIFTARLVTGQGLPPMAWEAASIAGAVFVVVTILRIVGTSSFANGGKRDATAWWRSYIPGGIAVAVGIFNVPSFTLARAIGGLIAWWWSRKHAKAQDLEPPTQAANEEQPQGNVRGADTRNPAAGPAPGQAIKDADAASSTVVVLASGLILGEGIISIVNLLLASGGVPHL

SEQ ID NO: 80861 - protein, 397 aa, Streptococcus pyogenes MGAS8232
MPKLSKRVLEMKESVTLAAGARAKALKAQGRDVLNLTLGEPDFFTPKHIQDKAIESIQNGTASFYTNASGLPELKAAIATYLKNQYGYHLSPDQIVAGTGAKFILYAFFMAVLNPGDQVLIPTPYWVSYSDQVKMAEGQPIFVQGLEENQFKVTVDQLERARTSKTKVVLINSPSNPTGMIYGAEELRAIGEWAVHNDILILADDIYGSLVYNGNQFVPISTLSEAIRRQTITVNGVAKSYAMTGWRVGFAAGEPEIISAMSKIIGQTTSNLTTVSQYAAIEAFCGSQSSLEEMRLAFEERLNITYPLLCQVPGFEVVKPQGAFYFFPNVKKAMEMTGFSDVTSFANAILEEVGLAVVSGAGFGAPENVRLSYATDIETLKEAIRRLHVFMESNEIN

SEQ ID NO: 80862 - protein, 378 aa, Chlamydomonas reinhardtii
MGKLGELLSHPNEIMPLLRMYRAAKRATKLPKDPDLAFCYGMLNDVSRSFAIVIQQLPNPLRDSICVFYLVLRGLDTVEDDMALDVDFKLPELRRFHERIYDRGFTMECGYNHYKRLMAQFGVVVNVFLALPPPHQAVIADITRRMGYGMAEFIEKEVVTVADYDKYCHYVAGLVGIGLSQLFAASGLEANSIGTEEDLANHMGLFLQKTNIIRDYLEDILEEPAPRMFWPRDIWGKYAPALADFKEPANRGAAVRCLNDMITDALRHLPYCLAYMEQLRHVMVFRFCAIPQIMAAGTLAACYNNGRVFEGVVKMRRGETARIFETCNDLGDLYTWFLQFLAAMEAKVDPTDPSLPLTRQRIAEARKACAAKLTEVSV

SEQ ID NO: 80863 - protein, 227 aa, Synechococcus sp. WH 7805
MSTKSLVVSPSILSADFSRLGEEVKAVDQAGADWIHVDVMDGRFVPNITIGPLIVDALRPVTAKPLDVHLMIVEPEKYVADFAKAGADIISVQVEACPHLHRNLAQIKDLGKMAGAVLNPSTPLSTLEYCLELCDLVLIMSVNPGFGGQSFIDNQVQKIRDLRRMCEEKGVDPWIEVDGGVKGGNAWKVIEAGANAIVSGSGVFNQPDYAAAIQGIRDSKRPEAVLV

SEQ ID NO: 80864 - protein, 380 aa, Glycine max
MGEDGYSWIRRTKFSHTVCHRLDPARLGSIPISVQSEQKSRPAASKAQRHPITNKQRSLSPLPETYLSEAFREARHEQKRFSTPNPRREKRIMGKLLNKDSRETKESSSKSPSHSPNRQVKSKNRKDSAWTKLLDNGGGKITAVETAEEWNVDMSQLFFGLKFAHGAHSRLYHGVYKEEAVAVKIIMVPEDDENGALASRLEKQFIREVTLLSRLHHQNVIKFSAACRKPPVYCIITEYLAEGSLRAYLHKLEHQTVSLQKLIAFALDIARGMEYIHSQGVIHRDLKPENVLINEDNHLKIADFGIACEEASCDLLADDPGTYRWMAPEMIKRKSYGKKVDVYSFGLMIWEMLTGTIPYEDMNPIQAAFAVVNKVCSVVI

SEQ ID NO: 80865 - protein, 437 aa, Synechococcus sp. WH 7805
MHIAVVGLSHRTAPVEVREKLSIPEQTMEESLQNLRGHDQVLEASILSTCNRLEIYTLVRNPELGISAVREFLSGHSGLETRDLKPHLFAYHHEDAVAHLLRVAAGLDSLVLGEGQILSQVKKMMRLGQEHKSLGPILNRLLTQAVSTGKRVRSETNLGTGAVSISSAAVELAQLKLGQTRGLDELVTLEDEQVAVVGAGRMSRLLLQHLQAKGATGVVLLNRTVARAEALAADFPSLPVQCRPLKDLDLCLSTCSLVFTSTAADDPIIDAQRLSTLNRRSLLRLIDIGVPRNIAADVVGLGGVEAHDVDDLKEVVERNQEARQQVAREAQGLLDEESRMFLEWWDSLEAVPTINRLRSSLESIRSEELMKALSRMGPDFSARERKVVEALSKGIINKILHAPVTALRSPQPRSDRQNALSVVERLFALQPEEDSDR

SEQ ID NO: 80866 - protein, 223 aa, Cryptococcus neoformans var. neoformans JEC21
MASHLANIFGTEQDRVNCSFYLKIGACRHGDRCSRKHIKPQFSQTILLPNVYNNPGHTPEGQNMSAEELQADFDRFYEDFFIELAKYGNLQEMIVCDNVGDHLLGNVYARFEYEAEAARAVQALNDRWYAMRPLHAELSPVTDFRESCCRQNELGECKREGFCNFMHLCHPTRSLVSALQASQRVSRRRAHKGAEVDSGDMGWTPAVAAGGEGDLGWMPERRY

SEQ ID NO: 80867 - protein, 431 aa, Synechococcus sp. WH 7805
MKRVLAIILGGGAGTRLYPLTKMRAKPAVPLAGKYRLIDIPISNCINSNINKMYVLTQFNSASLNRHLSQTYNLSAGFGQGFVEVLAAQQTPESPSWFEGTADAVRKYQWLFQEWDVDEYLILSGDQLYRMDYSLFINHHRSTGADLTVAALPVDAKQAEAFGLMRTDQDGRILEFREKPKGDSLLEMAVDTSRFGLSADSAKERPYLASMGIYVFSRDTLFDLLHQNPTHKDFGKEIIPEALARGDRLKSYVFDDYWEDIGTIGAFYEANLALTQQPTPPFSFYDAEFPIYTRPRYLPPSKLVDSQITDSIIGEGSILKSCSIHHSVLGVRSRVEDDVVLQDSLLMGSDFFESSSERAVLKERGGIPLGVGKGTTVKRAILDKNARIGSNVTIVNKDHVEEADRPEHGFYIRNGIVVVVKNASIPDGTVI

SEQ ID NO: 80868 - protein, 511 aa, Pseudomonas syringae pv. syringae B728a
MSQDPHALLNYYARKILTSRVYDVAIETPLQGARQLSERLGNQVLLKREDLQPVFSFKIRGAYNKLAQLPAEQTARGVVTASAGNHAQGLALAARELGIKATIVMPRTTPEIKVEGVRSRGATVVLHGDSFPEALAYSLKLVDEQGFVYIHPYDDPDTIAGQGTVAMEILRQQPGQLDAIFVPVGGGGLIAGIAAYVKYLRPEIKVIGVEPDDSNCLQAAMAAGERVVLSQVGLFADGVAVAQIGHHTFEVCRHYVDEVITVSTDEICAAIKDIYDDTRSITEPSGALGVAGIKKYVEQRGVSGQTLVAIDSGANVNFDRLRHVAERAELGEGREAIIAVTIPEQPGSFKAFCEAIGKRQITEFNYRYHTDREAHIFVGVQTHPENDPRSALIASLTGQGFPVLDLTDNELAKLHIRHMVGGHAERVDDEVVLRFEFPERPGALFNFLNRLGGRWTISMFHYRNHGAADGRVVAGLVVPEEERHLVGAALDEIGYRYWDESENPAYRLFLG

SEQ ID NO: 80869 - protein, 472 aa, Synechococcus sp. WH 7805
MSKAHFGLIGLGVMGENLVLNAESNGFSSVVYNRTYSKTEEFLSGRGAGKNIQGATDLQDFVSKLERPRRILMMVKAGGPVDAVIEQISPYLEEGDLLIDGGNSEYHDTERRVAELESKSFGFIGMGVSGGAKGALEGPSMMPGGTKASYDAIESLVQKMAAQVEDGPCVTYIGPGGSGHFVKTVHNGIEYGIEQILAEGYDLMKRVGGMNGTQMADVFAHWNSTEELCSYLVEITEVCLRTKDPDDGSDLVEKIQDKAGQKGTGLWTVVSALQMGASVPTIYASLNGRVMSSMKEQRIKAEPILKGPAIKPFDMGTPADGMAPLMDAMVLACMASYAQGMELMRIASAEHNYNLHMPAIAQIWKGGCIIRSRLLKRIQDAFNADPQLANLLIDPWFADQVNRRLPGLAKVVAGAAEAGIPVPCLSSTLDYINSYRTSRLPQNLVQAMRDCFGSHTYARVDKDGVFHTEWLN

SEQ ID NO: 80870 - protein, 296 aa, Chlamydomonas reinhardtii
MSQRDADSFISKNEREFILKALAEDVRLDGRRPNDMRKPKFQFSLDDRSCTVAQGSTRVMAVVSAALEAPYPDRPSEGPLRFNVEFSPMASPAFEPGKPGEDAIQVARLIERGLRQSGAVDQEALWVGAGRVRVWALRVDCHVLDHGGNLLDCCFLAALAALMAFRKPEVEVGGESGSEIIVHPPEVREPVPLTIHHLPVAVTFALFQAGDMLVADPTWKEEAAAAGSCTVVMNPAQEVCCVHKADGIGLSPEQFMRCVRLAGRQAEEVVAGLKKALEGHEVARVQVRGAGRGTGR

SEQ ID NO: 80871 - protein, 331 aa, Synechococcus sp. WH 5701
MAIAMGINGFGRIGRLVFRRSFEIEGIDVVAINDLIDLEYIAYMLRHDSTHGRFRGEVETRDGQLIVNGKAIRVTSERNPADLNWGAVGADVVLESTGLFLTDASARAHIQAGAKKVVLSAPSKDDTPMFVMGVNHHTYAGQDIVSNASCTTNCLAPIAKVLHDNFGIRDGLMTTVHAMTATQKTVDGPSAKDWRGGRGAGQNIIPSSTGAAKAVGKVIPSLNGKLTGMAFRVPTPDVSVVDLTVNLERPASYEAIKDAMKAAAAGPMAGVLGYTEAEVVSSDFLGETCTSVFDAGAGIALTDTFVKVVAWYDNEWGYSCKCLDLIRHISA

SEQ ID NO: 80872 - protein, 354 aa, Synechococcus sp. WH 5701
MITRRTFATASLVLVPLSLAAEMLHWGETVVFVCSGLAILPLAIWLSTATEKLSVALGPSLGALLNAVFGNASELIIALVALRAGLVDIVKASITGTVMANLLLALGLSMFLGGLGRSEQRFQPVVARVNGSAMTLAVLAILIPSIAVISTGAAPERTEAFSGFVAWVLLLVYLLTLIFSLRTHRALYEVAEVECRDEESPASPMPWLLVLIGATTALALVSEIFVGVVQSVTAQLGLTDLFTGVVLLPLLGGAAEFLTAITMARRNQMDLAVSVAMGSTLLVALLVVPVLVLTGPLLGHPLDLSFELYELVAVITAVLVSNLVSLDGRSDWLEGVLLLAAYVILAAGLYFQAL

SEQ ID NO: 80873 - protein, 393 aa, Bacillus halodurans C-125
MTSSTSQRTRLSTRVQSIQPSGIRRFFDLASKMENIISLGVGEPDFVTPWNVREASISSMERGFTAYSANAGIIELREAISRYLYERFHIGYDPESEILVTVGASEAIDIGMRAIIDEGDEVIVVEPSFVSYAPLVTMAGGVPVPVGTHIDTDFQVTPAQIEAAITPRTKAIILCFPNNPTGSIMGKEELEAVAKVISGNDLIVFSDEIYAELTYDGTHVSLASMDGMRERTVLISGFSKAFAMTGWRLGYVCAPDDILSAMLKIHQYSLMCAPTMAQHGALEALETGMDDVHRMVQSYRQRRNFVVKTFTEIGLTCPMPGGAFYAFPSVKETGLTSEEFAERLLMEEHVAVVPGNVFGEGGEGHIRCSYATSMEHLETALERIGRFVQKCKQ

SEQ ID NO: 80874 - protein, 207 aa, Aeromonas veronii
MYKNSPAMRSSPRNALIPMVVEQTAKGERSYDIYSRLLKERVIFLTGQVEDHMANLVVAQLLFLESENPDQDISIYINSPGGAVTAGMSIYDTMQFIKPDVSTVCMGQACSMGAFLLAGGAKGKRFCLPNARVMIHQPLGGFQGQASDIQIHAQEILKIKNTLNERLAFHTGQDMATIERDTDRDNFMSAEQAVAYGLVDGVLSQRS

SEQ ID NO: 80875 - protein, 306 aa, Xanthomonas axonopodis pv. citri str. 306
MSTTVPMAQRSYYEADARERIDGLLDVGSLREFVGPRRRLISPHLAQLETPGAFDDGIVVGEGTLRGRNVLIAAQQGAFMGGGVGEVHGAKLTGLLERAATTQPAAVLLLLDTGGVRLHEANAGLIAISEIMRATLSARAAGVPVLALIGSGNGAFGGMGIVARCCSAVIMSEEGRLSLSGPDVIETVRGVEEFDARDRALVWRVTGGKHRYLLGEAQTLVADRIDAFADAALATLDALTEATGEAALQALERAQQQLAARIDAYGDCRDGLEIWTRQGIVDAQRLPLLDTEAFLAATADRSLPWT

SEQ ID NO: 80876 - protein, 164 aa, Brassica napus
  misc_feature (124)..(125): Xaa can be any naturally occurring amino acid
  misc_feature (131)..(131): Xaa can be any naturally occurring amino acid
  misc_feature (143)..(144): Xaa can be any naturally occurring amino acid
  misc_feature (149)..(149): Xaa can be any naturally occurring amino acid
  misc_feature (152)..(153): Xaa can be any naturally occurring amino acid
  misc_feature (160)..(161): Xaa can be any naturally occurring amino acid
MLFSKDLPSPTSIFTAYASMAGYMMMIRSMAHELIPAPIQEFIYSTLRSLFFRSSSTTLTLTIDDDNMGMDNEIYLDAQTYLSTKISPDAVRLRISKGHKDKHVTLHLSNGEIVVDVFQDVELXXRFVTDXGDKTNGGGDDDXXSEYFXLSXXQEAQRLXXNSY

SEQ ID NO: 80877 - protein, 361 aa, Nicotiana longiflora
DNKPSPSPSPPAKSPPSQVKSSLPSPAKSPPTPPAKSPPPPSPPAQPPKQSPPPPPAKQPPPPPPSAKPPVKPPSPSPAAQPPATQRATPPSQSPPMQRASPPKLPLPPPPAQLPIRKPPPPATQLPIRKPPPPAYTQPPFKTPPPPPIRSSPPPQDAYDEPPIVDSPPAPPSDHEPPVVEPPPSDYEPPIVEPTPPTDQPPIITPSPPTLTPPITPPVRLPPPLFHPAGTPLIIVGRVHCKSCNNRGLPTLYKASPLQGAVVELVCHNNARKANVQTAMTDKNGEFVIIPMSLTRADVHKCKVYLVKSPKPICNVPTNFNGGKSGALLKPRPGPVQPPMFDYHGVGPSIFEASSKLPCKK

SEQ ID NO: 80878 - protein, 146 aa, Zea mays
KSGWAESQPQVASRTFASAIQIGDPVSVDRAVVALKATDGIVEEATEEELMNAMSLADRTGMFACPYTGVALAALFKLRDQRVIGTNDRTVVVSTAHGLKFSQSKIDYHDSKIEDMACKYSNPPVSVKADFGAVMDVLKKRLKGKL

SEQ ID NO: 80879 - protein, 434 aa, Helicobacter pylori
MPLKSLKNRLNQHFELSPRYGSVKKIMPNIVYADGFNPSVGDVVKIEKSDGSECVGMVVVAEKEQFGFTPFNFIEGARAGDKVLFLKEGLNFPVGRNLLGRVLNPLGQVIDNKGVLDYERLAPVITTPIAPLKRGLIDEVFSVGVKSIDGLLTCGKGQKLGIFAGSGVGKSTLMGMITRGCLAPIKVIALIGERGREIPEFIEKNLKGDLSSCVLVVATSDDSPLMRKYGAFCAMSVAEYFKNQGLDVLFIMDSVTRFAMAQREIGLALGEPPTSKGYPPSALSLLPQLMERAGKEENKGSITAFFSVLVEGDDLSDPIADQARSILDGHIVLSRELTDYGIYPPINILNSASRVAKDIISESQNLYARKFRRLYALLKENEMLIRIGSYQMGNDKELDEAIKKKALMEQFLAQDENALQPFEQSFQQLEEILR

SEQ ID NO: 80880 - protein, 322 aa, Ehrlichia ruminantium str. Welgevonden
MKLRNVSKNNLNKEDTKLSIEQFGGNVEWFNITKTLSESLPYIQQFSGETFIIKYGGAAMTDKKLAESFAHDVVLLKQLGINPIVVHGGGNKINEFLEKINKKSTFINGLRITDAETLEIVEMVLCGLVNKNITQLINNAGGNAIGLCGKDANLIEAKKICYTYKENQSNNVEKILDMGFVGEPHDINTDLLFFMEESDFIPVIAPVCSGENNLTYNVNADLVAGALANAMAAAKLIILTNVSGVTDSNGNLISELSVSHAENLIDNGTAHTGMIPKLQTCVRVVKEGYGSAHIIDGRIPHVLLLELFTIHGTGTMVVNSGV

SEQ ID NO: 80881 - protein, 364 aa, Flavobacteria bacterium BBFL7
MKAGIVGLPNVGKSTLFNCLSNAKAQSANFPFCTIEPNVGVVNVPDPRLKKLEELVNPERVIPATVEIVDIAGLVKGASKGEGLGNQFLGNIRETDAIIHVLRCFDNDNIVHVDGKIDPISDKETIDIELQLKDLETVDKKLEKVKRAARTGNKEAQKEEEALMKVKDALEAGKSVRTIDFDEAIHDEFIKPLQFITDKPVLYLCNVDDASAVTGNAYVDQVREMVKDENAEVLVLAVGTEADIAELDDYEEREMFLADIGLEEAGSAKLIRSAYKLLNQQTYFTAGVKEVRAWTVKIGATGPQAAGVIHTDFEKGFIRAEVIKYDTFVEYGSEAKVKEAGKLKIEGKDYIVQDGDVMHFLFNV

SEQ ID NO: 80882 - protein, 469 aa, Glycine max
MAATRPVQCLLRRVCRGSRTIGVATEVNASSSSSSQKIIDKEYEHSAHNYHPLPIVFSQAKGTSVWDPEGNKYLDFLSGYSAVNQGHCHPKILKALQEQAQRLTVSSRAFYNDRFPVFAEYVTNMFGYDMVLPMNTGAEGVETALKLARKWGYEKKRIPKDEAIIVSCCGCFHGRTLGVISLSCDNEATRGFGPLLPGNLKVDFGDAEALERIFKEKGEHIAAFILEPIQGEAGVIFPPDGYLKAVRDICSKYNVLMIADEIQTGLARTGKMLACEWEEVRPDIVILGKALGGGVIPVSAVLADKDVMLCIQPGQHGSTFGGNPLASAVAIASLEVIKNERLVERSAQMGEELAGQLLKIQQQYPDYVKEVRGRGLFIGVEFNSKNLFPVSGYELCKKLKYRGVLAKPTHDTIIRFTPPLCISLDEIQQGSKVLADVLEIDLPKLQKTKPKDAAPVASSACDRCGRVLY

SEQ ID NO: 80883 - protein, 259 aa, Vibrio angustum S14
MKKTIIAMTIAGLFLVGCDQAKQDTATDSTSAAQHSTVEMKDKVTEQSSTALDATKDTVSDAADVVKDQTNKMVDKASELSDSAVQKASEVTDSVKEKTADVVDKSKQAVDDSVDSMKEKATELKDSLTNSSAEEKTSAEVTEMNSSVSEVKDSVADDSKALMDATKENASDAINSAEGAADHSMDEMKHSATEMKDAAMDKTEVAEDNVKSAANDAMKSVDDSAEAAQDKAAEMTDSAVDKTENAAGDLEKKASDLLN

SEQ ID NO: 80884 - protein, 296 aa, Haemophilus influenzae 86-028NP
MGHFSEELQQVQTRINRFLEAQFEGIESHNALLLEAMKYALLLGGKRVRPFLVYATGQMLGAEKQTLDYAAAAIEAIHAYSLIHDDLPAMDDDNLRRGHPTCHIQFDEATAILAGDALQSFAFEILTKTPNISAEQKLALIQILAQGAGVQGMCLGQSLDLISEHKQISLSELELIHRNKTGALLIAALKLGFICSPHFTDKRLEQSLTQYAEAIGLAFQVQDDILDIEGDSAEIGKQVGADLDLDKSTYPKLLGLSGAKQKAQDLYQSALSELEKIPFDTTALRALAEFVITRKS

SEQ ID NO: 80885 - protein, 436 aa, Saccharomyces cerevisiae
AVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQQFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 80886 - protein, 436 aa, Saccharomyces cerevisiae
AVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDQGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 80887 - protein, 517 aa, Chlamydomonas reinhardtii
MSDEAPPTKRQCIEQVQSHAGPIDANGEVKVEPRSDAAVAAQQAAQAKERSAASQLVQEPAGPGPSSSSARDRPYIAPGAYSQREEALIKREQDGDIAFRYVFNNDDPQNLIYLVGLKNIFSKQLPNMPKEYIVRLVFDRRHRSVALLKRNGTVIGGITYRAFHEQAFGEIAFCAVTSHEQVKGYGTRLMNQTKEFARTVDRLTHFLTYADNNAVGYFEKQGFTREITLARERWQGYIKDYDGGTLMECVMHPRVSYTALPDLIRTQRLALDDRVRQVSNSHVVRTGLRHFQEEDARLAAATAAAAAAAGAAGGRGAGGVGAGAPAGDAAAATADTDPALRRRMLDIGGIPGVREAGWSPDMVQQGPRFRLLLDEAGAGPAVEAGSEALHRFLVLLLEHVKGLEDAWPFRERVAVQDAPDYYDIIKDPMALDVMEERLASRGYYVTLDIFTADLRRVFDNCRLYNAPDTIYYKLANKLEAQVNAFMSNHVLYEDEAGPAAAAAAAAAGTGAGAGAGR

SEQ ID NO: 80888 - protein, 201 aa, Triticum aestivum
FFTVSSFIYKSHSNGCDSSLWYRSPELLLGTKEYSTAIDMWSVGCIMAELLAKEPLFNGKTEFEQLDKIFRTLGTPNEKIWPGYAKLPGVKVNFVKQPYNRLRDKFPAASFSGRPNLSEAGFDLLNKLLTYDPAKRISAEAALEHPWFSEVPLPKSKDFMPTFPALNELDRRTRRYMKSPDPLEEQRLKELQAKGNRGLFG

SEQ ID NO: 80889 - protein, 387 aa, Arabidopsis thaliana
MATMITNLRRDLIEEIISRVPLRSMKAVRLTCKSWNNISKSEIFTKMQIDKATTREGKTMMISVMPHNLSLMSVAVDDVDPSVEFKGQLSFLCNQVSIHKVIHCEGLLLCFLKDHTRVVVWNPYSGQTRWVKLRYPHPPSPSKWDWFRYALGYEDKGSCRSVKFLRFLDYLPEEPENQNVCYEIYDFDSDLWTTLDVTSHSWICYSSCGVFLKGNAYWPVVKSSSEANIDHIIYFDFTRESFGPPLPLPFGATDRGYSYVNLSCVKEEKLAAFFQHYISYKYEFEIWVTTKIEAEMVSWSKFLRMDLGPNIDIPITFFIDEEKKVFMGFEHREYPKRFINIIGEAKYLRKLDLQVPQGQYCCPPLCSYVPSSIQIKKPALRQKDRAK

SEQ ID NO: 80890 - protein, 106 aa, Oryza sativa Indica Group
MAREPSPEIDDELFNEVYGKAYSGPVATTTNNVMPRVNDEKRPLEREKSDEEDGPPDPNAVPTDFTSREAKVWEAKAKATERNWKKRKEEEMICKICGESVFSTLQ

SEQ ID NO: 80891 - protein, 468 aa, Bacillus cereus ATCC 14579
MNKGRVTQIMGPVVDVKFDGGKLPEIYNALTVKQSNENGSMNLTFEVALHLGDDTVRTVAMSSTDGLVRGTEVEDTGKAISVPVGDATLGRVFNVLGDAIDLDGELPADVHRDPIHRQAPAFEELSTKVEILETGIKVVDLLAPYIKGGKIGLFGGAGVGKTVLIQELINNIAQEHGGISVFAGVGERTREGNDLYHEMSDSGVIKKTAMVFGQMNEPPGARQRVALTGLTMAEHFRDEQGQDVLLFIDNIFRFTQAGSEVSALLGRMPSAVGYQPTLATEMGQLQERITSTNKGSITSIQAVYVPADDYTDPAPATTFAHLDATTNLERRLTQMGIYPAVDPLASTSRALSPEIVGEEHYEVARQVQQTLQRYKELQDIIAILGMDELSEEDKLVVHRARRIQFFLSQNFHVAEQFTGQKGSYVPVKNTVSGFKEILEGKYDDLPEDAFRLVGGIEEVIENAKKMMA

SEQ ID NO: 80892 - protein, 384 aa, Zea mays
MAAADASSLPPSAITCRAAVAWGPGQPLVMEEVEVAPPGPMEIRVKVVSTSVCRSDVTAWQSKAQLDLFPRVFGHEASGVVESVGEGVTEFQVGDHVLTVFIGECKSCKHCVSGKSNMCQKLGLERKGVMHSDQKTRFSVKGKPVYHYCAVSSFSEYTVVHSGCAVKVGLTVPMDRVCLLSCGVSSGLGAVWNVANVSKGSSVAIFGLGTVGLSVAQGAKLRGASKIIGVDTNPEKQEKGKSFGVTDFINPDELSEPVQQVIKRITDGGVDYSFECVGDSGVVSTALQSCSDGWGVTVTLGLPKGKLEVSTHYAFLLSGRTLKGSMFGGWKPKSDLPSLVDKYAAKEIQVDGLVTHDIPFNEINKALELMLENKCLRCVIHMPR

SEQ ID NO: 80893 - protein, 237 aa, Nicotiana langsdorffii
PPPPAKSPPPPPAKSPPPPPPPAQPPKQSPPPPPAKQPPPPPPSAKPPVKPPSPSPAAQPPATQRATPPSQPPPMQRAPPPKLPLPPPPAQLPIRQPPPPATQLPIRKPPPPAQLPIRQPPPPATQLPIRKPPPPAYTQPPFKTPPPPPIRSSPPPQDAYDEPPIVESPPTPPSDHEPPVVEPPPSDYEPPIVEPTPPTDQPPIIITPSPPTLTPPFIPPITPPVKLPPPSIHPAGK

SEQ ID NO: 80894 - protein, 504 aa, Glycine max
MGKHKLLLLVLTLHLLLLFATLHVSAAPSTTSPAKIVNGFLSNAVPAFTKWVWSLKATTKTAVSSRSMMKFESGYNVETVFDGSKLGIEPYAVEVLPNGELLILDSANSNIYRISSSLSLYSRPKLVAGSAEGYSGHVDGKLREARMNHPKGITVDDRGNIYVADTTNMAIRKISDSGVTTIAGGKWNRGGGHVDGPSEEAKFSDDLDVVYVGSSCSLLVIDRGNRAIREIQLHFDDCAYQYGSGFPLGIAMLVGAGFFGYMLALLQRRLGTIVASQEAQVPVMVTSSVPPSPYQKPLKSVRPPLIPSEYEPDKQEEGFFGSLGKLLANTGASMVEIIGGLFPSFRRKSLRYQFQRQPLIQQPQKQVNAWPVQESFVIPDEDQPPSIDTRAPTPRKTYPFMSKDAEKMQQLRQSRAFYSGWDGDLQQQQQQQQQKHHRHQYRSSIPHTYYEQSHETTNEIVFGAVQEQDRKQESVVIKPVDYGESMYEHNIRSRMSSMGYGYRY

SEQ ID NO: 80895 - protein, 584 aa, Gibberella zeae PH-1
MASPWLKVMNDTSQPANSSTTFPGILDSVLTTAGQASPLLQLFLFIYKLVGAQLGLDPSILLTCLGCLWGLSKLFDQFLSEQQDIATNRHLTAQTVYKSAWDEEEDSTDALATTMVEDNQDSPKYLNFASDAARCNPRYVPAMGTTGFWHNRTFFRVYRRKETLQNTGGWGGMAKDVEELKISCFGRSTDPIKSLLKDAKTAYFLDTRYKTAIFRPRIKENRRESWSMWQQVARRPIRPMSTVILENQEKHEVLRDINEYLHPATPKWYAFRGIPLRRGYLFHGPPGTGKTSFSFALAGVFGIDIYVISLQDPTISEEDLAVLFTRLPRRCIVLLEDIDTAGLRRPHNEEEGEEEAAEDTGDKDAQPKKKSKPKKETDSDSDASSSEEERKKRRRKRRNKRSRGNSENKSTNNILAVESISLSGLLNAIDGVASHEGRILIMTTNKPEALDEALIRPGRVDVQVGFKNATGEQAAELFYRMYEVSRNKPMPMSKTGAAAPKTQNGSIHGAVDIKGPATDVDDELEETSKEFGNLIPEDLLSPAEIQGFLLKRKKSPKKALEDAKGWIEATVKQKELKSKVATVQ

SEQ ID NO: 80896 - protein, 261 aa, Rubrobacter xylanophilus DSM 9941
MTVELHHVVEGPADAPVLVLSSSLGTTHRMWDPQVPALRERFRLVRYDHRGHGSSPVPPGPYSIAELGQDVLAMLDGLGVERFSFCGLSLGGMVGMWVASEVPERVERLVLCCTSALLGPRELWDERARVARSEGMEALVEGVVERWFTPALHQERPEDVERAKRMLAATPPEGYAGCCEAIREMDLRDRLGRIQAPTLVISGSDDPATPPEHGERLREAIPEARTVVIERAAHLANIERPEPFARALLEHLSPVLEGRSS

SEQ ID NO: 80897 - protein, 369 aa, Escherichia coli O157:H7 EDL933
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFDLARRFGATDCINPNDYDKPIKDVLLDINKWGIDHTFECIGNVNVMRAALESAHRGWGQSVIIGVAGSGQEISTRPFQLVTGRVWKGSAFGGVKGRSQLPGMVEDAMKGDIDLEPFVTHTMSLDEINDAFDLMHEGKSIRTVIRY

SEQ ID NO: 80898 - protein, 208 aa, Pichia pastoris
MKPYHHAKSRPIGSYLYFGVFTVALTFLTWLKYDAELFAQQVHSKDIYDPQFNITLPIDGPTFTPSKNYSISVQNAAVASDIEQCSKLGVSILQQGGNAADSAVTVALCIGTINSYSSGIGGGGFIVSKLIDNPTALSFDCREMAPSKSFKEMFNYHEEKARVGGLAVAIPGELKGLYELFQHHGSGNVEWKDLILPVAELAEVGWTV

SEQ ID NO: 80899 - protein, 329 aa, Magnaporthe grisea 70-15
MLNTPSDGELTLAVLGCGTMGIAILSGILTSLQDMAASGVLSASASGTSTPVHPEVPDRLPSRFIACVRRPESAKKVKVALAEHLSVVKVVQNDNLASARQAGVVILACKPQMIGDLLSKPGIAEALRGKLLISICAGVTVPQIEGHLEQALGSKDVENPCRVVRAMPNTASMIRESMTVVATTEPPLPPQVSSLVTWIFKRIGDVVYLPASTMDASTALCGSGPAFFALMLEAAVDGAVAMGLPRAEALRMAAQTMKGTAALVQHGDHPALLRDKVSTPGGCTIGGLLVLEEGIVRGTVARAVREATVVASQLGQGVQGVNGTRPMRH

SEQ ID NO: 80900 - protein, 515 aa, Ehrlichia ruminantium str. Welgevonden
MLRFYCNVRYRMSSLTGKVKGRARKIKGDADIRINESTENVGLVIRVMTAVVDIKFPSGKVPKILNALESKEIYNGKKLVLEVSQHISDSIVRCIALDSTDGLSRNDEFIDTGAPISVPVGRATLGRVFDVLGNPIDNCGPLTKSDYSIKPIYSEVPKLTDQKVTTEILVTGIKVIDLLAPYLKGGKVGLFGGAGVGKTVLIMELIHNIAKAHKGVSVFAGVGERTREGNDLYHEMIESGVINLEEKDKSQAVLVYGQMNEPPGARLRVALSALTMAEYFRDVENQDVLFFVDNIFRFTQSGSEISALLGRIPSAVGYQPTLAAEMGAMQERITSTNRGSITSVQAIYVPADDLTDPAPATSFAHLDSTTVLSRQIAELGIYPAVDPLDSASQALSIDIVGEKHYEVSKEVQRILQTYKSLQDIIAILGMEELSEEDKLIVARARKIQRFLSQPFHVAEVFTGTPGVFVSLEDTVSSFKDIVEGKYDHLPEAAFYMVSNINEAVKKAELLQKEGK

SEQ ID NO: 80901 - protein, 145 aa, Mycoplasma pulmonis UAB CTIP
MNKTKEQRLKELTTLQYKVTQEGQTEKAFDNEYNNHYEEGIYVDIVDGTPLFKSQDKYNSGSGWPAFTSPIKKDEIVENADFSYGLRRVEVKSKNAQSHLGHVFTDGPKDKGGLRYCINSAALRFIPKKDLEKEGYKEYLKLFED

SEQ ID NO: 80902 - protein, 269 aa, Vibrio angustum S14
MDIEIYQVDAFTNETFKGNPAGVCITKETLSEDLMLSIAEEMAVSETAFLSLNNMNLKWFTPQAEVKLCGHGTLSATHILKEKKLFNVNDTVTFNTLSGPLTALIKPSTIELDFPAPILDFNITPSTELLTSLGIEATHVIAYGIFDSKILIEVDDEEIVLNLAPNFDRLTKIDGRGVLITAPTQHNDLDFISRFFAPWVGVNEDPVTGSAHCALTLYWSEKLNKVKLNGYQASARGGYVSTELLPNGRIKLIGSAITTIKGTMQLPNI

SEQ ID NO: 80903 - protein, 333 aa, Arabidopsis thaliana
MKLYEHDGVDLEDGKTLKSGGDKPIPRKIHNRALLSGLAYCISSCSMILVNKFVLSSYNFNAGIFLMLYQNFVSVIIVVGLSLMGLITTEPLTLRLMKVWFPVNVIFVGMLITSMFSLKYINVAMVTVLKNVTNVITAVGEMYLFNKQHDNRVWAALFLMIISAVSGGITDLSFNAVGYAWQIANCFLTASYSLTLRKTMDTAKQVTQSGNLNEFSMVLLNNTLSLPLGLLLSYFFNEMDYLYQTPLLRLPSFWMVMTLSGLLGLAISFTSMWFLHQTGATTYSLVGSLNKIPLSIAGIVLFNVPTSLQNSASILFGLVAGVVFARAKMREKS

SEQ ID NO: 80904 - protein, 726 aa, Yarrowia lipolytica CLIB122
MSSPPSLSDLSLNDRNPDRHPLKGLHEARGIRKVSLHSRSGSVAEEEEPSSTDSNAATASHPPADQLSEVSAETLARIQAIHMSRMSRDRSHSSPPEPEQEQLQQLQDRTPPSWQTQRPHPHVTTDFGPQLTSPEISPFTTASSVPRNSDHSFSQFQTGSLPKSYTGGVIPPGVTASPLNGPLTGPLTGPLTGPLTGGTKPVSRQSSLSSRRGMRLPGSPLVSDDECSQNPAASTPKPMNLHLPDYSKLSYNGDNNGSSSADSRSRESSSSSNASSTSTTPSCALTGGLTGPTVQTGARLPGRLSSQNSIKRKGPGKLSLSGSPSSSPVTPSDGSAVPLPIAKDQAPAQGAPAQGGGLFAQFSKIVDINTGKLNFAGKASLHSEGIDFSGGTSFRINIDELEPLGELGRGNYGTVTKVLHKPTGITMAMKEVKLELDTAKFAQIIMELDILHKCESPYIVDFFGAFFVEGAVYECIEYMDGGSLDKVYAGGVDEPCLAAITDSVVRGLMFLKEEHNIIHRDVKPTNILINTEGKVKLCDFGVSGNLVASKASTVIGCQSYMAPERIHNPDSGNVTYTANSDIWSLGVSILEIAQGSYPYPPEAYNNVFAQLRAIVSGDPPQLAERFSPEARDFVAQCLQKKPYQRPTYQQLLEHPWLKKYRGVDVGMADFVKKALERGKNATSTSNETTPTGTTIPVSRNNPGLVSRDGRNNMVPALHHSFLNNRQ

SEQ ID NO: 80905 - protein, 272 aa, Guillardia theta
MIVIQWERIFIIFFLVYSSSFNNFINIGKINLKYFLFEIYLISNLIELFLLNTSFNGSGSLPKSKVFKAISYKKNINESFYEEILVNGYFMQIKFCKSCSIWRPPRASHCSVCDSCNMQFDHHCPWLGKCISLKNYRIFFLFLSLLTFFIMSILSIFFINSKKTYFMNNQYSFKLFCIELNPKSVYSKVVNTFFITSYILVLIFIISLIIFHLYLGFSGKTTSELLKFPSKNFWKWDIRKEFSRKFYELYNIGLCDKNYLKKKKILFEIPKI

SEQ ID NO: 80906 - protein, 483 aa, Agrobacterium tumefaciens str. C58
MQTVNLFIGGDHCAAANGKRFERNNPITGDAVTSAAAASVEDATNAADAAAAAFPKWSATTPGERRRHLLAAAEALRAAGPQIIQAMMEEIGATEAWAGFNVMLASDMLVEAASLTTHITGEVIPSNRPGTMAMALRQPAGVVLSMAPWNAPVILGVRSIATPLACGNTVVMKTSELCPRTHALIIEAVASAGLPKGVLNAISNAPDDAAKIVETLIAHPAVRRVNFTGSTRVGRVIAETAGRYLKPALLELGGKAPFIVLDDADIDAAVAAAAFGAYMNQGQICMSTERIIVLDSIADTFVEAFAKKAASLTAGDPREGKTPLGSLVSAEAASRIRVLVDDAVSKGARRVAGGGGDGTMLDAIAVDGVTPAMRLYSEESFGPVVSIIRAGSIDEAVSIANESEFGLSAAVFGRDQARALSVAARIESGICHVNGPTVHDEAQLPFGGVKASGYGRFGGTAGIAEFTELRWVTLQDGPLHYPI

SEQ ID NO: 80907 - protein, 264 aa, Zea mays
MSAIDSAWQLLIANFTEFQLATVVTFLLHETVFFLSGLPSLLFERFGLFAKYKIQKKSNTSAYQNRCVLRLILYHVCVNLPVMIFSYPAFKFMGLRSSLPLPHWSVVVSQVLFYFVLEDFIFYWGHRALHTKWLYKHVHSVHHEYATPFGLTSEYAHPAEILFLGFATVVGPALTGPHLFTLWLWMVLRVLETVEAHSGYHFPWSPSNFLPLYGGSDFHDYHHRVLYTKSGNYASTFVYMDWLFGTDKDYRKAKTIEEKEGKNL

SEQ ID NO: 80908 - protein, 259 aa, Glycine max
MSQEQPRRPQGQDPIKYGDVFDVYGDLAQMPIAPEDAAMMQSAEARVLGKTQPGGASSVMQSAATRNEQAGLVGHQDVTDITGDHGVTVTETTFHGRRIITEAVGGQVVEQYVEPKSQFEAGRTSCNLRRSAYNQLGEALKATAQTVGHKPVDQSDASAIQTAEVRATGSNVITPGGLAAMAQSAAAYNADCKHDQDKVKLADVLTGATAKLPADKAATLQDAEGVASAEARNNPDATATPGGVAASVAAAARLNENVK

SEQ ID NO: 80909 - protein, 253 aa, Glycine max
MSQEQPRRPKGQNPIKYGDVFVVSGDLAQKPVAPEDAAMMQSAEARVLGQTQPGGAASVMQSAATRNEQAGLVGHRDVTDVTGDRGVTVTETKVPGRRIITEAVGGQVVEQYVEATPVEAGRSSAIKENAITIGEALEATAQTVGQKAVDQSDASAIQAAEVRATGSNVITPGGLAAMAQSAAAYNADCKLDQDKVKLLAGATAKLPADKAATLQDAEGVACAEVRNNPDATATPGGVAASVAAAARLNENVK

SEQ ID NO: 80910 - protein, 374 aa, Glycine max
MSSPQVITCKAAVAWRAGEALVMEEVEVSPPQPMEIRIKVVSTSLCRSDLSAWESHAIFPRIFGHEASGIVESVGQGVTEFKEGDHVLTVFIGECMSCRQCTSGKSNTCQILGLERRGLMHSDQKTRFSLKGKPVYHYCAVSSFSEYTVVHSGCAVKVSPLAPLEKICLLSCGVAAGLGAAWNVADVSKGSTVVIFGLGTVGLSVAQASKLRGASRIIGVDNNPQKCENAKAFGVTEVVDPNSYKEPIAQVIKRITDGGADFSFECVGDTDMITTALQSCCDGWGLTVTLGVPKVKPEMSAHYGLLLMGRTLKGSLFGGWKPKSDLPSLVEKYLNKEIQIDDYITHNLSFDDINKAFNLMKEGECLRCVIHMPR

SEQ ID NO: 80911 - protein, 302 aa, Triticum aestivum
  misc_feature (116)..(116): Xaa can be any naturally occurring amino acid
  misc_feature (136)..(136): Xaa can be any naturally occurring amino acid
  misc_feature (237)..(237): Xaa can be any naturally occurring amino acid
LVDQSRQRGWPRHIEAAPPGGEYGAKDYSDPPPAPLFDAEELTKWSLYRAVIAEFVATLLFLYITVATVIGYKHQADPAGPNAADAACSGVGILGIAWAFGGMIFVLVYCTAGVSXGGHINPAVTFGLFLARKVSXLVRALLYIIAQCLGAICGVGLVKGFQSAFYVRYGGGANELSSGYSKGTGLAAEIIGTFVLVYTVFSATDPKRSARDSHVPVLAPLPIGFAVFMVHLATIPXITGTGINPARSFGAAVIYNNEKAWDDHWIFWVGPFIGAAIAAAYHQYVLRASATKLGSSASFGRS

SEQ ID NO: 80912 - protein, 257 aa, Glycine max
MSQEQPRRPKGQNPIKYGDVFVVSGDLAQKPVAPEDAAMMQSAETRVLGQTQPGGAASVMQSAATRNEQAGLVGHRDVTDVTGDRGVTVTETKVPGRRIITEAVGGQVVEQYVEATPVEAGRSSAIKENAITIGEALEATAQTVGQKAVDQSDAFAIQAAGGESNGEVNVITPGGLAAMAQSAAAYNADCKLDQAKVKLADILAGATAKLPADKAATLQDAEGVACAEVRNNPDATATPGGVAASVAAAARLNENVK

SEQ ID NO: 80913 - protein, 542 aa, Bordetella petrii
MKTFDWNNPYPTARIPLFARNVVSTSHPLAAQAGLRMMLKGGNAVDAAIAAAATIVLVEPVSCGLGGDCFAIVWDGKELHGLNSSGVAPAAWNVEYFKRKYGTGPDGLAKQPKRGWDAATVPGVVAGWAALHQKLGKLPFADLFEPAIEIAERGYAVPPVVAHKWAAAADELRDQPGYAQAFLPNGRAPAIGEHFRIPDAAYTLRRIAASGGRDFYEGELAEKIAAFSKECGGAMTLDDLRNYRPEWVKPISKSYRGYELHEIPPNGQGIAALMALGICEHFDLGSMQVDSVLSQHVQIEAMKLAFADLYRYVSDPRTMDVTPQQMLSDAYLESRAKLIRLDRATQFEAGRPHAGGTIYLSAADENGMMISFIQSNYMGFGSGVVVPGTGISLQNRGVGFSMDPKSPNVVDGGKRPFHTIIPGFLTRGGKPVMSFGVMGGDMQPQGHLQTVVRMLDYHQQPQAACCAPRWKVNRDFSLDIESTMSRATVDGLRALGHVMKSVDDPYMDFGAGQFIWRLHESDNEHGYVAASDSRRDGQAVGF

SEQ ID NO: 80914 - protein, 407 aa, Zea mays
MAAALQATPIKTLATSRWRVEGAEARPRPMAASFRCSAAARSYNITLLPGDGIGPEVVAVAKDVLSLAGALEGVELRFQEKLVGGSALDATGVPLPDETLDAAKGSDAVLLGAIGGYKWDNNEKHLKPETGLLQLRAGLGVFANLRPAAVLPQLVDASTLKKEVAEGVDIMVVRELTGGIYFGKPRGFGTNDNGDDIGFNTEVYSASEIDRIARVAFEVARKRRGKLCSVDKANVLEASMLWRKKVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAARRIEAAVTETLNHGFRTGDIYSPGTTLVGCKRMGEEVLKTVESLKEVAAVN

SEQ ID NO: 80915 - protein, 733 aa, Silicibacter pomeroyi DSS-3
MSDFTLTKDADGVAFITWDAQGKSMNVMTREAFELVDSLVDQALADDEVKGIVITSGKSDFAGGMDLNTLAVIREEAGENPAQGLFDFVMGGHRIMRKLELAGMDPKTKKGGKPVACAINGTCAGIGTEIALACHHRVMTTNPKAKIGLPEILLGIFPGGGGTIRYSRMVGAMAAAPVLLEGKMMDPAKAKGAQMVDALADDPVAAAKEWVLNAKDADLVKPWDAKGYKMPGGAPYHPAGFMTFVGASAMVNGKTQGAFPAPKALLSAIYEGALVDFDTALRIEARWFTHVLMNPSSSAMIRSLFINKQALEKGAVRPKDIPDQRVKKLGVLGAGMMGAGIALVSAQAGMEVVLIDRDQAAADKGKAYTEAYLDKGMKRGKVTAEKKEAMLGLITATPDLDALKGCDLIIEAVFEDPGVKAEMTKKVEAIIPEDCIFASNTSTLPITGLAKASVRPEQFIGIHFFSPVEKMLLVEIIKGKETGPRAVAKALDYVRQIRKTPIVVNDARFFYCNRCIIPYVNEGARMITEGVSPVLIDNAARQLGFPVGPIQLTDETSIDLGAKIARATKAAMGNAYPESPADDLIFWMEELGRMGRKANAGFFDYDDKGKRTGYWQGLQDKYPLAEEQPDLIEVQERLMFAQVLEAVRALEEGVLEDIREGDVGAILAWGFAPWSGGPLSWIDIIGTPYAADRCDQLAAKYGERFACPPLLREMADKGQSFYGRFDPEAKSAA

SEQ ID NO: 80916 - protein, 457 aa, Triticum aestivum
MNSLQSFLAVAPVKPAAAAARLPSSRRARVSACLATPAPAPTAPAAARRELSAASRAVMADEAKYIVGTYKRAQVVFVAGRGCKLYDIDGREYLDMAAGIAVNALGHGDPDVDAAAADQRGRLVHASNVGYTVPQVELAKRLVEASFADRAFFANSGTEANEAAIKFARKYQRVAHPNGDAPTEFMSFTNCFHGRTIGSLALTSKVQYREPFEPVMPGSTFVEYGNLEEAKKVIQSGKIAAVFVEPVQGEGGIHSATNEFLQGLRDACDEAGALLVFDEVQCGLGRTGYLWAHEVYGVVPDIMTLAKPLANGLPIGVALVTEKVAAAIHYGDHGTTFGGGPFVCHAALATLDKIQKPGFLAEVTKKGEYFKQLLKTKLGGNPHVKEIRGAGLIVGIELDVPAGPLVDACLDAGVFLLTAGKGNVVRLVPALIVSEKELEQAAEVIRECLPALEASTS

SEQ ID NO: 80917 - protein, 503 aa, Hordeum vulgare subsp. vulgare
MVAPAKIPQRQLFIDGEWRAPALGRRLPVINPTTEVSIGEIPAGTSEDVDAAVAAARAALKRNRGRDWSRAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASVTCLELGDVCKEVGLPSGVLNIVTGLGNEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKTEGATILTGGVRPKHLEKGFFIEPTIITDINTSMEIWREEVFGPVLCVKEFSTEEEAIELANDTHYGLAGAVISGDRERCQRLAEEIEAGCIWVNCSQPCFCQAPWGGNKRSGFGRELGEGGIDNYLSIKQVTEYTSDAPWGWYKAPAN

SEQ ID NO: 80918 - protein, 353 aa, Nicotiana bonariensis
PPPPAKSPPPPPAKSPPPPPPPAQPPKQSPPLPPAKQPPPPPPSAKPPVKPPSPSPAAQPPATQRPTPPSQPPPMQRAPPPKLPLPPPPTQLPIRKPPPPATQLPIRKPPPPAYTQPPFKTPPPPPIRSSPPPQDAYDEPPIVESPPAPPSDHEPPVVEPPPSDYEPPIIEPTPPTDQPPIITPCPPTLTPPFIPRITPPVKLPPPSIHPAGKPLIIVGHVHCKSCNSRGLPTLYKASPLQGAVVKLVCHNNARKANVQTAMTDKNGEFVIMPMSLTKADVHKCKVYLGKSPKPICNVPTNFNGGKSGALLKPILPPKPHVNPGPGPVQPPMFDYHGVGPFIFEASSKLPCKK

SEQ ID NO: 80919 - protein, 521 aa, Pleurotus pulmonarius
MVLSTKLVALVASLPFVFAVTKKLDFHIRNDVVSPDGFERRAITVNGIFPGTPVILQKNDKVQIKTINELTDPGMRRSTSIHWHGLFQHKTSGMDGPSFVNQCPIPPNTTFLYDFDTAGQTGNYWYHSHLSTQYCDGLRGSFIVYDPNDPLKHLYDVDDESTIITLADWYHDLAPHAQNQFFQTGSVPIPDTGLINGVGRFKGGPLVPYAVINVEQGKRYRFRLIQISCRPFFTFSIDNHTFDAIEFDGIEHDPTPAQNIDIYAAQRASIIVNANQTIDNYWIRAPLTGGNPAGNPNLDVSLIRAILRYKGAPAVEPTSVATTGGHKLNDADMHPIAQEGPGNLGTGPPDMAITLNIAQPNPPFFDINGISYLSPSVPVLLQMLSGARKPQDFLPSEQVIILPANKLIEVSIPGAGAHPFHLHGHTFDIVRVSNSDVVNLVNPPRRDVLPINGGNTTFRFFSGNSGAWFLHCHIDWHLEAGLAVVFAERPAEVNEGEQAQIVTQDWRTLCPAYDGLAPEFQ

SEQ ID NO: 80920 - protein, 331 aa, Avicennia marina
MIMSSISKALFFFAILSFSSFSAFAENEGHGLAMNYYRDSCPQAEEIIKEQVQLLYKRHKNTAFSWLRNIFHDCFVESCDASLLLDSTRRMLSEKETDRSFGMRNFRYIETIKEALERECPGVVSCADILVLSARDGIVSLGGPYIPLKTGRRDGRKSRAEILEQHLPDHNESLSVVLDRFANMGIDAPGVVALLGAHSVGRTHCVKLVHRLYPEVDPALNPSHVEHMLHKCPDPIPDPKAVQYVRNDRGTPMKLDNNYYRNILDNKGLLIVDHQLATDKRTKPFVKKMAKSQDYFFKEFGRAITVLSENNPLTGTKGEIRKQCYLANKLH

SEQ ID NO: 80921 - protein, 506 aa, Hordeum vulgare subsp. vulgare
MAAPPAIPRRGLFIGGGWREPTLGRRIPVINPATEDTIGDIPAATAEDVELAVAAARSAFLLDGGSRWARASGATRAKYLNAIAAKIKEKISYLALLETVDSGKPKDEAVADMDDVAACFEYYAALAEALDGKQHAPISLPMEEFKTYVLKEPIGVVGLITPWNYPLLMATWKVAPALAAGCTAVLKPSELASLTCLELGAICEEIGLPSGVLNIITGLGPDAGAPIASHPHVDKIAFTGSTATGKTIMTAAAQMVKPVSLELGGKSPLVIFDDVADIDKAVEWAMFGCFFNGGQVCSATSRLLLHEKIAERFLDRLVEWAKNIKISDPLEEGCRLGSVISKGQYEKIKKFISTARSEGATILHGGDRPKNLGKGFFIEPTIITGVSTSMQIWREEVFGPVICVKVFKTESEAVELANDTHYGLAGGVISDDLERCERIAKVIHSGIVWINCSQPTLVQAPWGGNKRSGFGRELGEWGLENYLSVKQVTRYCKDELYGWYQRPSKL

SEQ ID NO: 80922 - protein, 532 aa, Pleurotus pulmonarius
MFPGARILATLTLALHLLHGALAAIGPVGDMYIVNEDVSPDGFSRSAVVARSVPITGPTPATASIPGVLVQGNKGDNFQLNVVNQLSDTTMLKTTSIHWHGFFQAGSSWADGPAFVTQCPVASGDSFLYNFNVPDQAGTFWYHSHLSTQYCDGLRGPFVVYDPTDPHLSLYDIDNADTVITLEDWYHIVAPQNAAKSHPDSTLINGKGRYAGGPTSPLAVINVESTKRYRFRLVSMSCDPNFTFSIDGHSLLVIEADAVNIVPITVDSIQIFAGQRYSFVLTADQTPDNYWIRANPNLGSTGFAGGINSAILRYVGAADADPTTTSSTSTPLLETNLVPLENPGAPGPAVPGGADININLAMAFDFTTFELTINGVPFHPPTAPVLLQILSGASSAASLLPSGSIYELAPNKVVEISMPALAVGGPHPFHLHGHTFDVIRSAGSTTYNFDTPARRDVVNTGTGANDNVTIRFVTDNPGPWFLHCHIDWHLEIGLAVVFAEDVTSISAPPAAWDALCPIYDALSDTDKGGIIP

SEQ ID NO: 80923 - protein, 2244 aa, Schizosaccharomyces pombe 972h-
MSGLLPSLSSSFPLVQSEALGMPRTHGPKPSENDPKEPTCSPSPAFYSVNGEMKDYKLMALELEDKSVLQGYSFGADHSVSGELVFQTGMVGYPESLTDPSYRGQILVFTFPTVGNYGVPDRRILDEISGLPKYFESNQIHVAAIIISSYSQNYSHFLAHSSLGEWLKEQGIPGIFGIDTRALTKKIRDQGSMLGRLLIQKDESPINPSSITGLGKDWSTAFEDIPWKNPNTENLTSQVSIKEPKLYEPHPTTAIKKADGKIIRILVIDVGMKYNQIRCFLNRGVELLVVPWDYDFTKETYDGLFISNGPGDPSLMDLVVDRVKRVLESKTVPVFGICFGHQIMARAAGASTTKMKFGNRGHNIPCTCMISGRCYITSQNHGYAVDASSLSNGWKELFVNANDGSNEGIYNTEYPFFSVQFHPESTPGPRDTEFLFDVFIDVVKRSADAKSLQPFKLPGGTIEENRSRHPLVDAKRVLILGSGGLSIGQAGEFDYSGSQAIKALREEGIYTILINPNIATIQTSKGLADKVYFLPVNADFVRKVIKQERPDSIYVTFGGQTALNVGIELKDEFEQLGVKVLGTPIDTIITTEDRELFARAMDEINEKCAKSASASSIEEAIKVSKDISFPVIVRAAYALGGLGSGFADNEAELIDLCTLAFATSPQVLIERSMKGWKEIEYEVVRDAFDNCITVCNMENFDPLGIHTGDSIVVAPSQTLTDEDYNMLRTTAVNVIRHLGVVGECNIQYALNPFTKEYCIIEVNARLSRSSALASKATGYPLAFTAAKLGLNIPLNEVKNSVTKVTCACFEPSLDYVVVKIPRWDLKKFTRVSTQLSSAMKSVGEVMSIGRTFEEAIQKAIRAIDYSNTGFNVKDALMSIDTELQTPSDQRLFAIANAMASGYSVDRIWELTRIDKWFLEKLMGLIRTSQLISKHDISSLPISLLKTAKQLGFADVQIAAFMNSTELAVRRIRTEAGIRPFVKQIDTVAAEFPAFTNYLYTTYNAVEHDIHFNDKGVMVLGSGVYRIGSSVEFDWCAVRAVRTLRDRGVKTIMVNYNPETVSTDYDEADRLYFENIGLETVLDIYEQESSSGIIIAMGGQTANNIALPLHRENVKILGTSPEMIDGAENRFKFSRMLDDIGVDQPKWKELTSFDEADKFCDTVGYPVLVRPSYVLSGAAMNTVYSQSDLHSYLQQAVAINKDHPVVISKYIENAKEIELDAVAREGKMVMHVISEHVENAGVHSGDATLVLPPQDLAPTTIERIVDAAAKIGEALNITGPYNIQFIAKDNEIKVIECNVRASRSFPFVSKVIGVDMISMATDVIMGNPIQPYPDVDLPRDYVAVKVPQFSFSRLSGADPVLGVEMASTGEVACFGHNKFEAYLKAMISTGFRLPKKNILISIGSYKEKAELLPYVKKLYENNYNIFATAGTSDYFMESGVPCKYLADLPAEEANNEYSLSAHLANNMIDMYINLPSNNRYRRPANYISSGYKSRRLAIDYSVPLVTNVKCAKLMIEAICRNLDFSLSTVDFQSSFQTANLPGLINISAFLPEFTSEAVSDYTKECIASGFTMARFLPFSTSSTLADKDSLSAVKKLALDHAHCDYNFSVIASSTNEVTISELTSESGCLFFHFEKDDSGIDHVTAVASHFNVWPDTQTVMTDAKSTTLASLLLLASLHNRRIHITNVSSKDDLNLIVLAKQRSLPVTFDVSVYSLFLNQNDYPGATFLPTADDQVEIWNKLSYIDCFSIGSIPSRLAKFVGNTAFTGFGVREAIPLLLTAVNEGRLTLKDVVDRFYSNPKAIFRLHDQDDSGVQLEVDRSVSWSSKDWTPFNGKKLYGSIQSVQFDGHDVFFDGELNFEHTYGRDYSSASLADKSKATRKVSALMSPGLPHAAPSLAEAFGQAPENKAHPDISLNMTPNFKPSHELVQLINSSPFYRKHIISVHQVTRSDLHVLFAIAHQMRIIVERQGVIDLCYGKLLCTMFFEPSTRTSSSFDAAMQRLGGKVVAVTASASSVNKGESLADTIRTLGCYGDAIVLRHPSIESARIAANFSPVPIINGGNGSKEHPTQAFLDLYTIREELGSVNGLTITFIGDLKYGRTVHSLARLLAFWHVELHLVSPEQLALPDDVKDDIRANGLNFIEHRELTKEVVAQSDVLYCTRVQKERFASVDEYEKLKDSFIVDNSVLASAKSHCIVMHPLPRNREISEEVDFDQRRAAYFRQMRYGLYIRMALLACVMGATEVAN

SEQ ID NO: 80924 - protein, 134 aa, Synechococcus sp. WH 5701
MGAGPHWSCISGCGACCRLDPEQRGEALDALSEEQRQLYLSMVGADGWCRHFNTGSRTCRIYADRPGFCRVGALAQLFAVPPEQGEAFAIACCRQQIREEYGGRSLVMRRFERSTRQPGGQPAPPAPSEHQNQP

SEQ ID NO: 80925 - protein, 177 aa, Magnaporthe grisea 70-15
MSVSCRYAAQCCSRQLRVSPSVRVSGVAVQRIARRHNSTEAASPKITTIVDQISQLTLLETAELVSSLKSRLNIPDLPVGGFAAAAPAAAPAAAEEADEPAPAAAAKTVFTLKLMSFDAGAKAKIIKEVKGLLGLSLVDSKKFVESAPKVMKESVPKEDAEKIIATMKELGAVVTME

SEQ ID NO: 80926 - protein, 221 aa, Glycine max
MGQQSLIYSFVARGTVILAEYTEFTGNFTSVAAQCLQKLPSSNNKFTYNCDGHTFNYLVDNGFTYCVVAVESAGRQIPIAFLERIKEDFTKKYAGGKAATAAAHSLNREFGPKLKEEMQYCVDHPEEISKLAKVKAQVSEVKGVMMENIEKVLDRGEKIELLVDKTENLRSQAQDFRQQGTKIRRKMWFQNMKIKLIVLGIIIALILIIVLSVCGGFNCGK

SEQ ID NO: 80927 - protein, 312 aa, Oryza sativa
MARHEAAAGVVDFHLPDEILAVIPTDPYEQLDVARKITSMAIASRVSRLEADAARLRRDLADRDRAEADLRARLADSDARLLAALDENAKLAKERDSLASTAKKMARNLAKLEAFKKQLMKSLSEDNLLQLSEIGDDRDFDANNNLTARVPSWEDEVSSSRTSADSSSRSTMTESAQEHQFSVTPYTAPKLTPGSTPKFLSGPTSPTKSLSEVHSTFSSWHGSSSHQYSAPTSPPQHRSFAGRPRIDGKEFFRQARTRLSYEQFGAFLANIKEFNAQKQSREDTLSKAEEIFGTEHKDLYISFQNMLNRNHS

SEQ ID NO: 80928 - protein, 324 aa, Xanthomonas axonopodis pv. citri str. 306
MGLLVDGKWQDRWYDTSKSEGRFERSQSQFRNWVTRDGSAGPHGQGGFQAASGRYHLYVSLACPWAHRTLIFRRLKGLESMIDVSIVHWLMRENGWTFADGPGVVGDTEHHAQYLYEVYLKADPHYSGRVTVPVLWDRERKTVVSNESADIIRMFNSAFDEIGAADGDFYPQPLREQIDAVNARVYDTVNNGVYKAGFATTQAAYEEAVVPLFESLDWLEARLSAQRYLCGDRLTEADWRLFTTLVRFDAVYVGHFKCNLRRIADYPQLSGFLRELYQMPGIADTVNFQHIKRHYYQSHDTINPTGIVPMGPLLDLDAPHGRGG

SEQ ID NO: 80929 - protein, 341 aa, Rubrobacter xylanophilus DSM 9941
MKAFVKTGSRPGEAGVAELPAPRPGPGEVLLRVAACGVCGSDVHAFRSDPGFEWISTPVTLGHEFAGTVEALGPGVERVAPGDRVVAVAIQGCGRCELCLAGLTQLCPDRVAVGLSRDGGMAEYAVMPEGHLVSVPEGLDLTLAALCEPLSVAVRAVDARAGIAPEGKVVVSGPGPIGILCAMVARLRGADVLLTGIGQDAEVRLPAAERAGIRAANLSEASLEEHLRDAFGRPPDVWIESSGSVRALESALESVRAGGTVVVVGIYAERLNLFPTDAVRRELSLLFSYSCNLADYRTALELLASGDLDLGPLISTHRLEEAPDALEAVAAGRTVKAVLVP

SEQ ID NO: 80930 - protein, 195 aa, Oryza sativa Indica Group
MSGCFCVCSFVSEILETQHHSAICLSGLSGGGKSILFYQKSKIKPVHVVDVPGHAGLKPKLDEVLPQAAGIVFAVDAQDFLSTMQVVAEYLYDILTKATVVKKRIHVLIFCNKTDKVTAHSKEFIKKQLEKEINKLRESRKDISSADTTDEVKLRNPGETFYFSQCQNRVTVAGGAGLTGNVSAVEQFIREYVKA

SEQ ID NO: 80931 - protein, 508 aa, Thermoplasma acidophilum DSM 1728
MLKKELGIIDLMMASVTGMIGSGWLFSAFYASSMAGPYSIFSWLVGTGIVAILALIYADLSGRVPMAGAAAGYPFLTNGTVAGSLNAWSLFLGYASTPPLEVIASISYLSFLVPGLLNNNGLLTTTGILLAVALLVAFFILNATGIRNTSRFNNIISYMKIAIPIITSFFFIFTIFSIRNFTLVGTVKPEGIFTAVPGAGIAFSFLGFRQAVELSGEAKNPQKTVPIAIMLSVAVASAIYMIVQIAFIGSLQWGSIKPGDWAALADSGYSSGPMLVLASTLGLGALATVLLFDGIISPLGTSSIYQTTTSRISYRISEMGFFPKKISTTNSRSVPIFALILDLVVMILFVLPFPSWQSLVSVNSDLTIIAYMSGPISLAIFEKYGIEAKGFRLPASKILAPLGFALSALIVYWSGYPTTLYMSAIAIAGLVLFVFARKNPIRDISQGSYMIAILAILPVVSYLGSYGIGIIPFPLDLIVISAVALAIFYAGTRAAPQSVALMENFISS

SEQ ID NO: 80932 - protein, 456 aa, Mycoplasma pulmonis UAB CTIP [sequence omitted]

SEQ ID NO: 80933 - protein, 686 aa, Zea mays
  misc_feature (647)..(647): Xaa can be any naturally occurring amino acid
  misc_feature (675)..(675): Xaa can be any naturally occurring amino acid
MGNTCVGPSITMNGFFQSVSTALWKTPQDSDALPAAAANGPGGASPGRSQSALPKPASDVHHHIAVLSEAPEPVKIGAYHSEPAPAVQSEAPEPVKIAASHSEPAPMAAKPGAAAANASPSPSPRPRPQVKRVSSAGLLVGSVLRRKTENLKDKYSLGRRLGQGQFGTTHLCVERGTGKELACKSILKRKLATDDDVEDVRREIQIMHHLAGHPSVVAIRGAYEDAVAVHLVMELCGGGELFDRIVRRGHYTERKAAELARVIVGVVEACHSMGVMHRDLKPENFLFADHSEEAALKTIDFGLSIFFRPGQIFTDVVGSPYYVAPEVLKKRYGPEADVWSAGVIIYILLCGVPPFWADFLANLLLTAPVCRRAENEQGIFEEVLHGRLDFESEPWPSISDGAKDLVRRMLVRDPRKRLTAHEVLRHPWVQVGGVAPDRPLDSAVLSRMKQFSAMNKLKKMALRVIAENLSEDEIAGLREMFKMIDADNSGQITFEELKVGLEKVGANLQESEIYALMQAVSAPHLVPVLVTGTVTASAEGKLAVAAFVRGAQADVDNNGTIDYGEFIAATLHLNKVEREDHLFAAFQYFDKDGSGYITADELQVACEEFGLGDVQLEDLIGEVDQDNDGRIDYNEFVAMMQKPTVGXSRRRPTCRTASVSGSGRRSGWPRPLCLXLPCCLRVGVDD

SEQ ID NO: 80934 - protein, 106 aa, Agrobacterium tumefaciens str. C58
MATVKVDAANFQSEVLESAEPVVVDFWAEWCGPCKMIAPSLEEISSELAGKVKVAKLNIDENPELAAQFGVRSIPTLAIFKGGEVADIKVGAAPKTALSAWISSAA

SEQ ID NO: 80935 - protein, 396 aa, Chlamydomonas reinhardtii
MSGTGTAGGRIAPGVGANLIGQHAQDRNQEATVYVGNLDVQTTEELVWELFTQAGPVVNVYMPKDRVTNAHQGYGFVEFKGEEDADYAIKVLNMVKVYGKAIRVNKASQDKRQADVGANLFIGNLDPDVDEKLLYDTFSAFGVIVNTPKIMRDPDTGNSRGFGFVSYDCFEASDAAIEAMNGQYLCNRAITVSYAFKKDTKGERHGTPAERLLAAQMREKAAAQSRPNMLFAEGPKLKGQQVGQAPPAPVMAPSGFAAGGPMPPPPPGPSGMPPPYGGPPPPYGAPQHWGGPPPGHFPPHMPPPPGGFGGYGPGPGYGMPPPPFGMPPPHFGMGPPPGMPPPPGYGMGPPPGMPPPPGYGMGPPPGMPPPPPNMPPPPGAPPPPPGMPPPPPPPPR

SEQ ID NO: 80936 - protein, 471 aa, Alkalilimnicola ehrlichei MLHE-1
MARTAADVLKLIQDEDVKFVDLRFTDTRGKEQHVTIPAHELDEDMFEDGKMFDGSSIAGWKGINESDMIMMPDPETATLDPFFDDPTINLTCDIIEPSTMQGYEKDPRSVARRAEAYLKSTGLGESALFGPENEFFVFDDVRWGADMSGSFYKIDSEEAGWNSERVYGDGNMGHRPKVKGGYFPVPPVDSLHDLRAAMCEALEDLGLTVEVHHHEVATAGQCEIGVGPNTLVKKADEIQKLKYAVHNVAHAYGKTATFMPKPLVGDNGSGMHVHQSVMKDGNNVFGGDSYGGLSEFALYYIGGIIKHARAINAFANASTNSYKRLVKGFEAPVLLAYSARNRSASIRVPYVPNPKARRIEVRFPDSTANPYFAFAAMLMAGLDGVQNKIHPGEAMDKDLYDLPPEEERDIPKVALSLNEALEALDQDREFLKQGGVFTDDTIDAYIELKMEEVERLNMTTHPVEFDLYYSV

SEQ ID NO: 80937 - protein, 750 aa, Guillardia theta
MAIKNSINENSKEITKNKIEEDLNEIIKKIDIKPEMYIKKNYLEIIDNKKIYIKKHLINEKEIFFKNLKILYSRYELFQLFLSDLIFENEMNKSEYNIILKKVLKIHENLFDRGLKNLLGYLDINKSYDISKNIKPKLFNNFEKNKKCNAQKIERKKNLKNFKNPKKIFSWILFKYFPILTWLQEYNINNFLKDDIISGITVGVMLIAQGMAYAKLAGLPPEYGLYSSGIPLFIYPLFGSSKHLGFGPVAIVSLLVSQITLSTNSAGHEYSTSEKITFSLLMAFSVGIVQISMGIVQIGFIVNFISHPVIAGFTTAAAFVIILSQIQHLLGFSVQKSHYPLFTLISYLININKFKWQPFFFGSANIFCLQMVKLINKNYKLELPGPILCVILSILITQTFKLNRFGITIQNKIPKGFPKIRGPIFNEFTKVAPVVLTISFINFLETIAIASKIGEIHGYKIVPDQELIGSGMTNLCGSFLSAFPMAGSFSRTAVLSQVGGKTQIAGLTTGIVIVLTYLFFTPLFTFLPNVTLASIILVSVINLIDYKEASNLLKIRFLDFFAFMISFISTFFIGVEWGIAIAIGVSLLIVLWFSINPTVSILGRIPGTVVYKDLKWYKDCIYTPGGILLRMDAPLFFVNSSVLRKKLKEKEDEYKNCNPVNLFYTLIDCRGMADIDSTGLELLNEIKEKFKKRKIFFGLANVNERVRKLLNKIDFENGSYHSMFFLRIHDGVEAAIKWKLLEIKNLSNNL

SEQ ID NO: 80938 - protein, 454 aa, Bacillus pumilus SAFR-032
METRDYLIKPMLNQHYPVAVKGEGIYLYDRDGKKYIDGSSGAVTASIGHGIREIIDAMTEQAEKVSFTYRSQFTNEPAEDLAYELSKLCPGNLNWSFFVGSGSEATETAMKIAIQHWQEQGKAEKNHIISRWMSYHGITLGALSMSGHIARRERFEPLLEKNPVLSPPYSYRSWLPKEEGKQVEWYVQEFKTVIQRIGKERIAAFIAEPIVGASGAALVPPDGYFEAMKRVCEENDILMIADEVMTGFGRTGKMFAMEHWGVVPDIMVLGKGMSAGYSPIAAAVSADHVIAPILSGSGSVMAGHTYSGNPLSAAVSLAVIRYMKKHQLPERADLSGRYLMNALKEVQTNHFIIGDVRGKGLLIGIEFVADRLSKTPFPAHAQMTHLVVETAKQNGLLVYPASAGEDGVGGAAIMIAPPLSITQQEMDELIQLFEQTITQVEQEVINRGFFPSAM

SEQ ID NO: 80939 - protein, 388 aa, Vibrio vulnificus YJ016
MNLHEYQAKQLFAEFGLPIPEGYACDTPQEAFEAAGRISTAKKVVKCQVHAGGRGKAGGVELHDTKEGVKEFAQKWLGKNLVTYQTDANGQPVTKILVEEASNIANELYLGAVVDRATRKVVFMASTEGGVEIEKVAEETPELIHKAAIDPLVGPQAYQGRELAFKLGLQGDQIKQFVKIFMGLGEMFTQYDLALLEINPLVITGEGNLLCLDGKINIDSNALYRQPKLREMHDPSQEDKREAHAAQWELNYVALDGNVGCMVNGAGLAMGTMDIVNLHGGKPANFLDVGGGATKERVAEAFKIILSDDNVKAVLVNIFGGIVRCDMIAEGIIGAVKEVGVSVPVVVRLEGTNADLGRKVLAESGLDIIAAESLTDAAQKVVAAAEGK

SEQ ID NO: 80940 - protein, 527 aa, Yarrowia lipolytica CLIB122
MPAPVNIPSMFDTILVLDFGSQYSHLITRRLREFNVYAEMLPCTQKIAELPWKPKGVILSGGPYSVYAEGSPHVDHAVFDLGVPILGICYGMQELAWINGKGVHAGEKKEFGHATIHVEKPSDPLFHGIDNFQVWMSHGDKLNALPTGYEVVATSDNSPYAGIAHTSEKIWGIQFHPEVTHTTKGKQLLQNFAVDICGAAQKWSMENFVDTEIQRIRDLVGPHAEVIGAVSGGVDSTVGAKLMKEAIGDRFHAILVDNGVMRLNECENVKKTLGEGLGINLNVVDAADLFLGKLKGVTDPEKKRKIIGNTFIEVFEEEAAKIQPTHPEAGEIEFLLQGTLYPDVIESISFKGPSQTIKTHHNVGGLLDNMKLKLIEPLRELFKDEVRKLGEIMGIPHDLVWRHPFPGPGIAIRVLGEVTPSQVEIARKADFIYIEEIKKAGIYEEISQAFACLLPVKSVGVMGDQRTYEQVIALRAIETVDFMTADWYIFDANFLKTVARRIVNEVPGVARVVYDITSKPPATVEWE

SEQ ID NO: 80941 - protein, 398 aa, Vibrio parahaemolyticus RIMD 2210633
MTFMFSNLPTPVLDPILSLSVAYRNDERPNKVDLGIGVYKNSAGETPIMKAIQMAQDVVVETQKTKSYVGLAGCEEFNQSMIDLLLTGTSAMDRVAAIQTPGASGALRMLGDLMKVAQPDTTVWISNPSYVNHKPVMEAAGLKVKFYHYFSPETKQVDTAKMLDDLAKAGPTDVVLLHGCCHNPTGADIDFSAWQAITELSQKNGFTPFVDIAYQGFGDGLEADAKGLRYMADNVEEMLITTSCSKNFGLYRERTGAAIVVGKNTQDITNAKGKLLTLARSTYTMPPDHGAALVKTILQDANLTSVWKQELSEMQQRLVSLRQSLCNELRNNHNTDQFDFIESHKGMFTVLGFSENQMAQLREDYGIYGVGDGRINIAGLTETHIPYVADAIKKISQP

SEQ ID NO: 80942 - protein, 462 aa, Glycine max
MCVFPLGLKLKTIIMGSSSPPDTSKSIKLERYNSYIRRLNSTKLLNASSKLLFRATILVALILVFLFTFNYPPLAPDFTSHRHLHSHSHFLSSSSSFASWEKQVRHSSTPRRPNGLTVLVTGAAGFVGSHCSLALKKRGDGVLGLDNFNSYYDPSLKRSRQAMLWKHQVFIVEGDLNDTPLLEKLFDVVPFTHILHLAAQAGVRYAMQNPQSYVTANIAGFVNLLEAAKSANPQPAIVWASSSSVYGLNTQNPFSELHRTDQLASLYAATKKAGEEIAHTYNHIYGLSLTGLRFFTVYGPWGRPDMAYFFFTKDILQGKTIDVYQTQEGKQVARDFTYIDDIVKGCLGALDTAQKSTGSGGKKKGPAQLRVYNLGNTSPVPVGTLVSILEGLLSTKAKKHVIKMPSNGDVPFTHANVSLAYRDFSYNPTTDLATGLRKFVKWYLGYYGLQQRLKKEYHLDNE

SEQ ID NO: 80943 - protein, 465 aa, Silicibacter sp. TM1040
MASYDVIVIGAGPGGYVSAIRCAQLGLKTAIVEGRETLGGTCLNVGCIPSKALLHATHMLHEAEHNFGAMGLKGKSPSVDWNQMKSYKDEVIGQNTGGVEFLMKKNKIDWIKGWASIPEAGKVKVGDDTHEAKNIIIASGSVPSALPGVEVDNDKGLVVDSTGALELPKVPKKMVVIGAGVIGLELGSVYARLGAEVTVVEYMDAVCPGMDKDVQRGFKRILEKQGLSFIMGAAVKGVETTKSKAKVSYEPKKGGDAEVIEADVVLVATGRKPYAEGLGLDALGVKMTERGQIATDAQWATNVKGIYAIGDVIEGPMLAHKAEDEGMAVAEVIAGKHGHVNYGVIPGVVYTTPEVATVGATEDALKAEGRKIKVGKFMFMGNARAKAVHQAEGGFVKLIADKETDRILGAAIIGPGAGDLIHEICVAMEFGASAEDLALTCHAHPTYSEAVREAALACGDGAIHS

SEQ ID NO: 80944 - protein, 640 aa, Hyphomonas neptunium ATCC 15444
MTETRPNRLLDAIDTPSDLKGRSRADLKQIAAEVREEVVDVVSVTGGHLGSGLGVVELTVAIHSVFDTPDDKLVWDVGHQCYPHKILTGRKDRMRTLRQGGGLSGFTKRSESEYDPFGAAHASTSISAGLGFAKSRDLQNKDNHVICVIGDGSMSAGMAYEAMNNAGADRSRMIVILNDNDMSIAPPVGAMSHYFSRLVSSRPYRGLRRIAKKVVQPMGLESPARRAEEYLRGFAMGGTLFEEMGFYYIGPVDGHDLDTLLDLLENIKAMQDGPILLHVVTQKGKGYAPAENSADKYHGVSKFSVVTGEQAKGAGGPPSYQKVFGQTLAKLGETDDKICAITAAMPSGTSTDIFGKKFPDRHFDVGIAEQHAVTFAAGLAADGMKPFCAIYSTFLQRGYDQVVHDVAIQQLPVRFAIDRAGLVGADGATHAGSFDIGYLGALPGFVCMAPSDEAELARMVLTSLEIDDRPSAVRYPRGEGVGVVIPDLLKPLEIGKGRVVREGTSIAILSYGTRLQEALKAAEMLAAQGLSATVADARFAKPLDNELIERLAREHEVLVTIEEGSRGGFGSFVLEHLANCGGLDAGLKVRVMTLPDVFQDHDTPAAMYDQAGLTARHIAARAIEALGRGDLSAIERLASA

SEQ ID NO: 80945 - protein, 387 aa, Aspergillus oryzae
MSLDSTSAAPPSLNSRIDELRGDAASQTDATEHTRGDITPAVPASLLSPSFTPPATPGGTINQAQLLQQTQQPTHTKPPKLLSCLPNVECIVRARIPTTNGAEMFLHLYHNDLDNKEHLAIVFGNSIRSRSLDAIRPGETEMDRMIRGAYIGTLRPGRVSSWYDSSANTESASSGQGRSTPDAPVSSQTSELAQSSTNQAPLVRIHSECYTGETAWSARCDCGEQLDEAARLMSLPMETLNEVASQQDLSVPSNASGGVIIYLRQEGRGIGLGEKLKAYNLQDLGSDTVEANLLLRHPADARSYGLATAMLVDLGLGVDSNPHGIRLLTNNPDKIRAVEGPNREVVVKERVLMVPLAWRTGGKMGITSTEVEGYLRTKISKMGHMLQ

SEQ ID NO: 80946 - protein, 311 aa, Zea mays
MEPGRSSTGAAKPRARMSTVSQKQGAQGALFYSALLCAREMLTQEDGSADLIRALNNRLIALSFHIREYYWLDMQKLNEIYRYKTEEYSYDAVNKFNIYPDQISPWLVEWIPPKGGYFIGNLQPAHMDFRFFSLGNLWSIVSSLATTHQSHAILDLIESKWSDLVAEMPLKICYPALENQEWKIITGSDPKNTPWSYHNGGSWPTLLWQLTVACIKMNRPELAAKAIEVAERRIATDKWPEYYDTKRARFIGKQSRLYQTWSIAGFLVAKLLIEKPDAARILWNDEDAEILNASSTNRKRGKKVLKKTYIV

SEQ ID NO: 80947 - protein, 476 aa, Hyphomonas neptunium ATCC 15444
MQQFLKFYIDGEWVDPVTPRTLEVENPATEENFAVISIGSSADVDKAVAAAKRAFPSFSQTSVEYRADLLDKITAGLQKRMPDLAKAISEEMGAPMWLANAAQVPSGLGHFATTAGILREYKWEEVKGTTLLRKEPIGVCAFITPWNWPLNQIACKVAPAIAAGCTMVLKPSEIAPLDAMIFAEVLHEAGVPKGVFNLVNGDGPGVGSAMSSHPDVDMVSFTGSTRAGVLVAQAAAPTVKRVAQELGGKSPNIVLPTADLQKAVSSGIMNMMTNSGQSCNAPSRMFVQKDQQEQAIAIAKATAEAVKVGNPADAAPGAIGPISNGNQYQKVQDLIQKGIEEGATLVAGGPGRPEGFNKGYFARPTVFANVTNEMTIAREEIFGPVLVMIPYDTVDDAVAMANDTVYGLAGYVQGPDKEANQVANRIRAGQILVNGARPDFSAPFGGYGQSGNGREWGEHGFEEFLEVKAVIGYNAA

SEQ ID NO: 80948 - protein, 501 aa, Silicibacter sp. TM1040
MTTEVRVPTLGESVTEATVATWFKKPGDTVAADEMLCELETDKVTVEVPAPAAGTLAEIVAKEGDTVGVDALLANITEGGAAAASAPAAKPAPAEAPASSGGDAVDVMVPTLGESVSEATVSTWFKKVGDSVAQDEMLCELETDKVSVEVPAPAAGVLAEITAPEGTTVDASAKLGVISGDGAAVAAAPAAAPAAAETPAAVSKDVANAPSAEKAMAEAGLSASDVKGTGRDGRIMKEDVASAIAAAKSAPAPTAAPAAPRAPVSADDASREERVKMTRLRQTIAKRLKDSQNTAAMLTTYNEVDMTEVMALRNEYKDLFLKKHGVKLGFMSFFTKACCHALKEVPEVNAEIDGTDIVYKNFVHMGIAAGTPTGLVVPVIRDADAMSFADIEKAIAEKGARARDGKLSMAEMQGGTFTISNGGVYGSLMSSPILNPPQSGILGMHKIQDRPMAINGKVEIRPMMYLALSYDHRIVDGKGAVTFLVRVKEALEDPRRLLMDL

SEQ ID NO: 80949 - protein, 566 aa, Schizosaccharomyces pombe 972h-
MNELHDGESSEEGRINVEDHLEEAKKDDTGHWKHSGTAKPSKFRAFIRLHFKDSRKFAFSRKKEKELTSEDSDAANQSPSGAPESQTEEESDRKIDGTGSSAEGGDGSGTDSISVIKKSFFKSGRKKKDVPKSRNVSRSNGADTSVQREKLKDIFSPHGKEKELAHIKKTVATRARTYSSNSIKICDVEVGPSSFEKVFLLGKGDVGRVYLVREKKSGKFYAMKVLSKQEMIKRNKSKRAFAEQHILATSNHPFIVTLYHSFQSDEYLYLCMEYCMGGEFFRALQRRPGRCLSENEAKFYIAEVTAALEYLHLMGFIYRDLKPENILLHESGHIMLSDFDLSKQSNSAGAPTVIQARNAPSAQNAYALDTKSCIADFRTNSFVGTEEYIAPEVIKGCGHTSAVDWWTLGILFYEMLYATTPFKGKNRNMTFSNILHKDVIFPEYADAPSISSLCKNLIRKLLVKDENDRLGSQAGAADVKLHPFFKNVQWALLRHTEPPIIPKLAPIDEKGNPNISHLKESKSLDITHSPQNTQTVEVPLSNLSGADHGDDPFESFNSVTVHHEWD

SEQ ID NO: 80950 - protein, 329 aa, Oryza sativa
MACILIGNLGASVTEVVSDAVVTEFSRTQKAGVLQSYAFIILAAGSLLGNLSGGYVLLRTQEPKTMFSAFSILLGLQLALSLSTKETLPSSHRNWNICHVRTSLSDNLRKQFSNLRTAISEEQIFYPLMWIMTSFAVVPILSGTMFCFQTQYLKLDPSVIGLSKVVGQVMVLSLTVLYNKYLKKIPLRRLVAGVQTMYALAVLSDLVLVKQVNLMLGIPNEIHVLCFSALAEAIAQFKVLPFSVLLSSQCPPGCEGSLFAFFTSGLVFSAIVSGVFGVGLSSLIGVSGGDYTSFPLCILLQSLAALVPLGWISFLPEKWTADDKILKPR

SEQ ID NO: 80951 - protein, 1111 aa, Gibberella zeae PH-1
MSFNFVHDSKFTSPTHNLSEMSSLTRSQLGQVQTSFPSQTQPVPIPMSATSASTGTSNSQQGSPIMSPDTAVLTTYSSVQASPEPMRGREEEAFPSSFQLPESVLSRKTSTNSLGYNAMSEVANNSKGGLIRRFSNRAQRFAGRRRPSSGAPASRDGSVGPSILRRRSDSNATAPQENSALTDTDEEFVPDDSMSMVGVDGANYTSSANSTHGSISASAGAMAGPVLPAELRNGCPVKKVSKKSRPKRITLAYETESNKLSWDPSRPQKSLHVDEIREIRTGTDIQQYIHDYGLSEQIEFYFPVWFTIIYNVPESSKTRFLHIVTDNSNTLSLWTEFLDAMLRYRQQLMTSLMSFNDRAVAQYWQTEMAKEFGDQARTPDQEEMNIAGVKRVCQNLHIYSSSSTLEVNFHLSDSRRRSKLNFREFKDFVRRMKQRNDVQRVIRNIAANPEFGLTLSEFLTFLRDDQGEDVDSNRTAWEKLFSRFCRQYRSTEADLPENVEIMTEAAFVAFLTSEDNEVIQPEPQNIVLDRPMNEYYISSSHNTYLLGRQVAGQSSVEGYISALARGCRCVEVDCWDGYNGQPEVNHGRTMTTSISFKEVMTTINKYAFVKSKFPLWISLEVHCSPAQQATMVEIIKESFGSRLVTETLEAFPDKLPTPSELMERVLIKVKKPQIKEEPIAAGNDFRGRRRGNSLNSPMMRPSVPDGTPLMPSQSLPQSPMLTPSHSSRRLVSKTRVNTITEGQVQGMLSSSTSDNESVSEQPVKKVHNKTVKVLGDLGVYCAGVKFSGFDTVDAKQYNHIFSFMESSFAKHSRAKDQKMALDIHNMRYMMRVYPDRTRITSNNFDPLNYWRRGVQMAALNWQTFDLGMQLNRAMFDGKDSSGYVLKPAELRDIQVLPYNADIAEGKKERTVISFTIDVISAQQLMRPANLPANKSMDPYVEVEVFHANDKRDKKEADSNLVLEHDTPLKYQTDVIRENGFNPLFDRTMKYTVTTKHPDLIFVRWSVKLSNDGESYNERPAVATYTAKLTNLKQGYRTLPLLNHAGDQYLFSKLFCKIKIDSVEKKFMEAPRRVQDGNKLNRLGGKVFSRMNTSPKSTIEKSSSEKTSFDSY

SEQ ID NO: 80952 - protein, 428 aa, Synechococcus sp. WH 5701
MTATLSRTTFTGLRCKECGHPYEAGARHVCEDVCFGPLEVVYDYDEIRRRVSRASIEAGPTSIWRYREFLPIEGDPIDVGTGFTPLLKANRLARRLGLKNLYIKNDGVNMPTLSFKDRVVSVALTRARELGFTTVSCASTGNLANSTAAIAAHAGMECCVFIPSDLEMGKVLGTLIYNPTLMAVKGNYDQVNRLCSEVANTYGWGFVNINLRPYYSEGSKTLGYEVIEQLGWQLPDHIVAPLASGSLFTKIRKGFDEFIKVGLVDEKPVRFSGAQAEGCSPIAQAFAEGRDFITPAKPNTIAKSIAIGNPADGPYAIDLANRTNGTIAAVSDAEIIDGIKLLAETEGVFTETAGGTTIAVLKKLVEQGKIDPSETTVAYITGNGLKTTEAVASSVGEPHTIEPQLASFNAAWERAQSLHRASWEPIGV

SEQ ID NO: 80953 - protein, 76 aa, Thermoanaerobacter tengcongensis
MIFEKVRNIIAEQLGIDPEEITMESSFIDDLGADSLDIVELIMALEEEFDIEIPDEDAEKIKTVGDVVEYLSNIVE

SEQ ID NO: 80954 - protein, 350 aa, Coccidioides immitis RS
MKKMSSGATVDSSPASSSLLDGTVPPINVLIVEDNTINLKLLEAFMKRLKVRWQTAMNGREAVNKWRGGGFHLVLMDIQLPVMNGLEATREIRRLERVNNIGVFSKGVAATSPHAMVDTKGNDVFPPKPEDVLDKKSSVKSPVIIVALTASSLQSDRDEALAAGCNDFLTKPVNMIWLEKKVTEWGCMQALIDFEGWRKWRGFDSSTSSGVSQQSTSTATITDAPLTDSPSPHLTTSKSSQGNHTSTVNSTHDEKPSQDQGESSPAPASSKLTGTCVYLKGSGKDSRTSSTSTIVPNGGSSSTGASPTPTLAGRTPTAGTTSGMTSLSSVISSSGKRGSRASTPAKNHAL

SEQ ID NO: 80955 - protein, 228 aa, Brassica napus
  misc_feature (220)..(220): Xaa can be any naturally occurring amino acid
MKQMRKSNLSIFAVVFSLFLVGIIMYNDNVKSIAYLTSSSPFSSLFEDGGAVELPPEECDLFTGKWVFDNKTHPLYKEEQCEFLTEQVTCLRNGRKDSLFQNWRWQPRDCSLPKFKARVLLEKLRNKRLMFVGDSLNRNQWESMVCLVQSVVAPGRKSLDQTGSLTTFQIQDYNATVEFYWAPFLVESNSDDPRKHSIIDRIIMPESIEKHAVNWKDVDXLVFNSYIW

SEQ ID NO: 80956 - protein, 352 aa, Oryza sativa Indica Group
MTDSPSPRLDEEDAFGRDFNSSPSPTAPPARSGEKRPFGDLDDDDEDVFASKKGKTKVEESAPGAATGMILSLRERATRIIYIVCLEHGTDFSPHPEVCRTVKIILRHVRWNGRLPNQKFKSGIQHFRTFQLYLLEPIQLEKAKKREAAFIVTFAKREQEIAELKSAVRDLKTQLRPPSMQTRRLLLDPAIHEEFTRLKNLVEEKEKKIKELQDNVAAVNFTPSSKHGKMLMAKCRTLQEENEEIGAMASEGKIHELGMKIAVLKTRNNELRNQFNELYKHMDGLTNDVERSNEMVAILQDELETKDVELRRLKEMLAQKEATDEDKIPQENDVAGDDIDAAAESQPIKVET

SEQ ID NO: 80957 - protein, 480 aa, Oryza sativa Indica Group
MEGFCFARCRFTRLVVAMQLVMGVLVICISMASLHRFYTTDALLPGGLDDPARCARFHGAVAGGYSGFDIRALADRVDEVLVQLAELQDKLEATALKIGKKTKKRKGKGKLQQQENMTMTEFQRFLEDEVIHPLYGAHIALRLIRIPRPDPDGGAPAVDPLVNFFAAEETRKYVTAKRNREGRPGAYGANRTYGSIGHACVVMRRELDEYMSYDVGALCPDDWDLGQRLMLGGCDPLPRRRCLARASKLFRRPLPINESLWALPDDGNVRWSRYHCRGYRCLSARNPRRGYDRCVGCFDMDREKQRWMQGSNGTTLADFRMEEVLAVKPGEIRVGLDVTVGTGSFAARMRERGVTVVTTAVNLGAPFAETVALRGLVALYAGLGQRLPLFDNSMDMVHTGGVLDGWVDLQMLDFVLFDWDRVLRPGGLLWVDKFACARKDLDDYMYMFLQFRYKKHRWVVSFKSRDEVYLSALLEKPLRS

SEQ ID NO: 80958 - protein, 357 aa, Pisum sativum
MAVKEATSETKKRSGYEIITLTSWLLQQEQKPIIDAELTIVLSSISMACKQIASLVQRANISNLTGTQGAVNIQGEDQKKLDVISNEVFSNCLRRSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 80959 - protein, 211 aa, Oryza sativa Indica Group
MDSDHWISRLMAAKRQYALQRAQNHHHATATATATAASHSHLDRYGYDDVEPEDEVRPDFPCPYCYEDHDITSLCAHLEDEHPFESKVVRHHRLRRVAVPSNHALSLGGRDLQETYLKVLLGNSSRSSGTNAASSVTDSLLSSLVLNLSSSEAEDTAKFSALAVVENNWFKRTLPSKTWKASSSNRRLVPDPFDIDDEPMWLASYLSWKQF

SEQ ID NO: 80960 - protein, 139 aa, Cicer arietinum
MSSTATTKGGRGKPKASKSVSRSSKAGLQFPVGRIARFLKAGKYAERVGAGAPVYLSAVLEYLAAEVLELAGNAARDNKNNRIVPRHIQLAVRNDEELSKLLGSVTIANGGVLPNIHQTLLPKKVGKGKGEIGSASQEF

SEQ ID NO: 80961 - protein, 448 aa, Thermoplasma acidophilum DSM 1728
MIMEDQERTERYNEDALRYSEYFKGKIQTISKVPVRSLDDFSIWYTPGVAAVSRKIASDPDLSFELTGRWNSIAILTDGTRVLGLGNIGPEAAMPVMEGKALIFNYLGGVNAIPIPIRVQSKEEFVKVAKALEPSFGGINLEDIESPKCFFLLETLQNEMNIPVWHDDQLGTASITLAGVINSLRIVGKKIDQVKVVFNGAGAANIAAAYLFKAAGFKMKNMILVDSKGILHPEREDIDALMINNPWKYQLAIETNGERVKGDLSNAIEGADLLISAAKSGPDTIDSRIVKKMNNDAIVFVLANPIPEMWPQEAKENGARIVATGRGDFPNQINNSLVFPGVFRGVLDARAKGVNFDVMVAASYEIANFVEDPTEEKIVPTMEEWELYPRLASAVASKTVELGLARKSDSKEGFYRRAREIIESNRNIYSKLMDLGLIKRMPNGEHKN

SEQ ID NO: 80962 - protein, 811 aa, Cryptococcus neoformans var. neoformans JEC21
MSSLVVFPSTTNAFTSYRPSVRAHVDFIKPGSGSQHSTGRIVKLELPSLVQPQATDQLEPLFKSIDAILAGQPTPLSYQHITAFCQTVVLQDRDAASQLSDKCTSSIDRYTEIIRRELKGGILAKDRNTLGKLCESWQVWTARTTLLSSLLVHLDKVYHSSFSEPNILRSRAIAKFKSIVWQDSVIHAVIIDDIFRWLSEERQTGIPSSARPTILAVDKIAQTLQTFGELAIAYQDETHDYYTSALRNAVSEIEQGKRKAGEYAPWFLAKMVEEENRVRECFHTFTLQLLARDLRKVGQSETTDKVIELAVEQAMSNDEAKGFSELYHFSIETDKFASLVKSLENYLAKRVSTLISDPVNDPRMIDETLKLKRFAEKTVSNLFSEEDTEPLPADEDVKMISVEEKEEREKEKEAAKEKRQSVRMRMFELEEAVRSGFKTGMGSRQNAPAEWIAKHLDAAMRKGQGSGTEEQFNNHLDEIVTLIGFTKDKDVFKAFYSSQLAKRLLLNKSASNDQEKTMVAKLQKELGEEFTSGDVMMKDLQLSETLVRSYQLAQSRGPAQYGETSNFTANVLTESAWPAYPLLKDGWNFHLTPSLQSSIDDFTSWYTTQHKNRVLSWRFQLATVTLTARFPSGRYEVGVSLFQAVVLLLYNEIESLTFAEIKERTGIENNELVRTLQSLALGRKGTRVLLKKPSGKEVNPTDIFAWNKGFTSERIKFKINQIQQDMSAEESRKTNEQVALDRVSILEATIVRIMKSRKKLTLQLLIDGVVSDVSKRFPPDVKEIKKRVESLIEREFMARDEEDRSILHYVA

SEQ ID NO: 80963 - protein, 131 aa, Triticum aestivum
  misc_feature (59)..(59): Xaa can be any naturally occurring amino acid
  misc_feature (93)..(93): Xaa can be any naturally occurring amino acid
MTSSSSPSRKALSKIACNRLQKELAEWQLSPPAGFKHKVSDNLQRWVIEVTGAAGTLYXGETYQLQVDFPEHYPMEAPQVIFLNPAPMHPHIXSNGHICLDILYDSWSPTMTVSSSVLSCCQFATKNVNGQ

SEQ ID NO: 80964 - protein, 584 aa, Magnaporthe grisea 70-15
MSDSEDFDVEGSNLAKDDPMRAFLPESFGKKGKEANIAAQIDRSRRTVDQKQAKKVQDDAVSKQSKPHSDGSSADDSDDDSDSDSDDDEDEYPVSHELVLKTHEKAVTAVSLDPAGSRLGTGSLDCTIKLHDFASMTPTTLRAFKSVDPWETKKSAASAESHPINQILFSPLSGGQFLCITAHPQAKVMSRDGDILAEFVKGDMYLRDMHNTKGHIGEVSAGAWSPTDRNLCVTAGSDSTLRIWDINNKRSQKDIIVFKSKAAGAAGRSKMTAVAWSSPLQGGNNALVAAALDGTLVMYSGDGPFTRPAAEVQAAHKPGTWTSGIDISADGRMIVTRGGDDLIKLWDTRKLKVPVVTASHTSTSDSFRMTNIKYSPNSTSILTGSANGDLHILNPGTLRPDLVTPVTPGSPLIVVDWHDKLNQIVTGSANAEIHVLYNPNMSARGAVDVMKRAPKKRHIDDNPALTMDQSVGISGDSIITPGAMGGRRGGVTASGRSLDPRRPQVQKVTPFGRSQPDEKHVEENIPLSRMLHEDPREALLKYADVAAKDPMFTNAWKDTQPVTQYAEESDEEVDEGPERKKQKK

SEQ ID NO: 80965 - protein, 517 aa, Zea mays
MAAIASASPRTLIPPRPRHHGAAPSPSTSDVSSLRLLRAHPRHVRRSRGVSISMPVARSRSFVFSPRAVADSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPMPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKILNADNVQEAARETDGYFIKGGIVTVIKDALLPSGTVI

SEQ ID NO: 80966 - protein, 116 aa, Pinus pinaster
TVFTVILYGSPLSVIRLVIHTKSVEFMPSFYFSLFAFLGSVLWMVYGALSGDILIMAPNFVGIPLGLSQMALYCIYWNNSPVRVEATKLEAGGELKSIEQNIKEDIELYTEDIEKA

SEQ ID NO: 80967 - protein, 382 aa, Thermoplasma acidophilum DSM 1728
MLSERMQYINESATVSASNNVEKLRKQGLKIYNFGIGEPDFTTPEGIIDYAFEMAKQGKTHYTPSAGIMELREKIASKLKTRNRIDANAENVLVTPTKFGINLAMMVILNPGDEVIIPDPYYVSYPDIVKLAGGKPVPVRTTDDYDIDLDEMRKFVTPRTRAIILNNPNNPTGKVLSEKEIRDLVDFALENDIYIVSDEIYEDLIYEGSLYSPASMGKEAFEHTITLNGFSKGYAMTGWRIGYFVATEEIVEAANIIQQQTITCASSISQYAALRALDDNESPARMRSEFRKRRDLAYGILSESTDMKVHKPEGAFYMFPGYSKDIPSEKIAEMLLNQEHVVVTPGSAFGDRGRHHFRISFATSEDIIKEGLERLVKFMHTL

SEQ ID NO: 80968 - protein, 406 aa, uncultured marine bacterium 106
MDKMGMTEKNFIEDLNLNGLRVLTRVDFNVPLNKDLQITDNGRIEAALTTIRYIVEQRGKAILMSHLGRPGGERVESLSLKPAAEELSLLLGQPVTFAKDCIGEEVEALIEGMQNGEVLLLENLRFHKAETKNEPEFCGALGKLGDVYVNDAFGTAHRAHASTAGVTGFIPESAVGYLIRKELQFLGGAVMNPARPFTAILGGAKVSDKIKVIDKLLNKVQTLIIGGGMSCTFLKAQGYKIGASLLEEDSLDFAKELIQKAQEKGVELLLPVDAVIADSFDKSASTRSVSVEEGASDGWLILDIGPKSAEIFCDSVRKSGTVLWNGPMGVFEMEPFALGTFAIAQCLAEVTDKGVVTIIGGGDSAAAIQQFGLSERITHVSTGGGASLEFLEGKELPGVTAIQQSK

SEQ ID NO: 80969 - protein, 757 aa, Silicibacter pomeroyi DSS-3
MSDQPSLRQAALDYHAFPKPGKLEIRATKPMANGRDLARAYSPGVAEACLEIKDNAAHAETYTARGNLVAVVSNGTAVLGLGNIGALASKPVMEGKAVLFKKFAGIDCFDLEVNESDPEKLADIVCALEPTFGAINLEDIKAPDCFIVEKLCRERMNIPVFHDDQHGTAIVVGAAARNALHVAGKAFGDIKIVSTGGGAAGIACLNMLVKLGVKRENIWLCDIHGLVYEGRAEDMNPQKAAFAQATDLRTLDDVIAGADLFLGLSGPNVLKPEMVARMAKRPIIFALANPTPEILPDAARAVAPDAIIATGRSDFPNQVNNVLCFPFIFRGALDVGATEINDAMQIACVEGIAELARITTSAEAAAAYQGEQLTFGADYLIPKPFDPRLVGVVSSAVARAAMESGVARRPITDLEAYRQKLNQSVFKSALLMRPVFEAAAKAARRLVFAEGEDERVLRAAQAILEETTETPILIGRPEVIEARCEKMGLSVRPGQDFQIVNPENDPRYYDYWTSYHQLMERRGVTPDIAKAIMRTNTTAIGAIMVHRGEADSLICGTFGEYRWHLNYVEQVLGSKDLRPHGALSLMILEDGPLFIADTHVRSRPSPEELAEITLGAARHVRRFGIEPQIALCSQSQFGNQAEGSGQRLRQAIEILDSRPRDFVYEGEMNLDSALDPELRQRIFPNSRLYGAANVLIFAHADAASGVRNVLKMKANGIEVGPILMGMGNRAHIVTPSITARGLLNMAAIAGTPVAHYG

SEQ ID NO: 80970 - protein, 930 aa, Aspergillus oryzae
MAASRHTGTIAPKIDSAIQRGTVLTKVTKKRRKQVRFFLDLDAGKVYWDVSNPAKRFYIDDIKEIRVGVDARNYREEHQIPQDTENRWFTIVIADDERSKGRTVKTLHLIAPNTPILELWTTTLEHISRYRIGLMAGLAGSGQSEAVLKAHWQREMSRLFPHGTRSAEQGSLDFGAVESICRSLHINCSKNMLRAQFSKADSDVNGKLNFSQFQNFVARLKERKDVKEIFKDSATDAKAGLSVDEFLKFLRNIQNENVDSDRSYWVSVFDKCVRKSKSRVPSIPEFEEEQVPRMDLDAFSSFLASPWNGLYASRAPQSRFDRPLNEYFISSSHNTYLLGRQVAGASSTEAYISALQKGCRCVEIDCWDGADGRPIVSHGRTMTTSVLFADCITVINRYAFITTDFPLILSLEVHCNPEQQLAMVKIMKDTFKDQLVLEPLLTNSFVLPSPEELKGRILVKVKTCDELQEGVRQEPVGTFAVHGRKRSASSPFIRPTASESSAITSLPPLSSPPTLGLETVGSFLTQDRRSFTTTSISSAAEESDGALATIRKEKKRRQKSKITKPLSDLGVYTRGYKWHSFSSAESQRYNHVYSFAERSFEGICRDAENKALFEKHNRKYLTRVYPSGFRLRSSNFDPLKFWRRGVQMAALNWQTYDIGMQMNQAMFAAGSDRTGYVLKPESLRALCPADEEKTKATEWKLVRFSVDVISAQQLPRPRSIGPDDNINPYVEIEMFSADDRGQSFVYGEGGMNASARNGMSGIGFPHRRRTKIEQSNGYSPIFNDRFRLSLETKYPDLVFVRWTIWSSQDGRSAGSNSSVQLATFTAKLSSLSQGYRYLPLYDGGGDQYLFSTLFCKITKEDPVSVQRLDAEELRAERMGILRQIGQTVFKRTSSTERERGNDMATSAEDKDSSPDLTPTVSAASTSSLPP

SEQ ID NO: 80971 - protein, 267 aa, Salmonella typhimurium LT2
MTIPAFGLGTFRLKDDVVIASVKTALELGYRAVDTAQIYDNEAAVGQAIAESGVPRNELYITTKIWIENLSKDKLIPSLKESLKKLRTDYVDLTLIHWPSPGDAVSVEEFMQALLEAKKQGLTREIGISNFTIPLMEKAIAAVGADNIATNQIELSPYLQNRKVVDWAKAHGIHITSYMTLAYGKALKDEVIARIAAKHNATPAQVILAWAMGEGYSVIPSSTRRENLASSLLAQDLHLDAEDKNAIAALDCNDRLVSPEGLAPAWD

SEQ ID NO: 80972 - protein, 397 aa, Silicibacter sp. TM1040
MNIHEYQAKALLRSYGAPVSDGRVVMKADEAKTAAGELDGPLWVVKAQIHAGGRGKGSFKEADAGEKGGVRLTKSVEEAAEEAKKMLGRTLVTHQTGPAGKQVNRIYIEAGSGIQTELYLALLVDRVTSRVSFVCSTEGGMDIEEVAAETPEKILSFSVDPATGYQAYHGRRVAFSLGLEGAQVKQCVKLMGQLYQAFIEKDMEMLEINPLIVADNGDLKVLDAKVGFDGNAIYRHADIAALRDETEEDPKELEASKYDLNYIALDGEIGCMVNGAGLAMATMDIIKLYGAEPANFLDVGGGATKEKVTEAFKIITSDKNVKGILVNIFGGIMRCDVIAEGVIAAVKEVGLEVPLVVRLEGTNVEKGKEIIANSGLNVIAADDLSDGAEKIVKAVKG

SEQ ID NO: 80973 - protein, 551 aa, Colwellia psychrerythraea 34H
MDIKKLSSLAHCAKTRSIVSLFDQKERANDFSLSTSHLYLDYSKQNITDVELEQLIEIAEDVGLSESITGQFNGDKINNTEGRSVLHTILRAPQVIKQQILGDTLANEVEAAELQMAKVVNDVQKGILTSHTGQRFTDVLAIGIGGSYYGVKVSLSALEHYRDLALSVHVIANVDGGALEEKLKTLNFETTLVVVISKTFTTQETMLNAKAVKQWMLSCASVKDLELNNVPLIIEKQWFAVSSNIEAAKEFGINIKHILPMWDWVGGRFSIWSTVGLPLALAIGNDNFNKLKQGAYEMDVHFKSTDFKNNMPVIMALLGIWNRNALEYPTLAILPYAHSLRALPGYLQQTDMESNGKSVSKSGDKLSWLTAPVVFGQEGTNGQHAFMQLMHQSDDIIPTDFIVALKGRSQYTENHKVLVANCFAQSEALMQGKTLTQVESELEMSALSTAEISLIAPHKTMKGNTPSNTLVMDLLTPETIGSLLALYEHKIFVQGVLWQVNSFDQWGVELGKQLGTRILSAIDGAEDDLLSASSQSLIARFRARSNVTPSV

SEQ ID NO: 80974 - protein, 536 aa, Synechococcus sp. WH 7805
MHLVMSFPDFSATDTQIQWQRFCDLLWYHDDLGIWLDVSRMHLNSAALDELTPPLEKAFDAMKKLEGGAIANVDENRQVGHYWLRDPRLSPDPEVSQHIASEVNDIEQFGKAVISGEIKSPTGQPFTDILWIGIGGSGLGPLLMVRALQDNGQGLPFHFFDNVDPNGMSRVLGELGNNLLTTLVVTVSKSGGTPEPHLGMEQARHRLESLGGQWAAQAVAITMSQSLLDQQASKEKWLKRFDMFDWVGGRTSITSAVGLLPGALIGTDIRDFLAGAAQMDEATRLADVRRNPAALMAAAWYFAGEGKGKRDMVVLPYRDRLEVFSRYLQQLVMESLGKRLDRSGAIAHQGIAVYGNKGSTDQHAYVQQLRDGVDNFFVTFIEVLRDVEDIPEIKGERPGDFLDGFVQGTRSALTEGGRQSLSISMRTFDARRLGALIALFERAVGFYGELVNINAYHQPGVEAGKKAAAAILKLQKQVEDVLSDGTSRSVLEIQQAIGEGSDEAIFWILRHLTGNNRGYQAQGTWDSPASLRFVKG

SEQ ID NO: 80975 - protein, 120 aa, Cryptococcus neoformans var. neoformans JEC21
MISQECFVGGLAISLLGAILLFLGATGAFATLFAVGGIISLIGTGFLIGFKTQLEKMFKPVRIVATVLMLASIIMTFVSAFVLPTILCIIFVIIQYLAYLWYSLSYIPYARTMVKNMVGW

SEQ ID NO: 80976 - protein, 246 aa, Dioscorea cayenensis
EDEFSYIEGSPNGPENWGNLRPEWKTCGNGMKQSPINLCDDKVIQTPALGKLRTSYQAARATLKNNGHDIMVNFKSDAGSQFINRVQYQLKRIHFHSPSEHALNGERYDLEIQMVHESQDQRRAVTAIMFRFGRSDPFLSDLEDFIKQISRSENFEVDAGVVDPRQLLQFDDPSYYRYMGSFTAPPCTEDITWTVIKKLGTVSPKQVLMLKQAVNENAINNARPLQPLKFRTVFLYPHQKPNHDAI

SEQ ID NO: 80977 - protein, 295 aa, Pseudomonas aeruginosa PAO1
MKSFENKVAAITGAGSGIGRALAVELGRQGCHLALADVNAAALEETRQLLASSGVRVSTAVVDVADREQVQAWADKAASEHGRVNLIFNNAGVAHAGTVEGSDYSEYEWIMNINFWGVVNGTKAFLPHLKASGNGHVVNVSSVFGLFAQPGMSAYNATKYAVRGFTESLRQELDMEDSGVSASCVHPGGIKTNIAKTARMNESMAKVTGQAPDKAREQFNDQLLRTTPEKAAQVILRGVQRDSRRILIGTDAHAIDVMLRLAPVLYQRLVTASMRLAARFAPRPKSPQGAREASE

SEQ ID NO: 80978 - protein, 181 aa, Triticum aestivum
MASDGRVERIASSIRAIPNFPKPGILFQDITTLLLDPQAFRDTTDLFVERYKDKDITVVAGVEARGFIFGPPIALAIGAKFVPIRKPKKLPGEVISEEYSLEYGTDKIEMHVGAVQPNDRVLIVDDLIATGGTLCAAAKLIERVGAKVVECACVIELPELKGRDKLGDMPVFVLVQADESV

SEQ ID NO: 80979 - protein, 209 aa, Kluyveromyces lactis NRRL Y-1140
MIFTDIEVAIEKFRQNKFVIVMDDESRENEGDLICAANAITTEQMAFLIRYSSGYVCAPMTNEWADRLDLPLLKDLSCESYADDRHGTAYTITCDYAHGTTTGISAHDRALTCSKLADKTTTAIDYLKPGHVVPLRAKEGGVLARRGHTEAAVDLCKLASLPPVGVIGELVKDEDGDMMRLDDCVEFGKEFDISIITLEALVDYIQKHQ

SEQ ID NO: 80980 - protein, 300 aa, Synechococcus sp. WH 5701
MSKRHPVVAVTGSSGAGTSTVKRAFEHIFQREGIVPAVVEGDSFHRFERGPMKEQMAQAQASGVNFSHFGPEANLFDKLAEQFQSYGETGGGQKRYYLHSVEEAAEHNARLGTQLEPGQFTPWEPIPSETDLLFYEGLHGGVVGDGYDVASLVDLLIGVVPIANLEWIQKISRDNAERGYSAETIVDTILRRMPDYINHICPQFSRTDINFQRVPTVDTSNPFICRNIPTPDESFVIIHFRKGAREKWGIDFSYLLRMINGSFMSSPTSIVVNGGKMGFAMELILTPIIHRMIEDKNKLA

SEQ ID NO: 80981 - protein, 357 aa, Synechococcus sp. WH 5701
MTSYRITLLPGDGIGPEITAVARRLLDAVSVRHGFGLTYDEQPIGGDAIDRTGVPLPETTLAACRSADAVLLAAIGSPRFDALPREQRPETGLLGLRSGLGLFANLRPVKIIPALIGASTLRPEVITGVDLLVVRELTGGIYFGTPKGRVEAEGRVRAFNTMVYADDEIDRIARVAFQLARERGGRLCSVDKANVLDVSQLWRDRVEVIAAEYPQVELSHLYVDNAAMQLVRAPRQFDVLLTGNLFGDILSDEAAMLTGSIGMLPSASLGAEGPGLFEPVHGSAPDIAGADLANPMAMVLSAAMMLRVGLKQEAAACELEAAVDRVLSAGYRTGDLMAEGCTQLGCSAMGEQLLAVL

SEQ ID NO: 80982 - protein, 286 aa, Oryza sativa Japonica Group
ETNFFRTSVRLIPSFRPFQVVRCFEDDDIVHVSGKVDPKSDIDVINLELIFSDLDQIEKRLDKLKKSKTKDQQVKVKEQAERTGLEKIQTVLMDGKPARSVDLADHEKEAIQHLCLLTMKPVIYVANVTESDLAEPGNNPHVKEVAKLATDLESGMVTISAQVEAELAELPLEERVEYLKSLGVTESGLGNLVKATYDLLGLRTYFTTGDKETKAWTILAGMTAPQAAGVIHSDFQKGFIRAETVSYDDFVAAGSLGVAREKGLLRLEGKDYIVQEGDVMLFRFNV

SEQ ID NO: 80983 - protein, 244 aa, Vitis vinifera
MDFFNQFCNSYPFPSDSHSVSTPESSSASDWQTRRTIQSDEEVLLASDRPKKRAGRRKFKETRHPVYRGVRRRNGNKWVCELREPNKKSRIWLGTYPTAEMAARAHDVAALAFRGRKACLNFADSAWSLPVPVSKDSMEIRRAAAAAAEAFRPQEFQDHSSGDARKESVEAAESVARTDRRPESIKTSAQNLLLTREELIFDTAGLLITMAEEPLHSPPPCLGDGFMWEDVELDADMSLWSYSI

SEQ ID NO: 80984 - protein, 198 aa, Triticum aestivum
MEAQNGAGGGAPVVLNVYDLTPMNNYLYWFGLGIFHSGIEVHGMEYGFGAHEFPTSGVFEVEPKSCPGFIYRRSVWMGTTDMSRAEFRSFIENLAGKYNGNTYHLISKNCNHFTDDVCKNLTRKSIPGWVNRLARVGSFFNCLLPEGIQVSTVRHVPTHPAFSDDDMDSVSSSIIGDSDLEELDQHLLPSTTDAHSID

SEQ ID NO: 80985 - protein, 176 aa, Synechococcus sp. WH 5701
MPTVLVRDGQNRQLLCFLEQLIPLDGHDYALLTPVDTPVCLVRIAEGDDEEDEVVEEVDAAESILTVADVVLQEHDLTLVRSAVTLTVSGELEEPDPDDLEDDLQGDGDGDEETDLYEMLIQFRAEDQEYGLYIPLDPFFVVARMQNNEAVLVEGEEFERVQPRIEAELEDRESVG

SEQ ID NO: 80986 - protein, 79 aa, Xanthomonas albilineans
MSTIEERVKKIVVEQLGVKEEEVTNSASFVDDLGADSLDTVELVMALEEEFECEIPDEEAEKITSVQQAIDYVKVHVKS

SEQ ID NO: 80987 - protein, 349 aa, Gibberella zeae PH-1
MRLLSLLSVVTLAVASPLSVEEYAKALDERAVSVSTTDFGNFKFYIQHGAAAYCNSEAPAGAKVTCSGNGCPTVQSNGATIVASFTGSKTGIGGYVATDPTRKEIVVSFRGSINIRNWLTNLDFDQDDCSLTSGCGVHSGFQNAWNEISAAATAAVAKARKANPSFKVVSVGHSLGGAVATLAGANLRVGGTPLDIYTYGSPRVGNTQLAAFVSNQAGGEFRVTNAKDPVPRLPPLIFGYRHTSPEYWLSGSGGDKIDYTINDVKVCEGAANLRCNGGTLGLDIDAHLHYFQATDACSAGGISWRRYRSAKRESISERATMTDAELEKKLNSYVEMDKEYIKTHANRSS

SEQ ID NO: 80988 - protein, 305 aa, Cryptococcus neoformans var. neoformans JEC21
MTAIQSFRKAAIIGAGQMGLGIAYVTAVHARVPLTLHDPSSAVLSQAMSRVQSLLSKDVSKNRMTQGEADEALARINPVKGDGSGLNGDEKLKDVDIVIEAIPEIPELKLGLFKRLGDLLPPTSILGSNTSSISLTKLAASAGSMGGAQGKSSAERVIGIHYFNPVPVMKLVEIIPALQTSKQTIDQATAFGKACKKEVTHSADSPGFIANAILMPMLNEAIMVLEKGIASTEHIDATFRLGMGHPMGPLALADLIGLDTCLSIQRVLHTETGDSKYRPAGLLVRMVDAGWLGKKTGKGFYEYAG

SEQ ID NO: 80989 - protein, 203 aa, Nicotiana benthamiana
MGNTEKLMNQIMELKFTSKSLQRQARKCEKDEKSEKLKVKKAIEKGNMDGARIYAENAIRKRSEQMNYLRLSSRLDAVVARLDTQAKMTTISKSMGNIVKSLESSLATGNLQKMSETMDKFEQQFVNMEVQAEFMESSMAGSTSLSTPEDQVNSLMHQVADDYGLEVSVGLPQAAGHAIPTKDSEKVDEDDLTRRLAELKARG

SEQ ID NO: 80990 - protein, 227 aa, Brassica napus
  misc_feature (143)..(143): Xaa can be any naturally occurring amino acid
  misc_feature (220)..(220): Xaa can be any naturally occurring amino acid
MATKIGMMDSAYFVGRSEILAWINSTLQLNLSKVEEACSGAVHCQLMDSVHPGAVPMHKVNFDAKSEYEMIQNYKVLQDVFNKLKITKHIEVSKLVKGRPLDNLEFMRWLKRYCDSVSGGGHLHSYHALERREACNGGKEATXRAAAATQQSAKGSSSSSSVAPRPSSSNGTRRLEPPSSNTGNHHSSKAPFSKQSKPVPAAYDEKITELKLYIDSLEKXERDFYFS

SEQ ID NO: 80991 - protein, 72 aa, Triticum aestivum
IATVVVRYILNQTSVAGSMVGVRLGLSEHIKDTNAIFSLELDEEDMNSITEVSKKGRNLMDIIGDCGDEYRA

SEQ ID NO: 80992 - protein, 558 aa, Rubrobacter xylanophilus DSM 9941
MAAVVIAAMLVPQGMAYALLAGLPASYGLYASTVPAVVYALFGTSRHMPVGPPALMALLTFTSVSELAEPRTPEYISLALLLALMVGVLQLVIGFLRMGFIVNFISHPVLSGFIYASAVLIALSQLEHMLGTPVSGGHSTVEVVLEHAKRIEEANPWTLAVGLGSLASLVVLGRALPRLPAALVVVAAATLVVYLSGLDDKGVNVVGRVPGGLPGLSLPALDPEAVRTLAPSAAVVAFVGFIESVSVAKAIAAREKYKIDSNQELRALGLANISAAFFSGFPVAGSFSRTAVQYQSGGRTQLASVATALLVLLVLLFLTPLFYYLPSAALAAVILVAVYKLLDFREAWRIFRIRRVDGYALLITFVFTLLVGVEQGIVVGAGFALLAFIRRTAYPRITELGYVPEKDAFLGVESNPGAKTFPEALIARFDARLYYANVPFLEEWLLKRVAERPELKWVFLDCRGVNDIDVTAIEGLEDLLSGYRSRGIEIIFTHMKLPVREQLEKAGWDTKFGGRGRRYCYQTTREAVRAVGLPVAGGASSPERRPWRRSVPGDGRSG

SEQ ID NO: 80993 - protein, 484 aa, Medicago sativa subsp. x varia
MRKSVTLKAGEVPSRLTRARAVALSTSGQLPPMKEVAPGTQNQKQPLRANSKRAVSDVTYLPHEMRAILQDVTNNCGENTNRSCLNPTEIQAKKRKVAKPAQPDVSNEVPSAAERPPFIADSKPVSSMEMRLRSSEDFRCLDDLEDNAPFRMSSNQSGTNNNLLQNQTSRISARLLSSQKKASQIVAAKKGNISELLDVSKHPDVADIDADFEDPQLCSHYAADIYDHLRVAELSRRPYPNFMETVQQDITPSMRAILVDWLVEVSEGYKLQANTLFLTVYLIDWFLSKNCIERERLQLLGITCMLIATKYEEINAPRIEDFCFITDNTYVKEEVVKLESLVLKSSSYQLFAPTTKTFLRRFLRAAQASYKRPSIELEYLANYLAELTLMNYGFLNFLPSMVAASSVFLARWTLDQSSHPWNPTLEQYASYKASDLKATVLALQDLQLNSNDDCPLTAIRKKYTQDKLNCVAALSSPKLLETLF

SEQ ID NO: 80994 - protein, 235 aa, Pinus pinaster
MSSRLFRCSCPNCQDSCCFFSEIFSFTRRKGNSCSASSCRGKVSSLVSLSSHGDYQSAYRQWISGALALPAAVYMLQDPSAEAAELERTFIAIKPDGVQRGLISEIVSRFERKGYKLVAIKLVVPSKQFAEQHYEDLKERPFFNGLCEFLSSGPVLAMVWEGQGVIKYGRKLIGATDPQNSEPGTIRGDLAIIVGRNIIHGSDGPETAKNEINLWFKPEELVNYAHNSEKWLYGK

SEQ ID NO: 80995 - protein, 43 aa, Pinus pinaster
ITDKLGLHSLRQRHWYIQSTCATSGEGLYEGLDWLSNNIANKA

SEQ ID NO: 80996 - protein, 331 aa, Chlamydomonas reinhardtii
MEWTTIESDPGVFTELIENIGVKGVQVEELWSLDQLRELSPVFGLVFLFKWKKEPVRPATTTDAGQVFFAKQVISNACATQAILNILLNVKAPGLDLGTELANLREFVSDFDPTMKGLAISNSDLIRTAHNSFARPEPLVPDNDKDDEKSGDAYHFISYVPVGGKLFELDGLQEGPIELCDCTDDDWLDKVGPHITARMERYAASEIRFNLMALVGNRVDIFSSRLAAATAQRDQLAAAAAAADGMSDEDLAHAQAKLLEAETEVANLQEALAAEQAKHRTWHEENVRRKHNYVPCLFQLLKLMAARGQMGPLLERARRPAAAGGGNGTKQ

SEQ ID NO: 80997 - protein, 560 aa, Synechococcus sp. WH 7805
MEFELRTSRALPESVDQSTQSQTLFDTIPDALKAIRNGECVVVVDDERRENEGDLICAAQFATPEQINFMATEARGLICLAMQGDRLDSLDLPLMVDRNTDANQTAFTVSIDAGPEHGVSTGISAEDRSRTIQVAIQSESRPSDLRRPGHIFPLRARPGGVLKRAGHTEAAVDLAQLAGLNSSGVICEIQNADGSMARLPELQDYARQWGLRLISIADLIRYRLENERFVVRQAQASLPSQFGSFQAIGFRNALDGSEHVALVKGTIGSMKEPVLVRMHSECLTGDAFGSLRCDCRGQLEAALRRIEQEGEGVLVYLRQEGRGIGLINKLKAYSLQDGGLDTVEANEKLGFAPDLRNYGVGAQILSDLGIHRLRLLTNNPRKIAGLGGYGLEVVDRVPLEIDPGDYNAQYLATKREKLGHLFEERPERSHWVIGLDTDATGETVLSKLVQRMEQLALEHKLQLQAEHNPRLLALWERPRFVWSIQNSDPTLSVVQKLLVTMASWQETSRIGVLHAVKTIQISHPPQWLNREERSLESLRSTMEKADWFQRENQPALIHWS

SEQ ID NO: 80998 - protein, 353 aa, Aspergillus oryzae
MGCGMSTEDKEGKARNEEIENQLKRDKMMQRNEIKMLLLGAGESGKSTILKQMKLIHEGGYSRDERESFKEIIYSNTVQSMRVILEAMESLELPLEDARHEYHVQTIFMQPAQIEGDNLPPEVGNAIGALWRDSGVQECFKRSREYQLNDSAKYYFDAIERIAQPDYLPTDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGADYAAACDYILNRFVSLNQAEQKQIYTHFTCATDTTQIRFVMAAVNDIIIQENLRLCGLI

SEQ ID NO: 80999 - protein, 182 aa, Pseudomonas aeruginosa PAO1
MIFDEFTLKSQIRAVPDFPKPGVVFRDITPLFQSPRALRMTVDSFVQRYIEADFSHIGAMDARGFLIGSAVAYALNKPLVLFRKQGKLPADVLAEGYQTEYGEAFLEVHADSLCEGDSVLIFDDLIATGGTLLAAASLVRRLGARVFEAAAIIDLPELGGSTRLQDAGISTFSLTAFALDER

SEQ ID NO: 81000 - protein, 579 aa, Ustilago maydis 521
MPAFPSSSAANSAGRHIELRSDNAYVQHLVHVINTVLERTGLALPVLVLTLLFLTIKYHNRTIFAKPPRKELYSPPAWPLIGHTLQAMKYTDNILDWFLEQSRKHPVGFSASIAGTGSGQMNFIYRPEYIEYVQKTNFENFEKGQAVKTRFSDLLGQNGIFNSDGHVWKTQRKMASHIFSVYQFRTWVQTVVQREMDSVVGILDALTEGKSSSDPATLLLPDLFFRYTLSSFGKMAFGSDIDCLSADPSCLEREVEFSNAFDFVQMVIDKRFRKPMWQLIERFSSEGRKNARMVKKINSFSGQIIEQRLREREAGIQKEKMTSDGKEGKDLLDLFMDITTDRDDLISVVLNFIIAGRDTTAQGLSWLFYELMKNPQYVEEIRSEIRNVLGNTDGSIRKLDYDTTKDLVFTQACFNEAIRLHPPVPKNGKRAIKDDVVVPQGPTAAGLPPIKIYAGELLSWSDWVIARNPEVWGPDCCEFKPMRFIETVTNEDGTKTRSLKNFGQWKFHVFNGGPRLCLGMTLANYEALSIIAAVMNRYDFGWGTKAQGQTADWPLKYLPSVTHPSQMYTATVVRRDELM

SEQ ID NO: 81001 - protein, 520 aa, Colwellia psychrerythraea 34H
MANKKSTVLMILDGWGYREETSSNAIHQANTPVLDNLKAKYPNMLIDTSGMAVGLPEGQMGNSEVGHVNLGAGRVVYQDFTRITKAISDGDFIENPTLCHAVDTATSNNKAVHIFGLLSPGGVHSHEEHIFAMMELAKKRGAQKVYLHAFLDGRDTPPRSAQASLEKAQQKFSKLFTETDTGEGQIASVIGRYYAMDRDQRWDRVEAAYNLMVNGEGLHQYNSALDALAAAYERNENDEFVGASAITSPSGKAIKVNDGDALIFMNFRADRARQFSRCFTDTNFNGFERKRIPAISNFVMLTQYAADIDAPSAFAPTPLTNVMGEWLAKHNKTQLRISETEKYAHVTFFFSGGKEDMFTGEERILVPSPDVATYDLQPEMNSTLLTDKLVGAIESGKYDFIVCNYPNGDMVGHTGSFDAAVKACEAVDTCVGRVVKAAQDNGGECLITADHGNAEQMQDPVSGQAHTAHTCEPVPLIYVGRNASPAASGTLSDISPSVLHLMGMEQPQEMTGSVLMQLIK

SEQ ID NO: 81002 - protein, 203 aa, Brassica napus
MAKKIGVTMEVGNDGVAVITISNPPVNSLASQIISGLKEKFQDANQRSDVKAIVLTGNGGRFSGGFDINVFQQVHKTGDISLMPEVSVDLVCNLMEDSRKPLVAAVEGLALGGGLELAMACHARVAAPKAQLGLPELTLGVIPGFGGTQRLPRLVGLAKATDMILLSKSISSEEGQKLGLVDALVPPGDLLTTSQKWALDIAL

SEQ ID NO: 81003 - protein, 473 aa, Geobacillus thermoleovorans
MTRGRVIQVMGPVVDVKFENGHLPAIYNALKIQHKARNENEVDIDLTLEVALHLGDDTVRTIAMASTDGLIRGMEVIDTGAPISVPVGEVTLGRVFNVLGEPIDLEGDIPADARRDPIHRPAPKFEELATEVEILETGIKVVDLLAPYIKGGKIGLFGGAGVGKTVLIQELIHNIAQEHGGISVFAGVGERTREGNDLYHEMKDSGVISKTAMVFGQMNEPPGARMRVALTGLTMAEYFRDEQGQDVLLFIDNIFRFTQAGSEVSALLGRMPSAVGYQPTLATEMGQLQERITSTAKGSITSIQAIYVPADDYTDPAPATTFSHLDATTNLERKLAEMGIYPAVDPLASTSRALAPEIVGEEHYQVARKVQQTLQRYKELQDIIAILGMDELSDEDKLVVHRARRIQFFLSQNFHVAEQFTGQPGSYVPVKETVRGFKEILEGKYDHLPEDRFRLVGRIEDVVEKAKAMGVEV

SEQ ID NO: 81004 - protein, 379 aa, Vibrio parahaemolyticus RIMD 2210633
MSKLALLVLEDGTVFRGVSIGADGVSVGEVVFNTSMTGYQEILTDPSYSQQIVTLTYPHIGNTGTNSEDEESSSIHAQGLVIRDLPLIASNFRNEQSLSDYLKSQNIVGIADIDTRKLTRILREKGAQNGCIVAGNNLDEALALAKAKEFPGLKGMDLAKEVTTKEAYQWKQGSWTLESGLPEAKDDSELPYHVVAYDFGAKRNILRMLVDRGCRLTVVPAETSAEEVLALNPDGVFLSNGPGDPEPCTYAIEATKVFLEKGLPIFGICLGHQILALASGAQTVKMKFGHHGANHPVKDLERNVVMITSQNHGFAADEATLPENLRATHVSLFDGSLQGIHRTDKPAFSFQGHPEASPGPHDAAPLFDHFIELIKKHSA

SEQ ID NO: 81005 - protein, 279 aa, Zea mays
  misc_feature (260)..(260): Xaa can be any naturally occurring amino acid
MDTAIGSVPAASDAARLPAPSASAPRDATLGRHLARRLAEVGARDVFTVPGDFNLTLLDELEAEPGGVRLVGCCNELNAAYAADGYARARAGGVGACAVTFTVGGLSAINGVAGAFSENLPVVCIVGGPNSNDYGSNRILHHTIGLPDFTQELRCFQNVTCYQAVVNNLEDAHEQIDTAISTAIKESKPVYISISCNLPSIPHPTFSRHPVPFFLSPRLSNQMNLEAAVEAAAAFLNKAVKPVLVGGPKMRVSQACEALXELADACGYPVAVMPSAKGL

SEQ ID NO: 81006 - protein, 414 aa, Schizosaccharomyces pombe 972h-
MGQTLSEPVTEKHSVNGSNEFVLYGLSSMQGWRISMEDAHSAILSMECSAVKDPVDFFAVYDGHGGDKVAKWCGSNLPQILEKNPDFQKGDFVNALKSSFLNADKAILDDDQFHTDPSGCTATVVLRVGNKLYCANAGDSRTVLGSKGIAKPLSADHKPSNEAEKARICAAGGFVDFGRVNGNLALSRAIGDFEFKNSNLEPEKQIVTALPDVVVHEITDDDEFVVLACDGIWDCKTSQQVIEFVRRGIVAGTSLEKIAENLMDNCIASDTETTGLGCDNMTVCIVALLQENDKSAWYKKIADRVAANDGPCAPPEYAENHGPGWRSGDNNKKVIVPPNFHQVKLNGSDGYDKDANENSKEDDSTNGSLAAGFRWKEHFFPHKAEEENSSSETDIVNSNKDVADDHKEAVSAAD

SEQ ID NO: 81007 - protein, 78 aa, Moritella marina
MSNFEERVKKIIIEQLGVKEEEVKNEASFVDDLGADSLDTVELVMALEEEFDTDIPDDEAEKITTVQAAIDYVVSSAE

SEQ ID NO: 81008 - protein, 76 aa, Deinococcus radiodurans
MATFDDVKDVIVDKLGVDEGKVTPEARFVEDLGADSLETVELIMGLEDKFGVTIPDEAAETIRTVQAAVDYIDNNQ

SEQ ID NO: 81009 - protein, 478 aa, Arabidopsis thaliana
RPWDCWKMESVKPLDVVSSGKGKLRRTFAKVINMKKLTGVVPEGNNKVERVKKSQEKVKLDKDLAKNAANLSESFDKLEEEYEKRLAMEALLAKLFATISSIKSGYAQLQYAQSPYDPNGIQKADNLVVAELKTLSELKQSFLKKQLDPNPDRTLVLAEIQELRSVLKTYEIMGKKLECQLKLKDSEIIFLKEKFQESMTQNKLMEKRLNQSGQLCNPLDHNLHLSAVSSTHFVTYLHHTVKSIRGFVKLMVEQMKLAAWDIDMAAELIQPDVLYYKQDHKCFALEHYVCKIMLEAFQLPYFSNESSKKTSREDKAMFFERFTELRSMKPREYLASRPKSRLAKFCRTKYLQLIHPKMEQAFFGHLHQRNQVTAGEFPETSLCTAFLEMAKRVWLLHCLAFSFDPEASIFQVSRGCRFSEVYMKSVSEEAFFSPEQEESSSETEPGVAFTVVPGFRIGKTTIQCEVYLSRSCQRRQSR

SEQ ID NO: 81010 - protein, 567 aa, Streptococcus mutans UA159
MEKIYLENPKSGSEILLDTLANLGVKTIFGYPGGAVLPLYDAIYKQDNIRHILARHEQGAVHEAEGFAKSTGKLGVAIVTSGPGATNAITGIADAMSDSVPMLVFTGQVATPGIGKDAFQEADIIGITMPITKYNYQIRETADIPRIVTEAVHIATTGRPGPVVIDLPKDVSEKRVSSFNETTIKIPGYQPTIEPNNLQVKKILSQLKKAKKPLILAGGGVNYAGASAELIAFAERYKIPVVSTLLSLGVMPIEHPLSLGMGGMHGSYASNMALTECDFLINFGSRFADRLTGNPKTFAQKAVVAHVDIDPAEIGKVVKTAIPVVGDAKKTLKQLLESDKVSTRHREWTDKVLQDKAKAPFSYKFDQEVIKPQHAIETIGKLTKGDAIIITDVGQHQMWAAQFYPYKNERQIITSGGLGTMGFGIPAAVGAKLANPGKEVVLFVGDGGFQMTNQELAILNGYGVPIKLVLINNHSLGMVRQWQESFYDERRSESTFDDEPNFQLLAESYGISHYKLDNPLTLEKDLEVILENKPMLIEVDISNREHVYPMVPSGKSNAEMLGVTFNA

SEQ ID NO: 81011 - protein, 160 aa, Streptococcus mutans UA159
MRRMLTAKLQNSTGVLNRFTGVLSRRQVNIESISVGHTEIPNISRITIIIDVDSLEEVEQIMKQLNRLIDVVRVRDITDKPHLEREVILIKVAAPTSKRAEILAIIQPFRASVIDVAPKSITIQMTGDADKIEALIRVIQPYGVKNIARTGATGFTRDLS

SEQ ID NO: 81012 - protein, 588 aa, Arabidopsis thaliana
  misc_feature (565)..(565): Xaa can be any naturally occurring amino acid
MAHSQVAYLIPLKADLKEDNSSPRITLSEGPNIIGRGNVSIVDKRLSRKHITIIVSTSGSASLSVDGTNPVVIRSSGDGERKKVKPSEEVSVCNDDLIELIPGHHFFKLVLLNGRAAKKARKAEDDVEAIRRFCPPNEKLPSTFRLLSVDALPDWANTSCVSINDVIEGDVVAAILSNYMVDIDWLMSACPKLANIPQVMVIHGEGDGRQEYIQRKKPANWILHKPRLPISFGTHHSKAIFLVYPRGVRVVVHTANLIHVDWNNKSQGLWMQDFPWKDDDKDPPKGCGFEGDLIDYLNVLKWPEFTANLPGRGNVKINAAFFKKFDYSDATVRLIASVPGYHTGFNLNKWGHMKLRTILQECIFDREFRRSPLIYQFSSLGSLDEKWLAEFGNSLSSGITEDKTPLGPGDSLIIWPTVEDVRCSLEGYAAGNAIPSPLKNVEKPFLKKYWARWKADHSARGWFLLTSSNLSKAAWGALQKNNSQLMIRSYELGVLFLPSPIKTQGCVFSCTESNPSVMKAKQETKDEVEKRSKLVTMTWQGDRDLPEIISLPVPYQLPPKPYSPXRCSMVMGPRLLEERCVWTSLAKI

SEQ ID NO: 81013 - protein, 168 aa, Glycine max
MIFSPSVTTVNRAGAGVVALFTGLMSMAGFPTENTNSDITYIASNCGRVQCVRVWPPFGKKKFETLFYLPDLDDAQLAREVIYLLRKGWIPCLEFELEHGFVYREHNRSPVLYYGLYWTMWKLSMCGCSDASHVLRDLLDAKSAYPCGFMRIIICHNVTQVHRISFIV

SEQ ID NO: 81014 - protein, 511 aa, Methylobacillus flagellatus KT
MSNAVPSGLSPAQIKTNVLSGLTVALAMVPETIAFAFVAHVSPLTGLYAAVIVSFITSAFGGRPGMISGAAGSLAVVMTALVVQHGVEYLFATVVLMGVLQVLFAVARMGKYIRMVPYPVMLGFVNGLAMVIFFAQFNHFKVAADDGSLQWMSGPLLYTMLGLVGLTMAVIYLLPRVTRVVPSALVAIVMVSAAVAVMGLETRTVGDLGSIAGGLPSFHVPQVPFNLETMKIIFPYSLILAAIGLIETLLTLNLIDEMTNTRGQPNRESMAQGAANVATGFFSGMGGCAMIGQSMINMNAGGLHRLSGIAMSAFLLSFILFASHWIEMIPLAALIGVIFVMAIKTFEWGSFRLFGKIPVPDIFVGILVAIITLISDLAIAVLVGVIVSALVFAWEHAKEIAATTYIDEAGRKVYRLKGSVFFASIANFQALFTPQEDPVQVVVDFKQAKVVDHSALAAIDALAERYAQQGKQLSLKHLSPDCRALLGRARDLVEVNLLEDPTYPVADDKLG

SEQ ID NO: 81015 - protein, 416 aa, Streptococcus mutans UA159
MISAKDVVAANKVLKDVVVQTPLDFDRYLSEKYGATIYLKRENMQKVRSFKIRGAYYAISQLSDEEKARGVVCASAGNHAQGVAYTCNEMKIPATIFMPVTTPHQKIGQVQFFGGSFVTIKLVGDTFDASAQAAQDYTKAEGMTFIDPFDNDMVQAGQGTIAYEIYDQAQEDGLSFDAILVPVGGGGLISGVSAYVKDVAPEIEVIGVEAMGARSMRAAFDKGHPVKLEHIDKFADGIAVQKVGRSTYDVARKYVDRLIGVDEGLISETLIDMYSKQGIIAEPAGAASIAALEEMKDDIKGKTIVCIISGGNNDINRMQEMEERALIYDGVKHYFVVNFPQRPGALREFVNDILGPNDDITRFEYIKRANKGTGPVLIGITLADKNDYQDLIDRLGAFDPGYINLHGNESLYNMLV

SEQ ID NO: 81016 - protein, 275 aa, Oryza sativa Japonica Group
MADRVHPMPAPPPPSSSPPPGHDAAAATETTPLHPSFRGAPPPSPGTYIIQIPKDQVLRVPPPDRARRYKKLAARPARRRRLRHACCGAFCGVLLLLLLAAAFVGVVYLVFRPLAPSFSVASLSIRGLDALAVSSLTPQIDAAVRADNGANKKTGIDYRGGGEVTVSYSGERLAAGPWPAFHQAPRNVTVFSTALAGGGVSLTEEQRKQLAADQAAGAVPLAVDAIVPVRLRFGKVLRTWTVDVKARCEVTVNKLAAAPANRGCMVKVRPLWWWW

SEQ ID NO: 81017 - protein, 345 aa, Vibrio campbellii AND4
MLKVAINGFGRIGRNVLRAVYESGKHQQIKVVAVNELAQPEAMAHLLQYDTSHGRFGKKISHDQEHIYIHHSSSEYDSIRILHLAEIELLPWRDLEVDIVLDCTGVFGSQADGQAHIEAGAHKVLFSHPGAGDLDNTIIYGVNHETLKDEHRVVSNGSCTTNCIVPIIKVLDEAFGIESGTITTIHSSMNDQQVIDAYHNDLRRTRAASQSIIPVDTKLHRGIERIFPKFSNKFEAISVRVPTVNVTAMDLSVTISSTVKVNDVNQTIVNASQCTLRDIVDYTESPLVSIDFNHDPHSAIVDGTQTRVSNGQLVKMLVWCDNEWGFANRMLDTALAMQASSQVEQ

SEQ ID NO: 81018 - protein, 344 aa, Neurospora crassa
MQSIRRAALRSALSASRAISTQAPAASFSASIARTALVSSRIQAIRFFSQSPRVLNTEEPTQPEQTETETAPAATEEAAVQKDTTEGHAAFVRNIVFDATEEHLKGAFEKFGNVTDVFLARDPRGLSKGYGFVTFATREALEEACSQVDGSFWHGRRISVEPRRAKVNRGSAVGEPSACLFIGNIPYETTDAELNNIFVGIDGLKDVRVAVDRATGWPRGFAHADFVDVEAAVNALEKLQGTQLGERTIKIDYAQPAAARQPRENNGERREYRPRQQRDGQRDGQRSYNRDGGNRSYNREGGNRNYNRDGGNRSYNREGGDRSYNREGGDRNYNRRDQGESTEF

SEQ ID NO: 81019 - protein, 386 aa, Vibrio campbellii AND4
MSVIKMTDLDLAGKRVFIRADLNVPVKDGKVTSDARIIASLPTIKHCLEAGAKVMVTSHLGRPTEGEYAEEFSLQPVVNYLNDALDCEVKLAKDYLNGLELNAGELVVLENVRFNKGEKKNEEELSKQYAALCDIFVMDAFGTAHRAQASTHGVGMHADVACAGPLLANELDALGKAMDKPARPMVAIVGGSKVSTKLTVLESLSKIADQLVVGGGIANTFIAAAGHNVGKSLYEADLVETAKKLMDECAIPVATDVACAKAFDENAEAEIKHVSEVQDDDMIFDLGPDSTAQLAEILKGAKTILWNGPVGVFEFKNFEAGTKGISEAIAASEGFSVAGGGDTLAAIDKFGIKADVSYISTGGGAFLEFVEGKALPAVEMLEARAK

SEQ ID NO: 81020 - protein, 238 aa, Ustilago maydis 521
MSSINWNAPISLDSQLMALTRSSHRSIPLINTLTLSRRTLLGTGAIVACIAAISSGHLHTISATRASSSAAAPFKSHLRLFSSSPATAFKMGSTASSRSAPESFPKGMSDSEWRTKLNPEQFRILREKGTEMAGTGKYNKHYPKDGVYTCAGCDSPLYKATTKFDSGCGWPAFFDAIPGAIDRHSDRSWGMERIEITCKNCGGHLGHVFKGEGFNTPTNERHCVNSVSINFDKDEAKI

SEQ ID NO: 81021 - protein, 449 aa, Escherichia coli K12
MSEIVVSKFGGTSVADFDAMNRSADIVLSDANVRLVVLSASAGITNLLVALAEGLEPGERFEKLDAIRNIQFAILERLRYPNVIREEIERLLENITVLAEAAALATSPALTDELVSHGELMSTLLFVEILRERDVQAQWFDVRKVMRTNDRFGRAEPDIAALAELAALQLLPRLNEGLVITQGFIGSENKGRTTTLGRGGSDYTAALLAEALHASRVDIWTDVPGIYTTDPRVVSAAKRIDEIAFAEAAEMATFGAKVLHPATLLPAVRSDIPVFVGSSKDPRAGGTLVCNKTENPPLFRALALRRNQTLLTLHSLNMLHSRGFLAEVFGILARHNISVDLITTSEVSVALTLDTTGSTSTGDTLLTQSLLMELSALCRVEVEEGLALVALIGNDLSKACGVGKEVFGVLEPFNIRMICYGASSHNLCFLVPGEDAEQVVQKLHSNLFE

SEQ ID NO: 81022 - protein, 665 aa, Cytophaga hutchinsonii ATCC 33406
MTMPLQCLKTLISRTTMSTNINSNNLPDVSSLEKLANELFLALPGNFPNPESLREKLNSSSGSDAAFGQTERFNLKDPQTSFQNPHSYEPQQALPSGSGLGISPSVLQHTNTIDVQALQNLIPGESYKGGITPYSPTDQGNAVNASDPQTSFAEPKHESRGIPTSLSGSGISPSALQHGQKPDKLPTVHEQAYGNDLTSILTSINTFELSPQLPLVNDSSFYFLSETRNYGSNTKVNQQQHTSVKEVHTPGGILSKPFDVNLIKKDFPILQERVNGRPLIWLDNAATTQKPKQVIDRISYFYEHENSNIHRAAHELAARATDAYESARQKVQTFINAGSINEIIFVRGATEAINLIAKSWGEQNLQAGDEIIVSHLEHHANIVPWQQLAAKKGLKLRVIPVDDDGQIILEEYAKLLGPKTKLVSFTQVSNALGTVTPAKKIVELAHQAGAKVLVDGAQSISHMRVDVRNLNCDWFVFSGHKVFGPTGIGVVYGKEDLLNETNPWQGGGNMIVDVTFEHTTYHKAPGRFEAGTGNIADAVGLGAALDYVSRLGIDVINQYEHYLLVYATKLLKDIPGLRLIGTAEDKASVLSFVFDGYKTEEVGAALNQEGIAVRSGHHCAQPILRRFGLEATVRPSLAFYNTCSDIDVLVETLYRLRSGHKRAIR

SEQ ID NO: 81023 - protein, 287 aa, Cytophaga hutchinsonii ATCC 33406
MMKENINTQSLIDLLRKTHHAEWEATPSAHDAITWLGDLVQFLFPSNHLPKQSSYEGILKKNQIDLENILLSYVEAHKLNIEQAVSSFYNGLGNLYQNLREDASKINEFDPAATSVNEVIVSYPGFYAITVYRIAHKLAELNIPILPRILSEYAHGKTGIDIHPNASIDVPFVIDHGTGIVIGATSVIGKNVCIYQGVTLGALHVSKIMAEIKRHPTVEDNVVIYARTTILGGNTVIGKNSIIGGSVFITKSIEPDSQVFNTHQLRISNIHARTFDENRGVVLKKQS

SEQ ID NO: 81024 - protein, 464 aa, Picea sitchensis
MISTTAGEVISYKVFGTRDHLGRSTVQGNSQALLQAKFSHSKAIWGDRPYKENAKLYCRRSCRMQSAQTHKKPFEDQIDPSSKMASSTAGQVITCKAAVAWGPGQPLKIEKVEVAPPQAMEVRIKVHYTALCRTDLVFWEAEGQTPLFPRIFGHEAAGIVESVGEGVTDLKVGDSVLPVFTGECKECRHCKSEESNMCDLLRINTERGVMISDGKSRFSIDGKPVYHFLGTSTFSEYTVVHVGCVAKINPEAPLNKVCILSCGVSTGMGATLNVGKPKKGSTVAIFGLGSVGLGAAEGARIAGASRIIGIDLNSDRYEQAKLFGVTEFINPKDHKKPVQEVIAERTNGGVDCSIECTGNVKAMVQAFESCHDGWGVSVLVGVPHADAVFSTNPVNFLNERTLRGTFFGNYKPRSDLPGLVEMYLNKELELDKFITHEVSFADINKAFDYMIKGESLRTVIKVSD

SEQ ID NO: 81025 - protein, 317 aa, Bacillus pumilus SAFR-032
MKKLVYFNHDGGVDDLVSLFLLLQMEHLKVIGTSVIPADCYLEPALSASQKIIDRFSPYDIEVAASNSRGVNPFPKEWRMHAFYVDALPILNEKGTVDTNVSKLPAHLHLIETVKKAAEPVTLLFTGPLTDLARALEEDPSISNKIEKLVWMGGTFLEKGNVEEPEHDGTAEWNAFWDPYAVSTVFKERFPIDMVALESTNQVPLTLDVRQRWASLRSHIGIDFIGQCYAFCPPLIHHETNSTYYLWDVLTTMTLASSSFTHSKEVNTIVYTDTPRQGRTEEHPDGKSIQVIDHVDRDAFFHAFEELMRKAVCQIST

SEQ ID NO: 81026 - protein, 382 aa, Pyrocystis lunula
LFLLLLRPPPEHASNSTSPGPLPPSSPCTHSDLTPATAMAAGSDTKAAINGFGRIGRNVLRCWLKKETKPFDVVAINVGSMGAKAAAHLLKYDTVLGTLQANVSFTDDEITIDGKSFKVVSGRDPAAMPWKDMGVEVIIESTGAFNSLEGGSKHLEAGAKKIVLTAPGKNCPTYVVGVNEGDYDAENDTVVSNASCTTDGMASVCKVLDESFGVEYGMMTTTHSYTGDQMILDGRHRDLRRARAGACNIVPTSTGAAKAVAEVLPKYKGKLNGIALRVPTPNVSIVDLVVKVSKKCTKEEVNAAVKAAADGPMKGIINFEEQPLVSSDFMQTDYSNSVDVALTMVMGEDLVKVVMWYDNEWGYSQRVLDLTAIVAAKLPVAA

SEQ ID NO: 81027 - protein, 470 aa, Vibrio parahaemolyticus RIMD 2210633
MSQNVYQFIDVQRVDPAKKPIKIRKIEFVEIYEPFTKQQATAQADRCLDCGNPYCEWKCPVHNYIPQWLKLANEGRILEAVELSHQTNSLPEVCGRVCPQDRLCEGSCTLNDDFGAVTIGNIEKYITDKAFEMGWKPDMSKVEWTNKKVAIIGAGPAGLAAADILVRNGVKPVVFDRYPEIGGLLTFGIPSFKLEKGVMENRRRVFTEMGVEFRMNVEVGQDVQMQELLDEYDAVFLGVGTYKYMRAGLENEDAPGVYDALPFLISNTYKVMELEHNQPFIDMAGKKVVVLGGGDTAMDCVRTSIRQGASNVICAYRRDEENMPGSRREVKNAKEEGVKFMFNLQPLGIEVDAYGKVSGVKVVKTALGEPDDAGRRRPEPVEGSEHVLPADAVIMAFGFQPHQMDWLTPFNVELDQWGRIKAPNNQEFQYQTSNEKIFAGGDAVRGSDLVVTAIDEGRKAAEGILDYLDV

SEQ ID NO: 81028 - protein, 367 aa, Rubrobacter xylanophilus DSM 9941
MQAVILVGGLGTRLRPITYDIPKALVPLRNKPFMGYTLDFLRGGGIEGAVLSLGYLPDPIQRYIDERGDLDGFSVEYAVEERPLGTAGGIKNAARFLQDGPVVVLNGDVLTGMDLRKAIELHRSTGALATITLTSVEDPTAYGLVEVDHDMMVRRFIEKPSPDEVTTNLVNAGVYVLEPEVLEMIPPGREVSIEREIFPRLQERRQLYAHVSSSYWKDIGTPRSYLAASHDVLSGAVGAGEGFDYMDVHRSTLIEKNVRILPPVSVAEGCEISAGATVGGRSSLGRGCRVGEGAVVEGSILLDGAVVEAGAVVRGSIVGPGARIGEGAIVRGLSVLGARCVVGEGNVLDQGIRINPGVVLQPRSVSF

SEQ ID NO: 81029 - protein, 453 aa, Thermoactinomyces vulgaris
LSPADWQEKSIYFIMTDRFDNGDPSNDNYGGFNADKSDPRKYHGGDFQGIINRLDYIKNMGFTAIWITPVTMQKSANAYHGYWTYDFYSVDGHLGSMAKLQELVRAAHAKGISVMLDVVANHTGDFQPSSFAKAPFDKADWYHHYGDTQDWNDQWWVENGDIAGLDDLNQDNPAVATELKNWIAWLVQTTGVDGLRVDTVKHVPKWFWREFDGAANTFTLGEVFHGDPAYVGDYTNYLDAVLDFPMYYTIKNVFGQDQSMRQIADRYAQDYRYKNPMTNGLFIDNHDVPRFLNEASGKPGASWDKWPQLKAALGFMFTTRGIPILYQGTEQGFSGGADPYNRDDMVFNDKHELYGYIAKLNYIRNTHVALRKGTQAEKWVDDTFYAFQRSYNGDEVVVMINNSWNSQTRTVPNIDRVANGQTLYNRMGTDKVTVNNGSITATLGPKEVKIFTK

SEQ ID NO: 81030 - protein, 489 aa, Vibrio parahaemolyticus RIMD 2210633
MGKPTGFLEHGRELPQKIDPAERIKNNKEFVLNEEFGSKINTQASRCMDCGVPFCHNGCPIGNIIPEFNDAVYRDSWEEAWNILSSTNNFPEFTGRVCPAPCESACVLGINQDPITICNIEKTIVETAYREGYAKPKTPRSRTGKTVAIIGSGPAGLAAAEQLNSAGHTVTVFERDEKVGGLLRFGIPDFKLSMEVIDRKINLMAEAGVEFRVNQHVGVDVNAQQLRQEYDVVLLTGGSTVPRDLPVPGRDLKGVYFAMQFLGQNNRRANNMDLKGEEIHAAGKHVVVIGGGDTGSDCVGTSNRHGAASITQVEIMPIPPEKRPANMPWPQYPMILRTSTSHEEGVDRHWNILTKEFIGNDKGEVTGLRLADIVWEDAKPGERPSFKEVEGSERVIPCDMAFLAMGFLHPEPTGVLAQLDIALDDRGNVATQGFATNQEGVFAAGDMRTGQSLVVRCINEGRECARAIDEYLMGGTNLEAKANSLMLSA

SEQ ID NO: 81031 - protein, 479 aa, Magnaporthe grisea 70-15
MTDNGAPAPGTQLPPPPQANAGAPGFDNPQNGQSGPMAPPPLHIPQNTNPIPTAITSPMGGGDQSALMSPGGTFTRRTAPEPNKRALYVGGLDARVTEDVLRQIFETTGHVQNVKIIPDKNAKGYNYGFVEYDDPGAADRAMQTLNGRRVHQSEIRVNWAYQAATSATKEDTSNHFHIFVGDLSNEVNDEVLTQAFSVFGSVSEARVMWDMKTGRSRGYGFVAFRDRSDAEKALSSMDGEWLGSRAIRCNWANQKGQPSIAQQQAMSAVGMTPTTPFGHHHFPTHGMQSYEMVVNQTPAYQTTCYVGNLTPYTTANDVVPLFQNFGYVVESRFQADRGFAFIKMDSHENAAQAICGLNGYNVNGRPLKCSWGKDKNSTNPQGNFDPSQAFSPQSAGGPGFPGTPSTYFPQYGGQFSGPQGNFGPNSAQSPAGFQQPMPFSNPPSAGGYGRGQQAPNAQWSSPQGQPQNFNNNGFSGYQG

SEQ ID NO: 81032 - protein, 443 aa, Glycine max
MKNPTPNPTHLCLECRNLIWTSSRAFHQYLELQMENTWILSFHLLLLLLHPNAAKGAISVGVGVGVGVGVGVGIGIGNSPGPSGSTGSNLKNAFTALQAWKSAITDDPLKILDTWVGSNVCSYKGVFCANSEDDNGIVTTAATESSVVAGIDLNHANLQGTLVKELSLLSDITLFHLNSNRFSGSLPDTFRDLTSLEELDLSNNQLSGPFPMATLSMPNLIYLDLRFNNFSGQLPDQLFNKKLDAIFLNNNNFGGEIPDNLGNSPASVINLANNKLSGSIPFSFGFMGSRLKEILFLNNQLTGCIPQGVGIFTEMQVFDVSFNSLMGHLPDTMSCLQDIEVLNLAHNKLSGELSEVVCSLRSLLNLTVAYNFFSGLSQECSRLFSVGFDFSDNCIPGRDMQRPQPECSIIPGGSLNCLRIPTPKPLVCAATLSKHTNSRSSSP

SEQ ID NO: 81033 - protein, 348 aa, Thermoplasma acidophilum DSM 1728
MKRYLITSDGTVIAGYGYGSPVTGYGELVFTTSMTGYLESMTDPSYVGQILVFASPTIANYELRKGVMESDRVKVSGIVTRDAHINMPAGTLGLDFDRFLRDEGIPAIDGVDTRLLVRKIRQGGVLRAYIADDPQGHSDFPDPMSENLVARAVDARGVKNIRGKGERRILFIDLGSKKTLRDMMLEHFSLIMASADSDLDAIDKYDAIFVSNGPGDPDHPSLRPVVNFLKRNIGVKPIFGICFGLQIIALAYGSKTYKMKFGHRGSNHAVTDGNRIYVTTHNHGYAVDPDTVRDFHVRERDINDGTIEMIEDGMMMAVQYHPEASPGPHDTRWFFSEMRRRTEDAAKG

SEQ ID NO: 81034 - protein, 462 aa, Triticum aestivum
  misc_feature (374)..(374): Xaa can be any naturally occurring amino acid
MASYDKAMESYKKAVTTAASLAASAMLVRGVVNELVPYEVRDLLFSGMGYLRSHMSSQHTIIIEETEGWANNQLYDAARAYLATRINTDMQRLRAPSSQRAWLLGTRNNTSASSSNGNGRGGSGNFKLEVRSFEMSFHRKHKDKALTSYLPHILAVAKKIKEQNRTLKIYMNEGESWFAIDLHHPSTFSTLAMDHKLKQSVMDDLERFVKRKEYYKKIGKAWKRGYLLYGPPGTGKSSMIAAMANYLKFDVYDLELTEVNWNSTLRRLLIGMTNRSILVIEDIDCTVELQQREEGQEGTKSNPSEDKVTLSGLLNFVDGLWSTSGEERIIIFTTNYKERLDPALLRPGRMDMHIHMGYCCPESFRILASNYHSXDHHVTYPEIEEMIKEVMVTPAEVAEVLMRNEETDVALKGLIQFLKRKKDGAGKPENVDQVAKEEEQEKEMMAQSDVPDNQDQQDGSKE

SEQ ID NO: 81035 - protein, 449 aa, Vibrio angustum S14
MNRLQADSLTALAALDSVPIARVTGRLVKVNGLMLQAVGCRFKLDQRCLIVADDGEQIEAQVVGFDHNIAYLMPVRQLGGLYAGAKVIPMQGGSTVNVSHKWIGRVVNGLGEPLDNGSPLQGGESLSLEPKPINPMKRQPVESPLDVGIKAINGLLTVGKGQRIGLMAGSGVGKSVLMGMITKYTAADIIVVGLIGERGREVREFIERNLGEEGRKRAVIIAAPADESPLMRLRATKLCHRVAEYFRDQGKDVLLLMDSLTRYAMAQREIALALGEPPASRGYPPSVFSLLPQLLERAGNGENPNGSLTAIYTVLAEGDDQQDPVVDSARAILDGHIVLSRTLAEQGHYPAIDINASISRCMSSCTEQAHVTVANQFRQLNANYQQVKELLPLGGYQQGQDPELDQAVMMQPQLKQFLQQPVTEHCDYQASLTQLANLFSLNQPSPSAP

SEQ ID NO: 81036 - protein, 370 aa, Prochlorococcus marinus subsp. marinus str. CCMP1375
MARSFFKKFITKQNHQAVHKHWPGIIEAYKHWLPVTKKTPIITLQEGATPLIELQYINKIIGKDVKVYAKYDGLNPTGSFKDRGMTMAISKAKENGTKVVICASTGNTSASAAAYAKKGGMRSFVLIPEGYVAQGKLAQALVYGAEVLAIKGNFDEALKIVQNISNKFPVTLVNSVNPYRLQGQKTAAFEIIESLGEAPDWLCIPMGNAGNITAYWMGFNEYYIAGISKKLPKMMGFQAKGSAPLVLGKTIDNPDTIATAIRIGNPVNKENAYKVKKESKGKFTDVTDEEIINAYKILGKEEGIFCEPASASSVAGLLKVKESIPSNSKIVCVLTGNGLKDPDCAIKNNDAVFKEGISPDIKTVAENMGF

SEQ ID NO: 81037 - protein, 462 aa, Glycine max
MGEDGNSWIRRTNFSHTVCHRLDPARLGSIPISVQSEQKSRPSSKAQRHPMTYKQRSLSPLPETYLSEAFREARLEQKRFSTPNPRREKRIMGKLLNKDSRETKESSSKSPSRSPNRQVKSKNRKDSAWTKLLDNGGGKITAVETAEEWNVDMSQLFFGLKFAHGAHSRLYHGVYKDEAVAVKIIMVPEDDGNGALASRLEKQFIREVTLLSRLHHQNVIKFSAACRKPPVYCIITEYLAEGSLRAYLHKLEHQTISLQKLIAFALDIARGMEYIHSQGVIHRDLKPENILINEDNHLKIADFGIACEEASCDLLADDPGTYRWMAPEMIKRKSYGKKVDVYSFGLILWEMLTGTIPYEDMNPIQAAFAVVNKNSRPIIPSNCPPAMRALIEQCWSLQPDKRPEFWQVVKILEQFESSLASDGTLSLVPNPCWDHKKGLLHWIQKLGPLHQNSGPVPKPKFT

SEQ ID NO: 81038 - protein, 218 aa, Vibrio campbellii AND4
MTQDEMKKAAGWAALKYVEKGSIVGVGTGSTVNHFIDALGSIKDDIKGAVSSSIASTERLKALGIEVYECNDVAMLDIYVDGADEINAAREMIKGGGAALTREKIVAALSEKFICIVDGTKAVDVLGQFPLPVEVIPMARSYVARELVKLGGDPAYREGVTTDNGNVILDVHNMQITNPRELEDKINAIAGVVTVGLFAHRGADVVITGTPEGAKIAE

SEQ ID NO: 81039 - protein, 409 aa, Streptococcus mutans UA159
MTLDTQKMKQDFPILKQIVNDEPLVYLDNAATTQKPKQVLACLNDYYRQDNANVHRGVHSLAERATAAYEAAREKVRRFINADSTKEILFTRGATTGLNWAARFAEEVLQADDEVLISVMEHHSNIVPWQEACRKTGAKLVYAYLKDGQLDLEDLKNKVSAKTRFISLTHISNVLGCINPIKEIAQLAHQHNAYMVVDGAQSAPHMTIDVQDLDCDFFAFSGHKMLGPTGIGVLYGKEDILKQMSPVEFGGEMIDFVYEQKTTWKDLPWKFEAGTPNIAGAIALGAALDYLAELGMEQVQAHEQELVAYVLPKLQAIKGLTVYGPENPAKHTGVISFNLEGLHPHDVATALDYEGVAVRAGHHCAQPLINYLGLHSAARASFYIYNTKEDCDKLIEAILKTKEFFNGTL

SEQ ID NO: 81040 - protein, 399 aa, Malus x domestica
  misc_feature (323)..(323): Xaa can be any naturally occurring amino acid
WPVSDDQGFNWESWKEEGGWYKSLSQSIPQQLASSGITHVWLPPPSHSVSPQGYMPGRLYDLNASRYGNQDELKALINTFHDNGIQSIADIVINHRCAEKKDERGIWCIFEGGTPDDRLDWGPSLICCDDTAYSNGKGNPDTGADFSAAPDIDHINTRVQRELSDWMNWLKTEIGFNGWRFDFVKGYAPEFTKLFVTNTRPSFSVGELWNSLAYGSDGKLEYNQDAHRRALVGWVEGAGGDVTAFDFTTKGILQAAVQGELWRMKDSNGGAPGMIGLSPGKSVTFVDNHDTGSTQNMWPFPSDKVMQGYAYILTHPGIPSIRXITKLVAIRLRNGIGPDSALRILASDADLYVAATDEKIIAKIGPRYDVGNLVPPTYQIATSGNDYCVREKKAGALLE

SEQ ID NO: 81041 - protein, 187 aa, Triticum aestivum
  misc_feature (106)..(106): Xaa can be any naturally occurring amino acid
  misc_feature (116)..(116): Xaa can be any naturally occurring amino acid
  misc_feature (129)..(129): Xaa can be any naturally occurring amino acid
  misc_feature (184)..(184): Xaa can be any naturally occurring amino acid
SLPLTKEKAAFSPSDPAMQRHVASGRPSGTDGSDFSYRMVVESRYQRVAEGRSRLARLILVQALHLVAGGLLLLLSLSKGAAVNKFAVLSMAAGFLAIVVGELGRXRTMAVLLRLXTSLSSIAVAFSVXCIIRSELFLKVMKQNTEAITSYEMLDAVRVALGILLQMVVIATTTILLQNMSPPXRAS

SEQ ID NO: 81042 - protein, 542 aa, Cytophaga hutchinsonii ATCC 33406
MLVSFHSMQSSLFRTKNPNELHTEVSALKRTLTFKDLTALGIAAVIGAGIFGTIGQAAYDGGPGIIFLFIITSLGCLFSAFCYAEFAASTPISGSAYTYAYISFGELIAWIIGWDLFMEYAVGNMAVAISWSDYFTAFLKGVNIEFPLWLSMDYFTAVHQKSAAAQQAYVHAPRIFDFPVIVDLPAILITVLITILVYIGIQESKRTNNVLVVFKIIVLLLFIIVGFTTVNTANWSPFIPNGWSGIFKGTAAVFFAYIGFDALSTTTEECVNPKRDLPRAIFSSLLISTLIYIAIALVITGMVSYHDLNVGDPLAYALEKTGLHKFAGLLSFSAIVSMTGVLLVFQIGQPRIWMNMSRDGLLPKALSRIHPRYQTPSVATVLTGGSIILPLLFLDLKEVVDLTSIGTLFAFLIVCAGIWLKKEKIKTESFTVPFIGGRYLLPVTMLPVLYLYLHTVSTENVFSFTQIPLYSCILAMIATIFYGSVRNLSLLPGIGVCLNLLLLSTMHHQNWIRFVAWLAIGLIVYMTYGRKHSVLAGPSTKG

SEQ ID NO: 81043 - protein, 363 aa, Oryza sativa Indica Group
MALPRGVRSPKPMAAAAASASPPQPRPGHMLVLGTGFVGRYVSQRLLAQGWRVSGTCTSPAKKTELEMLGMDASVFDATSSRCCFFFFFLLFLFFVPSESDKSPVLVLVPFSLTNLRSLQDATHLLISIPPIPGIGDPLLSSHSNLQTTLSNSNLQWLCYLSSTSVYGDCGGAWVDEDHTVNPKTESVKLRYAAEKGWLNVIDDLDLSAFVFRLGGIYGPGRSAVDTIAKSKSLSRRQKSRESKQYTARIHVADICQAILASMSIRSARRIYNVVDDDPAPRSEVFAFARSLVERKHPGLIMDSVVLPATQDRIVAAEKRVSNARLKEELGVKLLHPTYKSGLQSILDSWSVESSFSNRNVDV

SEQ ID NO: 81044 - protein, 585 aa, Ustilago maydis 521
MTTSATEKALEDRAKSLHKKEKKASAKAAAAAGASASTSLEGSPSPASPAKKDKKDKKDKKDKKRSADDADADDDEKAAKKRRKEEKKAKKAAAKSGAATSLESTPAASPAPAASSSASAASFTPTNPAAARAFVESHNITIEAPEESNERPPLPMVDFRELDGKVDAAVKKTLDSQGFSTPTPIQACCWPVLLQNKDVVGIAETGSGKTFAFGLPALQHLVTKHKVLDSGKKKAKGAQVNVLVIAPTRELAIQTEENMAKLGKSMGIGMICLYGGVSKQEQVRLLNQSPPVRIVVGTPGRVLDMARDGSLDLSGVTYLVLDEADRMLDKGFEPDIRAIIGMCKSREEGRHTSMFSATWPPAVRGLAESFMNGPVRVTVGSDELSANRRVEQTVEVLADGYAKERRLNDFLRSVNAQRSKDKILIFALYKKEAQRIEQTLRRGGFKVSGIHGDLGQNERIASLERFKSAETPLLVATDVAARGLDIPNVEHVVNYTFPLTIEDYVHRIGRTGRGGKTGKSLTFFTEMDKAHAGELIRVLKDADQKVPDALTKFPTTIKKKTHSSYGDHFKELVPGKAKKITFDDD

SEQ ID NO: 81045 - protein, 625 aa, Brassica napus
MSREKLRFFTLSFLLISSPALCRFVVEKNNLKVTSPDSIKGIYECAIGNFGVPQYGGTLVGTVAYPKSNQKACKSYNDFDISFKSKPGGLPTFVLIDRGDCFFTLKAWIAQQAGAAAILVADNKAEPLITMDTPEEDKSDADYLQNITIPSALITKSLGDSLKSALSGGDMVNMKLDWTESVPHPDERVEYELWTNSNDQCGTKCDTQIEFLKNFKGAAQILEKGGHTQFTPHYITWYCPEAFTLSKQCKSQCINHGRYCAPDPEQDFTKGYDGKDVVVQNLRQACVYRVLNETGKPWVWWDYVTDFAIRCPMKDKKYTKECADEIIKSLDIDLKKVDKCIGDPEADVENPILKAEQESQVGKGSRGDVTILPTLVVNNRQYRGKLEKGAVLKAMCSGFQESTEPAICLTEDLNTNECLENNGGCWQDKASNITACRDTYRGRLCECPTVQGVKFAGDGYTHCKASGALHCGINNGGCWRETRGSYTYSACVDDHSSDCKCPLGFKGDGVKSCEDVNECKEKKVCQCPDCKCKNTWGSYECSCKNGLLYMREHDTCIGSSKVGTTKLSWSFLWVLIIGVGVAGLAGYAVYKYRIRTYMDAEIRGIMAQYMPLESQPTPSGPHMDI

SEQ ID NO: 81046 - protein, 324 aa, Bacillus pumilus SAFR-032
MSKNFWRDLPRPFFILAPMEEVTDVVFRHVVSEAARPDVFFTEFTNSESYCHPDGIQSVKGRLTFTEDEQPIVAHIWGDKPENFRQMSIGMAELGFQGLDINMGCPVPNVTQNGKGSGLILRPDVAAELIQAAKAGGLPVSVKTRLGFTEVDEWHDWLRHILEQDIVNLSIHLRTRKEMSQVDAHWELIPEIIKLRDEVAPDTLLTINGDIPDRQTGLKLAEQYGVDGVMIGRGIFHNPFAFEKEPKEHTSDELLGLLRLHLDLHDQYSSLGLRPFKALHRFFKIYVKGFRGASFLRNQLMNTSSTDEVRAMLDEFEARNQEQS

SEQ ID NO: 81047 - protein, 316 aa, Kluyveromyces lactis NRRL Y-1140
MSSAVMSSVFSNGTIAELVGQGQGLSYGQVLSNIKVVQPQLNFMEQYWAAWYCYMNNDILATGLMFFLLHEFMYFFRCLPWAIIDQIPYFRRWKIQPTKIPSAKEQLFCLKSVLLSHFLVEAIPIWTFHPMCQKLGISVAVPFPSLTTMAKQISLFFFLEDAWHYWFHRLFHYGVFYKYIHKQHHRYAAPFGLAAEYAHPVETLSLGFGTVGMPIFYVMYTGNLHLFTLCLWITMRLFQAVDSHSGYDFPWSLNKFLPFWSGAEHHDLHHHYFIGNYASSFRWWDYVLDTEAGPEAKAEREERMKLKAEKKAKKAN

SEQ ID NO: 81048 - protein, 353 aa, Coccidioides immitis RS
MGCGMSTEDKEGKARNEEIENQLKRDKMMQRNEIKMLLLGAGESGKSTILKQMKLIHEGSYSRDERESFKEIIFSNTVQSMRVILEAMESLELPLDDLRAEYHVQTIFVQPAQIEGDCLPPEVGAAIEALWKDAGVQECFRRSREYQLNDSARYYFDSIGRIMQPDYLPSDQDVLRSRVKTTGITETTFIIGDLTYRMFDVGGQRSERKKWIHCFENVTTILFLVAISEYDQLLFEDETVNRMQEALTLFDSICNSRWFTKTSIILFLNKIDRFKEKLPVSPMKNYFPDYEGGADYAAACDYILNRFVSLNQAEQKQIYTHFTCATDTTQIRFVMAAVNDIIIQENLRLCGLI

SEQ ID NO: 81049 - protein, 354 aa, Bacillus halodurans C-125
MSQWRGLLQEYKEFLPVTEETPLLTLGEGNTPLIPLENLSKEWGVKAYVKYEGANPTGSFKDRGMVMAVAKAKEEGSRTIICASTGNTSAAAAAYGARAGLRCIVVIPEGKIALGKLAQAVMYGAEVLEIKGNFDHALDIVRSISEKEPITLVNSVNPYRIEGQKTSAFEICDALGQAPDVLAIPVGNAGNITAYWKGFKEYHEKKGTGLPQMRGFEAEGAAAIVRNQVIEEPETIATAIRIGNPASWTYAVEAAAESNGKIDEVTDEEILAAYQLLAQKEGVFAEPASCASIAGLRKQIASGEIKKGSTVVCVLTGNGLKDPNTAMSTIDVNPAVLPNDEQAFLDHIKGGVPK

SEQ ID NO: 81050 - protein, 334 aa, Staphylococcus aureus subsp. aureus Mu50
MSQERYSRQILFKQIGEIGQSKINQKCALIIGMGALGTHVAEGLVRAGIAKLIIVDRDYIEFSNLQRQTLFTEEDALKMMPKVVAAKKHLLALRSDVDIDGCIAHVDYYFLETHGQDVDVIIDATDNFETRQLINDFAYKHRIPWIYGGVVQSTYTEAAFIPGKTPCFNCLVPQLPALNLTCDTVGVIQPAVTMATSLQLRDAMKVLTEQPIDTKITYGDIWEGSHYSFGFSKMQRSDCTTCGDVPSYPYLNKNEQRYATLCGRDTVQYENASITHDILVQFLKQHQLNYRSNSYMVMFEFKGHRIVAFKGGRFLIHGMTRTSDATHLMNLLFG

SEQ ID NO: 81051 - protein, 1702 aa, Haemophilus influenzae
MLNKKFKLNFIALTVAYALTPYTEAALVRDDVDYQIFRDFAENKGRFSVGATNVEVRDKNNHSLGNVLPNGIPMIDFSVVDVDKRIATLINPQYVVGVKHVSNGVSELHFGNLNGNMNNGNDKSHRDVSSEENRYFSVEKNEYPTKLNGKAVTTEDQTQKRREDYYMPRLDKFVTEVAPIEASTASSDAGTYNDQNKYPAFVRLGSGSQFIYKKGDNYSLILNNHEVGGNNLKLVGDAYTYGIAGTPYKVNHENNGLIGFGNSKEEHSDPKGILSQDPLTNYAVLGDSGSPLFVYDREKGKWLFLGSYDFWAGYNKKSWQEWNIYKPEFAKTVLDKDTAGSLTGSNTQYNWNPTGKTSVISNGSESLNVDLFDSSQDTDSKKNNHGKSVTLRGSGTLTLNNNIDQGAGGLFFEGDYEVKGTSDSTTWKGAGVSVADGKTVTWKVHNPKSDRLAKIGKGTLIVEGKGENKGSLKVGDGTVILKQQADANNKVKAFSQVGIVSGRSTVVLNDDKQVDPNSIYFGFRGGRLDANGNNLTFEHIRNIDDGARLVNHNTSKTSTVTITGESLITDPNTITPYNIDAPDEDNPYAFRRIKDGGQLYLNLENYTYYALRKGASTRSELPKNSGESNENWLYMGKTSDEAKRNVMNHINNERMNGFNGYFGEEEGKNNGNLNVTFKGKSEQNRFLLTGGTNLNGDLKVEKGTLFLSGRPTPHARDIAGISSTKKDQHFAENNEVVVEDDWINRNFKATNINVTNNATLYSGRNVANITSNITASDNAKVHIGYKAGDTVCVRSDYTGYVTCTTDKLSDKALNSFNATNVSGNVNLSGNANFVLGKANLFGTISGTGNSQVRLTENSHWHLTGDSNVNQLNLDKGHIHLNAQNDANKVTTYNTLTVNSLSGNGSFYYLTDLSNKQGDKVVVTKSATGNFTLQVADKTGEPTKNELTLFDASNATRNNLNVSLVGNTVDLGAWKYKLRNVNGRYDLYNPEVEKRNQTVDTTNITTPNNIQADVPSVPSNNEEIARVETPVPPPAPATPSETTETVAENSKQESKTVEKNEQDATETTAQNGEVAEEAKPSVKANTQTNEVAQSGSETEETQTTEIKETAKVEKEEKAKVEKEEKAKVEKDEIQEAPQMASETSPKQAKPAPKEVSTDTKVEETQVQAQPQTQSTTVAAAEATSPNSKPAEETQPSEKTNAEPVTPVVSKNQTENTTDQPTEREKTAKVETEKTQEPPQVASQASPKQEQSETVQPQAVLESENVPTVNNAEEVQAQLQTQTSATVSTKQPAPENSINTGSATAITETAEKSDKPQTETAASTEDASQHKANTVADNSVANNSESSEPKSRRRRSISQPQETSAEETTAASTDETTIADNSKRSKPNRRSRRSVRSEPTVTNGSDRSTVALRDLTSTNTNAVISDAMAKAQFVALNVGKAVSQHISQLEMNNEGQYNVWVSNTSMNENYSSSQYRRFSSKSTQTQLGWDQTISNNVQLGGVFTYVRNSNNFDKASSKNTLAQVNFYSKYYADNHWYLGIDLGYGKFQSNLKTNHNAKFARHTAQFGLTAGKAFNLGNFGITPIVGVRYSYLSNANFALAKDRIKVNPISVKTAFAQVDLSYTYHLGEFSVTPILSARYDTNQGSGKINVNQYDFAYNVENQQQYNAGLKLKYHNVKLSLIGGLTKAKQAEKQKTAELKLSFSF

SEQ ID NO: 81052 - protein, 311 aa, Carboxydothermus hydrogenoformans Z-2901
MIASYRGRDFLSMNDLTGEEIEEVLDLASELKIRQKKGISTPILKGKTLAMIFSKNSTRTRVSFEVGMVQLGGYPLFITATDSQLSRGEPIADTARVLSRMVDGIMIRTYSHSEVEELAYYADVPVINGLTDYEHPCQIMADLLTIKEHKGQLRGLKVAWVGDGNNVCHSLMIGAAKVGMEVAVATPPGYEPDQKVSLIAQKETSRWGTKLLLTHDPVEAVTGADVVVTDVWASMGQEAESAERVKVFEPYQVNGELVSHAKQDFIFLHCLPAHRGEEVTAEVIDGEHSVVFAEAENRLHAQKAILTLLLG

SEQ ID NO: 81053 - protein, 118 aa, Neptuniibacter caesariensis
MSRHYTGSCHCGDIKFSFKAPEIVDGLRCNCTVCQKKGAMMSNFFVAPEDIDIEAKEGAIATYEFGTHVAKHHFCKRCGIYPFHQTMRKPGHYRIHLGCVDGVDVLSLPHVLVDGASF

SEQ ID NO: 81054 - protein, 1849 aa, Haemophilus influenzae
MLNKKFKLNFIALTVAYALTPYTEAALVRDDVDYQIFRDFAENKGKFSVGATNVEVRDKKNQSLGSALPNGIPMIDFSVVDVDKRIATLVNPQYVVGVKHVSNGVSELHFGNLNGNMNNGNAKSHRDVSSEENRYYTVEKNNFPTENVTSFTTKEEQDAQKRREDYYMPRLDKFVTEVAPIEASTANNNKGEYNNSDKYPAFVRLGSGSQFIYKKGSRYQLILTEKDKQGNLLRNWDVGGDNLELVGNAYTYGIAGTPYKVNHENNGLIGFGNSKEEHSDPKGILSQDPLTNYAVLGDSGSPLFVYDREKGKWLFLGSYDFWAGYNKKSWQEWNIYKHEFAEKIYQQYSAGSLTGSNTQYTWQATGSTSTITGGGEPLSVDLTDGKDKPNHGKSITLKGSGTLTLNNHIDQGAGGLFFEGDYEVKGTSDSTTWKGAGVSVADGKTVTWKVHNPKYDRLAKIGKGTLVVEGKGKNEGLLKVGDGTVILKQKADANNKVQAFSQVGIVSGRSTLVLNDDKQVDPNSIYFGFRGGRLDLNGNSLTFDHIRNIDDGARVVNHNMTNTSNITITGESLITNPNTITSYNIEAQDDDHPLRIRSIPYRQLYFNQDNRSYYTLKKGASTRSELPQNSGESNENWLYMGRTSDEAKRNVMNHINNERMNGFNGYFGEEETKATQNGKLNVTFNGKSDQNRFLLTGGTNLNGDLNVEKGTLFLSGRPTPHARDIAGISSTKKDPHFTENNEVVVEDDWINRNFKATTMNVTGNASLYSGRNVANITSNITASNNAQVHIGYKTGDTVCVRSDYTGYVTCHNSNLSEKALNSFNPTNLRGNVNLTENASFTLGKANLFGTIQSIGTSQVNLKENSHWHLTGNSNVNQLNLTNGHIHLNAQNDANKVTTYNTLTVNSLSGNGSFYYWVDFTNNKSNKVVVNKSATGNFTLQVADKTGEPNHNELTLFDASNATRNNLEVTLANGSVDRGAWKYKLRNVNGRYDLYNPEVEKRNQTVDTTNITTPNDIQADAPSAQSNNEEIARVETPVPPPAPATESAIASEQPETRPAETAQPAMEETNTANSTETAPKSDTATQTENPNSESVPSETTEKVAENPPQENETVAKNEQEATEPTPQNGEVAKEDQPTVEANTQTNEATQSEGKTEETQTAETKSEPTESVTVSENQPEKTVSQSTEDKVVVEKEEKAKVETEETQKAPQVTSKEPPKQAEPAPEEVPTDTNAEEAQALQQTQPTTVAAAETTSPNSKPAEETQQPSEKTNAEPVTPVVSENTATQPTETEETAKVEKEKTQEVPQVASQESPKQEQPAAKPQAQTKPQAEPARENVLTTKNVGEPQPQAQPQTQSTAVPTTGETAANSKPAAKPQAQAKPQTEPARENVSTVNTKEPQSQTSATVSTEQPAKETSSNVEQPAPENSINTGSATTMTETAEKSDKPQMETVTENDRQPEANTVADNSVANNSESSESKSRRRRSVSQPKETSAEETTVASTQETTVDNSVSTPKPRSRRTRRSVQTNSYEPVELPTENAENAENVQSGNNVANSQPALRNLTSKNTNAVLSNAMAKAQFVALNVGKAVSQHISQLEMNNEGQYNVWISNTSMNKNYSSEQYRRFSSKSTQTQLGWDQTISNNVQLGGVFTYVRNSNNFDKASSKNTLAQVNFYSKYYADNHWYLGIDLGYGKFQSNLQTNNNAKFARHTAQIGLTAGKAFNLGNFAVKPTVGVRYSYLSNADFALAQDRIKVNPISVKTAFAQVDLSYTYHLGEFSITPILSARYDANQGNGKINVSVYDFAYNVENQQQYNAGLKLKYHNVKLSLIGGLTKAKQAEKQKTAEVKLSFSF

SEQ ID NO: 81055 - protein, 410 aa, Alkaliphilus metalliredigens QYMF
MYFLEDKIAQRLGGKSFGKVSKEYKFRKIKKTKEEAIKKYPFISLIDLGVGEPDLAADERVVSILSKEAGKPENRWYADNGILEFQEAAVQYLNKVYGLKGLDPNENILHGIGTKSMLAMLPACFINPGDVVLTTIPGYPILSSNTQYFGGEIYPLPLHEENSFYPDFTAIPKSILNKAKLLYLNYPNNPTGQVATYDFYQEAVSIALQYGIVIVSDAAYGPITFDDHRPISLFSVPDASHVGIELHSLSKAFNMTGWRLAFALGSPEMIKAYSAIKDTTDSGQFRAIQKAGAFALQHIDIIEANCQRYSRRMDFLIEILQEVGFKATKPQGTFYCYVPIPKGTKSGIRFTNAEEVATHILEHALISTVPWDDVGSYLRLSVTFEAKDLESEKELLEELKRRLLSLELVF

SEQ ID NO: 81056 - protein, 513 aa, Rubrobacter xylanophilus DSM 9941
MAENGGAERAVSQDGRRDGQPREGGVGRVVEVKGPVVDVRFPPDQIPEIYNALTCKIETEEGEHTLTLEVQQLLGDDMVRTVAMSSTDGLRRGVEVQDTGRPIAVPVGEAVLGRVLDVLGEPVDEQGPVEGEADRWPIHRPAPKFEDLSTKAEQFVSGIKVIDLLCPVRRGGKVGLFGGAGVGKTVLITELINNIALQYEGTSVFTGVGERTREGTALYGEMEEAGVLKNTALIFGQMNEPPGARFRVGLTGVTIAEYFRDVLGQDVLFFLDNIFRFAQAGNEVSALMGRMPSEVGYQPTLGTEMGALQERITSTKKGSITSFQAVYVPADDPTDPAPFTVFAHLDSTVELSRSLFEQAIFPAVDPLASSSTILDPDVVGQEHYEVAQEVKGILQRYKELQDIIAILGIDELSEEDKVIVARARRLQRFLSQPFFVAEQFTSLPGKFVELEETVQSFREVVEGKHDDLPEQAFYLVGGIDDVLEKARQLSGEEEEGEEAAKEEAGVGAGGEGS

SEQ ID NO: 81057 - protein, 363 aa, Vitis vinifera
MHSLGIPTTRALCLVTTGKYVTRDIGNPKEEPGAIVCRVAQSFLRFGSYQIHAARGKEDLGIVRALADYTIRHHFPHIENMTRSEAWSVEVAERTASLVASWQGVGFTHGVLNTDNMSVLGLTIDYGPFGFLDAFDPSYTPNTTDLPGRRYCFANQPDIGLWNIAQFTSTLMSAELINDKEANYAMERYGTKFMDEYQAIMTRKLGLPKYNKQLISKLLNNMAVDKVDYTNFFRLLSNIKADPTIPQDELLTPLKAVLLDIGKERKESWISWVQSYIQELAASGISDEERKASMNSVNPKYVLRNYLCQSAIDAAEQGDFGVVRRILKIMERPYDEQPGMEKYARLPPAWAYRPGVCMLSCSS

SEQ ID NO: 81058 - protein, 224 aa, Vitis vinifera
MLSHLSSASLPLKPSTVTATAFLRLSSRNLHFSYSSCPIFSPFFRSHPSLSSKLSRSFHFRPGVSSESAFSPSRSMEASPSADAAATVESLADGLRNQRLGSENRVLLRLEDLNWDHSFVHELPGDPRTDPIPRQVLHACYTKISPSAEVENPQLVAWLESVAELLDLDPKEFERPDFPLIFSGASLLVGGLPYAQCYGGHQFGMWAASEFQVRTMGIAAERCW

SEQ ID NO: 81059 - protein, 619 aa, Vigna mungo
MGIKLSLLLCVWGLLLGCTVGRFVVEKNSLRVTAPSSLKGTYECAIGNFGVPMYGGTLVGSVLYPKVNQKGCLNFTDVNFQSKPGGFPTFLLVDRGDCYFTLKAWNAQNGGAAAVLVADDKAETLITMDTPEEGKGTDDDYVENISIPSVLISKSLGDSIKKALSDGEMVNMNLDWREALPHPDDRVEYELWTNSNDECGQKCDSLINFLKDFKGVAQLLERKGFTQFTPRYITWFCPEAFLLSKQCKSQCINNGRYCAPDPEQDFSSGYDGKDVVVQNLRQACFYKVANESGKPWQWWDYVTDFSIRCPMKEKKYTEECSDQVIKSLGADLKKIKDCIGDPHADVENPVLKAEQEAQIGKGTRGDVTILPTLVINSRQYRGKLSRPAVLKAICAGFLETTEPSVCLTPEMETDECLVNNGGCWKEKSSNITACRDTFRGRVCECPVVQNVKFVGDGYTHCEASGTLSCDFNNGGCWKGSQGGRAYTACLDDYRKGCTCPPGFRGDGVQSCEDIDECQEKTACQCPACTCKNTWGSYECKCGSGLFYSRENDTCLGAYSATGVSIWMIILIAVVAVSGGYAFYKYRIQRYMDSEIRAIMAQYMPLDNQPEESNQVHHNI

SEQ ID NO: 81060 - protein, 174 aa, Thermoplasma acidophilum DSM 1728
MIYEFEGRIPEIDPSAYVSESATVIGKVKIGKEVWIGPGAVLRGDYGEIEVGDYSAIEDNCVIHARPGEKTTIGQHVTIGHLSVIHTGRIRDWAVIGMGSTVSDFAVVGVWAAIGEGAVVKNRQEIPDEAVAVGVPAKVIGKIDDDYKKLWTDYKHNYNTFSSRYKTNLKPINR

SEQ ID NO: 81061 - protein, 849 aa, Capsella grandiflora
MRSEGPNKHYSYTFAFLFFFVTLFPDVCISANTLSATDSLTSNKTLVSPGDVFELGFFKILSDSWYLGIWYKTLPQKTYVWIANRDNPLFGSTGVLKISNANLILQSQTDTLVWSTNLTGAVRAPMVAELLDNGNFVLRDSKTNGSDGFLWQSFDFPTDTLLPQMKLGRDHKRKLDRFLTSWKSSFDLSNGDYLFKLETQGLPEFFLWKKFWILYRSGPWDGSRFSGMSEIQQWDDIIYNLTDNSEEVAFTFRLTDHNLYSRLTINDAGLLQQFTWDSTNQEWNMLWSTPKEKCDYYDPCGPYAYCDMSTSPMCNCIEGFAPRNSQEWASGIVRGRCQRKTQLSCGGDRFIQLKKVKLPDTTEAIVDKRLGLEDCKKRCATNCNCTAYATMDIRNGGLGCVIWIGRFVDIRNYAATGQDLYVRLAAADIGDKRNIIGKIIGLIIGVSLMLLMSFIIMYRFWRKNQKRAIAAPIVYRERYQEFLTSGLVISSDRHLSGDKTEELELPHTEFEAVVMATDNFSDSNILGRGGFGIVYKGRLLGSQNIAVKRLSTVSSQGTNEFKNEVRLIARLQHINLVRLLSCCIYADEKILIYEYLGEWKPPILIYLKNPKRSRLNWQKRFNIINGIARGLLYLHQDSRFKIIHRDLKASNVLLDKDMTPKISDFGMARMFERDETEANTRKVVGTYGYMSPEYAMDGIFSVKSDVFSFGVLVLEIVSGKRNRRNSYNSNQENNPSLATTWDNWKEGKGLEIVDPVIVDSSSFSTFQPHEVLRCLQIGLLCVQERAEDRPKMSSVVLMLGNETGEIHQPKLPGYCVGRSFFETESSSSTQRDSESLTVNQFTVSVIDAR

SEQ ID NO: 81062 - protein, 478 aa, Xanthobacter autotrophicus Py2
MANKVGRITQVIGAVVDVQFDGHLPEILNALETTNQGNRLVLEVAQHLGESTVRCIAMDATEGLVRGLEVTDTGAPIQVPVGAGTLGRIMNVIGEPVDELGPIEAEATRGIHQPAPSYAEQATEAEILVTGIKVVDLLAPYAKGGKVGLFGGAGVGKTVLIMELINNVAKAHGGYSVFAGVGERTREGNDLYHEMIESNVNKDPHENGGSAAGSKCALVYGQMNEPPGARARVALTGLTVAEHFRDQGQDVLFFVDNIFRFTQAGSEVSALLGRIPSAVGYQPTLATDMGALQERITTTTKGSITSVQAIYVPADDLTDPAPAASFAHLDATTVLSRSIAEKGIYPAVDPLDSTSRMLSPAILGDEHYNTARQVQQTLQRYKALQDIIAILGMDELSEEDKITVARARKIERFLSQPFHVAEVFTGSPGKLVDLKDTIAGFKGLVEGKYDYLPEQAFYMVGSMEEAIEKGKKLAAEAA

SEQ ID NO: 81063 - protein, 251 aa, Vibrio sp. Ex25
MIKAQVYDVFCDELAQGNPCGVIELNHWLSDSELLQITHQVAQPVTSFVVQSSSDYHIRWFSLAGEINLCGHGSLGAGSAIISNYHKNEVILQSQYGHVTVTELDGMYRIVMPSWQAKPHVIPLDISGFSNRPVDAFTTRDLVVVLESEDDVVRYQPNFDELIKIDEFHAVIVTAQSSDSGYVLRYFAPKIGISEDLATGSAQCSLAPYWFDKLGKEKLTARQLSRAGGYFEVARGSESTIVLSAHVKSRT

SEQ ID NO: 81064 - protein, 342 aa, Methylobacillus flagellatus KT
MSFQVIIKPSDRTFIVEDDDTVLDAAIEAGINLPYGCRNGTCGACKGQLLAGDVEYGEYFDSALSELEKKTGKALFCCARPLADLVIECREVVGEGIPPRIMPVRVEKLEKLSHDVMGMTLKLPSHERMQFMAGQYIEFLLNDGRRRAFSLASAPHQDRFLELHMRLVPGGQFTQYVFNEMQEKTILRIEGPFGTFFLREDSLRPVILVAGGTGFAPVKGIVEHALQQGMKRPMTLYWGARTRADLYLDALPRRWQEEHPWFRYIPVLSDPVPEDAWQGRTGLVHQAVLEDHPDMQAYQVYCCGAPQMVEVAHRDFQAHGLPEQEFFSDAFTFANPGAKAAI

SEQ ID NO: 81065 - protein, 213 aa, Pseudomonas syringae pv. syringae B728a
MSRNSYIQQNSDIQAAGGLVPMVIEQSARGERAYDIYSRLLKERVIFMVGPVEDYMANLIAAQLLFLEAENPDKDIHLYINSPGGSVTAGMSIYDTMQFIKPDVSTICIGQACSMGAFLLAGGAEGKRHCLPNSRMMIHQPLGGFQGQASDIDIHAKEILHIRHRLNSLLAHHTGQSLETIERDTERDNFMSAERAAEYGLIDSVINKRQMPA

SEQ ID NO: 81066 - protein, 647 aa, Synechococcus sp. WH 7805
MHLSDLAHPNELHGLSVAELQDVAEQIRQRHLEVVSNSGGHLGPGLGVVELTLALYQTLDLDKDRVVWDVGHQAYPHKLITGRYAEFDSLRQQGGVAGYLKRCESEFDHFGAGHASTSISAALGMAMARDRQGLDHKCVAVIGDGALTGGMALEAINHAGHMPHSPFLVVLNDNDMSISPPVGALSSHLNRMRLSPPMQFLSGSVEESMRHLPFMGGDLPPELNRLKESMRRLAVPKVGAVFEELGFTYMGPIDGHDMAEMIRTFQAAHRIGGPVLVHVITTKGKGYPYAEADQVGYHAQSAFDLGTGKARPSKTPKPPSYSKVFGQTLVKICEQNSKVVGITAAMATGTGLDLLQKAVPDQYVDVGIAEQHAVTLAAGMACDGLRPVVAIYSTFLQRAFDQMIHDVGIQNLPVTFVLDRAGIVGADGPTHQGQYDISYLRAIPNFTVMAPKDEAELQRMLVSSLQHPGPCAIRIPRGPGEGVPLMEEGWEPLPIGRGELLREGNDLLIVAYGAMNSKAMATAELLAVQGVESTVVNARFLRPLDDELLHPLAQRIGKVVTIEEGTLSGGFGSAVTESLSDADIKPSILRLGIPDVLVDHATPQQSFEKLGLTPAQMAETILTFVQRPKGASVTPFIQNPSVTVVES

SEQ ID NO: 81067 - protein, 510 aa, Synechococcus sp. WH 7805
MDDYLQRILRARVYDVARETPLDAASNLSRRLSNTIRLKREDLQPVFSFKLRGAYNRMAQLSEEELSRGVIASSAGNHAQGVALSASHLHCRAVIVMPVTTPSVKVEAVKQLGGEVVLHGETYDEAYAEACRRSENEHLCFIHPFDDPDVIAGQGTVGMEILRQSPRPPDAIYIAIGGGGLISGIAAYVKALWPDVQIIGVEPHDAAAMTLSLEAGERIRLPQVGLFADGVAVREVGEHTFRLVQRYVDAIVTVSTDEICAAIKDVFEDTRSILEPAGALAVAGLKADVARRGLKDQELVAVACGANMNFDRLRFVAERAELGEEREAMLAVEIPEQPGSLKNLCELLQKRSLTEFSYRMGAGERAHIFMGVQVADLQDRSDLLNSLRSHGYDCLDLSDDELAKVHLRHMVGGRLPVRTDATSSQPKELLYRFEFPERPGALMRFVSALRADWSISIFHYRNHGADVGRIVVGVLVKPDELQDWQAVLRELGYASWEETSNPAYRIFLGA

SEQ ID NO: 81068 - protein, 207 aa, Triticum aestivum
METEVGSPATATAAPINFSLPVDSEHKAKSIKIFSFGNPHMRAFHLGWMSFFTCVVSTFAAAPLIPIIRDNLNLTKADIGNAGVASVSGAIFSRLAMGAICDLLGPRYGCAFLVMLSAPAVFCMSVIDGPGGYITIRFLIGVSLATFVSCQYWISTMFNSKIIGTVGGLTAGWGDMGGGATQLIMPLVFDGILACGATRFTAWRIAY

SEQ ID NO: 81069 - protein, 252 aa, Vibrio sp. Ex25
MRGLKNKVALVTGSANGIGLAIAKRLYEEGANVALADWNEEQLANAVEGFDKQRVSAHSIDVSDPDKVAALISDVVTRFGKLDILVNNAGVHVPGSVIEGSVEDWKKISGVNIDGVVYCAKFALPELLKTKGCMVNTASVSGLGGDWGAAFYCASKGAVVNLTRAMALDHGAEGVRINAVCPSLVKTNMTNGWPQEIRDKFNERIALGRAAEPEEIASVVTFLASDDASFINGVNLPVDGGATASDGQPKIV

SEQ ID NO: 81070 - protein, 594 aa, Synechococcus sp. WH 7805
MAVIDLNRRTKIVATIGPATESAERIRELIQAGATTFRLNFSHGDHSEHATRMATIRQVAHELGVHIGILQDLQGPKIRLGRFEEGPITLGKGDHFSLTSKKVRCNQTVATVTYDKLADEVTAGSRILLDDGRVEMRVDRVDLADQTLHCVVTVGGVLSNNKGVNFPDVQLSVRALTPKDRQDLAFGLQQGVDWVALSFVRNPSDMQEIRELIRKHGFTTPVVAKIEKFEAIDQIDAILPLCDGVMVARGDLGVEMPAEEVPLLQKDLIHKANSLGIPIITATQMLDSMASSPRPTRAEVSDVANAILDGTDAVMLSNETAVGDFPVEAVETMATIARRIERDYPQRPIDTHLPSTIPNAISGAVSSIARQLNAAAILPLTKSGATAHNVSKFRPSTPILAITSEVAVARKLQLVWGVTPLLIETQKSTTATFTLAMGVAQEMGVLKDGDLCVQTAGTLAGVSGSTDLIKVGIVSAVLGRGTGIGNGSISGKVRIARTASDCARLEPGEILVASDTNADYLDAFREAAAIITECGGEESHAAVIARRLGLSVITGVANATRDLREGEVVTLHIKEGAVHRGTGSNMLMKLDTML

SEQ ID NO: 81071 - protein, 313 aa, Staphylococcus aureus subsp. aureus Mu50
MTKKVYFNHDGGVDDLVSLFLLLQMENVQLIGVSTIGADCYLEPSLSASVKIINRFSNEDIQVAPSYERGKNPFPKEWRMHAFFMDALPILNEPVKHVASNVSDKEAFEDIIQTLKRQSEKVTLLFTGPLTDLAKALQKDSSIVQYIEKLVWMGGTFLPKGNVEEPEHDGSAEWNAYWDPEAVKIVFDSDIEIDMVALESTNQVPLTLDVRQRWANERQYTGIDFLGVSYAAVPPLTHFITNSTYFLWDVLTTAYIGNKDLVHSIEKKVDVISYGPSQGKTFECKDGRKINVINHVDNNAFFDYITALAKKVN

SEQ ID NO: 81072 - protein, 327 aa, Escherichia coli K12
MATRIEFHKHGGPEVLQAVEFTPADPAENEIQVENKAIGINFIDTYIRSGLYPPPSLPSGLGTEAAGIVSKVGSGVKHIKAGDRVVYAQSALGAYSSVHNIIADKAAILPAAISFEQAAASFLKGLTVYYLLRKTYEIKPDEQFLFHAAAGGVGLIACQWAKALGAKLIGTVGTAQKAQSALKAGAWQVINYREEDLVERLKEITGGKKVRVVYDSVGRDTWERSLDCLQRRGLMVSFGNSSGAVTGVNLGILNQKGSLYVTRPSLQGYITTREELTEASNELFSLIASGVIKVDVAEQQKYPLKDAQRAHEILESRATQGSSLLIP

SEQ ID NO: 81073 - protein, 327 aa, Zea mays
MVKSKAIRVHELGGPEVLRWEEVEVGEPGEGEIRIRTTAVGVNLVDIYFRKGVYSAPTMPFTPGMEAVGVVTAVGPGLTGRKVGDVVAYAGNPMGSYAQEQILPAAVAVPVPPSVDHKQAASVMLKGMTAHVLLFRVFKVESGHTILVHAAAGGVGSLLWQCANALGATVIGTVSNQEKAAQAAQDGCHHPIIYTSEDVVARVKDITSGKGVNVVYDSVGKDTYKASLECLASRGFLVSFGQSSGKPDPIPTSDLASKSLFLTRPSLMHYTATRDELLESAGEVFANVANGVLHVRVNHTYPLSEAAQPHADLEGRKTSGSIVLIPG

SEQ ID NO: 81074 - protein, 213 aa, Brassica napus
HLYRMDYMNFVQKHIESNADITVSCLPMDESRASDYGLLKIDESGQIVQFSEKPKGDDLKAMQVDTTVLGLPPKEAAELPYIASMGVYVFRKEVLLNLLRSSYPTSNDFGSEIIPLAVKEHNVQAFLFNDYWEDIGTIGSFFDANLALTEQPPKLQFYDPKTPFFTSPRFLPPTKVDKCRILDSIVSHGCFLRECSVQHSIVGIRSRVESGVE

SEQ ID NO: 81075 - protein, 448 aa, Candida albicans
MGKFLQLLSHPTELKAVIQLFGFRQPLHPGKRDVNDKELGRCYELLNLTSRSFAAVIEELHPELRDAVMIFYLVLRALDTIEDDMTIKSSIKIPLLREFDTKLNTKNWTFDGYGPNEKDRTVLVEFDKILNVYHRLKPQYQDIIKSITFKMGNGMADYILDEEFNVYGVATVEDYNLYCHYVAGLVGEGLTNLFVLANFGDKTLTENNFAKADSMGLFLQKTNIIRDYHEDLQDGRSFWPREIWSKYTENLQDFHKVKTPAKEFAGVSCINELVLNALGHVTDCLDYLSLVKDPSSFSFCAIPQVMAVATLAEVYNNPKVLHGVVKIRKGTTCRLILESRTLPGVVKIFKEYIQVINHKSSVRDPNYLKIGIKCGEIEQYCEMIYPNKQALPPSMKSLPENKFTKIVASRESIDLSVQRRIEPGNFNCNVVLFGIGALILSLIYFVLY

SEQ ID NO: 81076 - protein, 200 aa, Thermoplasma acidophilum DSM 1728
MLKIYVVDNGGQWTHREWRVLRELGVDTKIVPNDIDSSELDGLDGLVLSGGAPNIDEELDKLGSVGKYIDDHNYPILGICVGAQFIALHFGASVVKAKHPEFGKTKVSVMHSENIFGGLPSEITVWENHNDEIINLPDDFTLAASSATCQVQGFYHKTRPIYATQFHPEVEHTQYGRDIFRNFIGICASYREIQKENFQH

SEQ ID NO: 81077 - protein, 212 aa, Rubrobacter xylanophilus DSM 9941
MPEVSENFHLVDGPLTRHKLAILRDERTPTPIFRQAMRELALIMVAEATRNMPTRKATIRTPLAETEVQEISAPVCLVPVLRAGIGMLDGALALLPTATVGFMGLFRDEATAEPVEYYVNLPRNLADYLVLVLDPMLATGGSLSATLGKLKEEGARWISCIHAVAAVPGVERVSREHPDAHFYAAALDPELNEDAFIVPGLGDAGDRLYGTL

SEQ ID NO: 81078 - protein, 339 aa, Streptococcus mutans UA159
MMKKTDYITTEDFSKEELLKLVDLSLKIKACIKNGYYPPLLEHKSLGMIFQQTSTRTRVSFETAMSQLGGHAQYLAPGQIQLGGHETIEDTSTVLSRLDDILMARVERHQSVVDLARCASIPVINGMSDYNHPTQELGDLCTMIEHLPAGKKLEDCKVVFVGDATQVCFSLALITTKMGMEFVHFGPKGFQLNDMHKEKLDKICERSGGKYTVTDNEDAIEGADFLYTDVWYGLYEAELSEEERMQIFFPKYQVDSQMMAKAGADCKFMHCLPATRGEEITDEVMDGPHSICFDEAENRLTSIRGLLVYLLRDYREKNPYDLVKQEKAKEELETFLKPE

SEQ ID NO: 81079 - protein, 569 aa, Clarkia epilobioides
MASPALISETEAWKDLKAHLEGIKMTHLRELMGDTERCQSMMVEFDNIFLDYSRQQASPDTISKLYKLADAAHLKQKIDRMYNGDHINTTENRSVLHVALRAPRNSSICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEELKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLQATSDVPADPSTLLPNI

SEQ ID NO: 81080 - protein, 569 aa, Clarkia epilobioides
MATPALISETEAWKDLKAHLEGIKRTHLRELMGDTERSQSMMVEFDNIFLDYSRQQASPDTINKLYKLAEAAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLGIYEHRVAVQGFVWGINSFDQWGVELGKSLATQVRKQLHASRVKGEPVEEGFNFSTKTLLTRYLQATSDVPADPSTLLPNI

SEQ ID NO: 81081 - protein, 369 aa, Streptococcus mutans UA159
MAKRIKNTTPKQDGFRMPGEFEKQKQIWMLWPWRNDNWRLGAKPAQKAFLEVAEAISEFEPVSLCVPPLQYENALARVSELGSHNIRIIEMTNDDAWIRDCGPTFLVNDKGDLRAVDWEFNAWGGLVDGLYFPWDQDALVARKVCEIEGVDSYKTKDFVLEGGSIHVDGEGTVLVTEMCLLHPSRNPHLTKEDIEDKLKDYLNCVKVLWVKDGIDPYETNGHIDDVACFIRPGEVACIYTDDKEHPFYQEAKAAYDFLSQQTDAKGRPLKVHKMCVTKEPCYLQEAATIDYVEGSIPREEGEMAIASYLNFLIVNGGIILPQYGDENDQLAKQQVQEMFPDRKVVGVRTEEIAYGGGNIHCITQQQPAT

SEQ ID NO: 81082 - protein, 476 aa, Clarkia delicata
MATPALISETEAWKDLKAHLEGIKRTHLRELMGDTERSQSMMVEFDNIFLDYSRQQASPDTINKLYKLAEAAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKLLGIYEHRVAVQG

SEQ ID NO: 81083 - protein, 336 aa, Legionella pneumophila str. Paris
MSYEELSNTMEQMLHEGKGILAADESNSTIGKRFASINTENTEENRRDYRLLLATTPDLEQYINGVILFEETFTQTDEHGTPIPELFANKGIIPGIKVDKGLVDLANTEHEKVTQGLDGLTERLLHFKKLGAKFAKWRNVYSISEYTPSLTAIKTGAENLGRYAAACQSVGIVPIVEPEVLMDGNHSIEHCAEVCEMVLHELFHTLFIHQVELEHIILKPSMVTCGKEVTPFSDPEEVADYTISVFRNNVPASVPTINFLSGGQTPQQATANLNAINQIGHQPWLLSFSFGRALQEDCLKEWCGNKANITKAQEALIKRARLNSMACLGEYQNDME

SEQ ID NO: 81084 - protein, 330 aa, Coprinopsis cinerea okayama7#130
MGASESAQRGGDEQQSEAVVDYYKILEVAEDATPDEIKKSFRRLALINHPDKNHDNIEEATKKFAVIQQAYEVLSDEQERAWYDSHKANLVPEADGDVVFEDIRTGNKAPRTKDRGLTTRHLARFFDATIWDGFHDEENGFFSIYRNLFSRIQSEEAMLDPDASGYPSFGYSSWPWTTEMKKRTNADGAAREFYSVWSNFATEKEFGWVEQWRLSEAPDRRVRRLMEKDNKKARDDARREYNETVRALVKFLRKRDPRFKKYEKEQQTLAASQSASTPTSKQTAQLDLENYVEQDWQKVDPAFHKSHADLEWGLVEGENDEEEWECVGCG

SEQ ID NO: 81085 - protein, 127 aa, Clarkia delicata
KGEVVNNHDELMSNFFAQPDALAYGKTPEQLKKENVSEHLIPHKLLGIYEHRVAVQGFVWGINSFDQWGVELGKSLATQVRKQLHASRVKGEPVEEGFNFSTKTLLTRYLQATSDVPADPSTLLPNI

SEQ ID NO: 81086 - protein, 329 aa, Pisum sativum
MTITRFVLNEQSKRPESRGDFTILLSHIVLGCKFVCSAVNKAGLAKLIGLAGETNIQGEEQKKLDVLSNDVFIKALISSGRTCILVSEEDEEATFVEPSLRGKYCVVFDPLDGSSNIDCGVSIGTIFGIYMVKDNHAPTLDDVLQPGKNMLAAGYCMYGSSCTLVLSTGSGVNGFTLDPSLGEFILTHPDIKIPKKGKIYSVNEGNAKNWDGPTTKYVEKCKFPTDGSSPKSLRYIGSMVADVHRTLLYGGIFLYPADKKSPNGKLRVLYEVFPMSFLMEQAGGQSFTGKQRALDLIPTKIHERSPIFLGSYDDVEEIKALYAAEQKNA

SEQ ID NO: 81087 - protein, 223 aa, Glycine max
MTKQQANWSPYDNNGGSCVAIAGADYCVIAADTRMSTGYNILTRDYSKISQLAEKCVMASSGFQADVKALQKVLSARHLIYQHQHNKQMSCPAMAQLLSNTLYYKRFFPYYAFNVLGGLDNEGKGCVFTYDAVGSYERVGYSSQGSGSTLIMPFLDNQLKSPSPLLLPAQDAVTPLSEAEAVDLVKTVFASATERDIYTGDKVEIVILNASGIHREYMDLRKD

SEQ ID NO: 81088 - protein, 490 aa, Vibrio vulnificus YJ016
MSLWSSVKFAQRYAQLPKVFYRLVTPQPLDNSRWVIWNGELAQGFALPKHADDPQLLSVFSGAEPFSAFKPLAMKYAGHQFGVYNPDLGDGRGLLLGEMQNQQGQWFDIHLKGAGLTPFSRMGDGRAVLRSTIREYLCSEAMAALGIETTRALGMTVSDTPVYREQVEQGACLIRLAQTHIRFGHFEHFFYTEQYDELRLLADNVIEWYMPECTAHDKPYLAMFEQVVARTATMIAQWQAVGFAHGVMNTDNMSILGQTFDYGPFGFLDDYEPGYICNHSDYQGRYAFDQQPRVALWNLSALAHALSPLVERDDLELALAQYEPTLGKVFSQLMRQKLGLLSQQEGDSELFNAMFTLLAENHTDYTRFFRTLSQLDSEGAQTVIDLFIDRDAARGWLSRYLERVALEQTASGEAKSAQQRCEQMRAVNPKYILRNYLAQQAIDKAQQGDFSEVHTLAKLLKNPYDEQAEMEAYAHLPPEWGKKMVISCSS

SEQ ID NO: 81089 - protein, 510 aa, Arabidopsis thaliana
MAAMLTVEFQNCLIFILLCILLLLCYPLFFKKPKVSQDGFGLPPSPLSLPIIGHLHLLFSNLTHKSLQKLSSKYGPLLYLRIFNVPIIFVSSASVAYEIFRGHDVNISFRGNPPIEESLLVGSFGFFTAPYGDYWKFMKKVMVTKLLGPQALQRSRGIRADALERFYMNLLDKAMKKESVEIGKETMKLIYDSICKMIMGRNFSEENGEAERVRGLVTESTALTKKIFMANVLHKPLKKLGISLFKKEIMDVSNSFDELLERFLVEHEEKLNEDQDMDMMGVLLAACRDKNAECKITRNHIKSLFVDLVVAGTDTSRHATQWTMAEIINKPKVLEKVREEIYSVVGRTRLVQETDLPSLPYLQATVKEGLRLHPPGPLFARTAREGFSVGGFYVPENTPLVVNAYAMMRDPGSWEDPNEFKPERFLGSGKEDEREHGLKYIPFGSGRRGCPGINLAYILVGTAIGVMVQCFDWKIKGNKVNMEEARGSLVLTMAHPLKCIPVARTQIPSC

SEQ ID NO: 81090 - protein, 627 aa, Xanthobacter autotrophicus Py2
MIVLDDISLRLAGRLLIDHASVAIPENARVGVVGRNGSGKTTLFKAIVGELELESGAVRLPNRTRIGRVAQEAPAGPDSLLERVLAADTERAQLLHERETTRDPMRMGEIEMRLLDIDAHSAPARAATILAGLGFDESAQQRPCSEFSGGWRMRVALAALLFTEPDLLLLDEPTNYLDLEGTLWLQDYLAHYPRTVILISHDRDLLDESVDHILHLTGKKLTLYKGGFTGFDRQRRERLLLDQKARKKQEMQRAHMESFVARFRAKATKAKQAQSRLKALARMEPLAAQVSEEAAAISIRHPERLLSPPILVMNHVSVGYVPGKPILRNLDLRIDEDDRIALLGPNGNGKSTFAKLIAGRLEAESGSVVRADKLEVAYLAQHQIDELIPGDSPAQHVRKLMPDAPEARVRARAAEMGFSGGAADTKVSSLSGGEKARLLLGLATFHGPHLLILDEPTNHLDIEARAALIEAINDYPGAVILVSHDRHLLEACAEQLWRVSGGTVKAYDGDLDQYKREVLSKSDGDRMTDAGRKDKAELKKDGAPAEGKRRVATGPLKKRIRELEAAVEKLEKEIAGIDVKLAAPDLHAKKPLDAARFAKARADAVEKLAQVEEEWLAVSAELETAGG

SEQ ID NO: 81091 - protein, 485 aa, Cytophaga hutchinsonii ATCC 33406
MNLEELLLGFSTLILISIFIARISNNLGVPVLLLFLGIGMLAGSEGAGGMAFDDTRLAQSIGITSLVFILFSGGLSTHWHIVKPVLFPAISLATLGVVVTAGSVAIFAHYVFDVSLLVSLLLGSIVASTDAAAVFSIIGARNIKIKGNITPLLELESGSNDPMAVFLTITMIEIIQMPDISFGQLALQFLMEMGIGLGMGLLLGKGIVFIINRLKIPIEGLYQVFVFASAFFVYASTNLIHGSGFLAVYVAGMVVGNHNIVHKKNVFRFFDGMAWVAQIVMFLTLGLLVFPSHILTAFKTELSISLFLIILARPLGVFISLIPFKFSFKEMLFISWVGLRGAVPIILATFPLLAGVAEAQWIFNVVFFIVITSALLQGWTIPFVLDLLHLKDTHKPFITSPTEFNHLDEVDRVRINMIVPDNATFNNQSIVSIKALQGCLIITVKRGDTYFVPSGGTVLQSGDYLQALVSKSKVEELQSILEVSQ

SEQ ID NO: 81092 - protein, 92 aa, Bordetella pertussis Tohama I
MATPSKTATARKPNAAFMKPLTPSAELAAVIGSEAVPRTEVTKKIWDYIKKHNLQDASNKRNINADAKLRPIFGKDQVTMFELTKLVNAHLK

SEQ ID NO: 81093 - protein, 433 aa, Vibrio campbellii AND4
MSKIVKVLGREIIDSRGNPTVEAEVHLEGGFVGMAAAPSGASTGSREALELRDGDKARFLGKGVLKAIEAVNGAIAEALVGKDAKDQAAIDAVMIDLDGTENKSKFGANAILAVSLANAKAAAASKGMPLYEHIAELNGTAGQFSMPLPMMNIINGGEHADNNVDIQEFMIQPIGAKTLKEGLRIGAEVFHNLAKVLKSKGYSTAVGDEGGFAPNLKSNAEALEVIAEAVAAAGYELGKDVTLAMDCAASEFFDKEAGIYNMKGEGKTFTSEEFNHYLAELANQFPIVSIEDGLDESDWAGFKHQTELLGDKLQLVGDDLFVTNTKILAEGIEKGVANSILIKFNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 81094 - protein, 429 aa, Picea sitchensis
MYVAPPPQLSVATQRGTDDNTVTRRVYQLWEGSNKFFLGGRLIFGPDVRSLFLTIFMIIVPLAIFCAFVANNLLDKFSHHLGIFIMAIAIIFTVSDLFLLLLTSGRDPGIIPRNENPPEQEEDYDTSISPAEWGGGQISRLRLPRTKDTMVNGVAVKIKYCDTCMLYRPPRCSHCSICNNCVERFDHHCPWVGQCIGQRNYRYFFMFVFSTTLLCIYIFAFCWVYIKIIMEAHQINVWRAMLKTPASIVLIIYTFIAVWFVGGLTAFHIYLISTNQTTYENFRYRYDNKENPYHRGLVQNFIEIFFTKTSPSKNNFRAKVTHESPDYKFFCSRLETDTLDTNMGKGGGDLEIGGKPSWPSLGIETSEDSEDLQGDALEGIDTRSGIHPRRSSWGRKSGSWEITPDIIALAAGVGGEVSRANGVNTPGNR

SEQ ID NO: 81095 - protein, 556 aa, Cytophaga hutchinsonii ATCC 33406
MSEQIIFSMAGVSKIIPPKRQIIKNIYLSFFYGAKIGVLGLNGSGKSTLLKIIAGIDKEFIGDVAFSPGYTVGMLEQEPKLDPTKTVKEIVEEGVQEVVDLLKKFEDINLKFGEEMTDDQMTKLIEEQGRIQELLDQHNAWELDTKLERAMDALRCPPGDAKIEHLSGGEKRRVALCRLLLQEPDVLLLDEPTNHLDAESVDWLEQHLQQYAGTVIAVTHDRYFLDNVAGWILELDRGEGIPWKGNYSSWLDQKQTRLSQEEKTESKRQKTLQRELEWVRMSPKARQAKSKARISAYDKLLGEETKEKEERLEMFIPAGRRLGSKVIEVQNVSKAFGDKLLFDDLSFNLPQGGIVGIIGPNGAGKTTLFKLITGQAQPDSGSFAVGETVDIGYYDQEHSGLDPEKSVFETISGGTEHLMLGNKQVNSRAYVSRFNFGGSDQEKKIGVLSGGERNRVHLAMTLKTGANLLLLDEPTNDLDVNTLRALEEALENFGGCAVIISHDRWFLDRVATHILAFEGDSQVYWFEGNYSDYEENKKKRLGDVGPQRIRYKKLVK

SEQ ID NO: 81096 - protein, 278 aa, Nocardioides sp. JS614
MAIPTHQLNDGSTLPAIGFGTYPMKGEEGVTAIRGAIEVGYRLLDTAVNYQNETAVGEAIRRSRVPRELLQVTSKLPGRDHGYDDAIASVHGSLERLGLEYLDLHLIHWPNPSRDQYVDAWRALVDLREQGLVRSIGVSNFTERHLERIIAATGVTPAVNQIELHPYFPQADMRAVDEGLGIRTEAWSPLGKRQAPFAEPAVADAARRHGMTPGQVILRWHVQLGSIPIPKSAAPERQRQNLDVFGFELSEDEVAAITALGRPDGRLFGGDPDVHEEM

SEQ ID NO: 81097 - protein, 506 aa, Hyphomonas neptunium ATCC 15444
MRVSIRRFALALSLPAAAGAPALAQDAYYDDGQPPAAIALFTSENFYGDVREAFDPFVSMHDLAFNDRARSAAVLAGQWELCEHANFTGRCVFVREDVADLAWFGLNGRISSIRPVFEYTEAQHGLMFTRDDNGYIRYAHNEAYGYDTWNYGYSSSVRLSVQHYGYSPDYWRFGYYDPRWGFDPYGFAWRPSGGPRYVSYTYRVHPRPVVINTYWKKHWGKSHKHWDRRGHRDDWRHKPSWNGRGDDRGPGRGNGGWDRDRDRDRDRDWNRDRDGGRPDGRPGWGNDGRGSGITPRERIDDRDRGWSAGDRAQRGGDGPRTERTSPPRTGGRAIPVDPRRGEGRGRGDWSGRPDGGAAIVTPPAGADRDRGGREGGWRGGDRDRGESRPSGARPNRDGPNRDGMRGNGGGRGGDRLLGAPSGGGRPVVDTPRRGGGDFGRGGGDSGRRGGAGAAPSAPAPAPVARPSPPPTAVSRPAPPPRVERPRGRSGDGGGGRGGRRPGSAQD

SEQ ID NO: 81098 - protein, 213 aa, Zea mays
MEGLSWRTVCCLSVLCAVLFLRPAEGIRFVIDREECFSHNVEYEGDTVHVSFVVIKADTPWHYSEEGVDLVVKDPNGAQVRDSRDKTSDKFEFIVQKRGVHRFCFTNKSPYHETIDFDVHVGHFSYFEQHAKDEHFAPLFEQIGKLDEALYNIQFEQHWLEAQTDRQAILNENMSRRAVHKALFESAALIAASVIQVYLLRRLFERKLGTSRV

SEQ ID NO: 81099 - protein, 409 aa, Pseudomonas aeruginosa PAO1
MAIEIKAPTFPESVADGTVATWHKKPGEAVKRDELIVDIETDKVVIEVLAEADGVLAEIIKNEGDTVLSNELLGKLNEGGAAAPAAPAAAAPAAAPAAQAAAPAAAGGDDAILSPAARKLAEEAGIDPNSIAGTGKGGRVTKEDVVAAVEAKKNAPAAPAKPAAPAAEAPIFAAGDRVEKRVPMTRLRAKVAERLVEAQSAMAMLTTFNEVNMKPIMDLRSKYKDLFEKKHNGVRLGFMSFFVKAATEALKRFPGVNASIDGNDIVYHGYQDIGVAVSSDRGLVVPVLRNAEFMSLAEIEGGIANFGKKAKEGKLTIEDMTGGTFTISNGGVFGSLLSTPIVNPPQTAILGMHKIQERPMAVNGQVVILPMMYLALSYDHRLIDGKEAVSFLVAIKDLLEDPARLLLDV

SEQ ID NO: 81100 - protein, 478 aa, Pseudomonas aeruginosa PAO1
MSQKFDVVVIGAGPGGYVAAIRAAQLGLKTACIEKYIGKEGKVALGGTCLNVGCIPSKALLDSSYKYHEAKEAFKVHGIEAKGVTIDVPAMVARKANIVKNLTGGIATLFKANGVTSFEGHGKLLANKQVEVTGLDGKTQVLEAENVIIASGSRPVEIPPAPLTDDIIVDSTGALEFQAVPKKLGVIGAGVIGLELGSVWARLGAEVTVLEALDKFLPAADEQIAKEALKVLTKQGLNIRLGARVTASEVKKKQVTVTFTDANGEQKETFDKLIVAVGRRPVTTDLLAADSGVTLDERGFIYVDDHCKTSVPGVFAIGDVVRGAMLAHKASEEGVMVAERIAGHKAQMNYDLIPSVIYTHPEIAWVGKTEQTLKAEGVEVNVGTFPFAASGRAMAANDTTGLVKVIADAKTDRVLGVHVIGPSAAELVQQGAIGMEFGTSAEDLGMMVFSHPTLSEALHEAALAVNGHAIHIANRKKR

SEQ ID NO: 81101 - protein, 388 aa, Pseudomonas aeruginosa PAO1
MNLHEYQGKQLFAEYGLPVSKGFAVDTPEEAAEACDKIGGSEWVVKAQVHAGGRGKAGGVKLVKSKEDAKAFAQQWLGKNLVTYQTDANGQPVSKILVESCTDIDKELYLGAVVDRSSRRIVFMASTEGGVDIEKVAHDTPEKILKATIDPLVGAQPYQGRELAFQLGLKGDQIKQFTHIFVGLAKLFQDYDLALLEVNPLVIKKDGNLHCLDAKINIDSNALYRQPKLRAMHDPSQDDAREAHAQKWELNYVALEGNIGCMVNGAGLAMGTMDIVNLHGGKPANFLDVGGGATKERVTEAFKIILSDSNVKAVLVNIFGGIVRCDMIAEGIIGAVKEVGVKVPVVVRLEGNNAELGAKVLAESGLNIIAATSLTDAAQQVVKAAEGK

SEQ ID NO: 81102 - protein, 156 aa, Capsicum annuum
MSAPKKILLKSSDGETFEVDEAVALESQTIKHMIEDDCANTSIPLPNVTSKILSKVVEYCKKHVDAGAKTEDKASEDDLKSFDSEFVKVDQGTLFDLILAANYLNIKSLLDLTCQTVADMIKGKTPEEIRKTFNIKNDFTPEEEEEVRRENAWAFE

SEQ ID NO: 81103 - protein, 127 aa, Carboxydothermus hydrogenoformans Z-2901
MSKVQEILEAVKSLTVLELAELVKAFEEEFGVSAAAPVAVAAAPAAGAAAAAPAQEEKTEFDVILVSPGAQKVNVIKVVREITGLGLKESKDLVDGAPKPVKEKVSKADAEAIKAKLEEVGATVEIK

SEQ ID NO: 81104 - protein, 168 aa, Zea mays
MRSPVPAMLTAPSAAAAVAKPLPVARSNTTAALHATASSRRDVMTGVGAALLMALSPQRARAASDDEYLTETTEVIGKVRSTISMDKTDPKVADAVTELREMSNSWVAKYRREKALLGRQSFRDMYSALNAVSGHYISFGPTAPIPAKRRIRILEEMDTAEKALPPPR

SEQ ID NO: 81105 - protein, 370 aa, Zea mays
  misc_feature (128)..(128): Xaa can be any naturally occurring amino acid
MPRTTVVESPGCPPLRALTTDILGLVKVVEAHARPAGAAKVVETWGAPDASCAIVAASLADRATDPVLAVARMNGVVELLNPLNGDTLAAVKAVGPAPNDGGAEGDPLTALHLSPRPAARSILRNVFXCLHGSPGKASIRPITKENAASGSHIEPSATWDVCGGANVQFCSVDHGENYVMFGGKGIEVSLWDITSCSKTWSAKSPRTNSLGLFTRPWFTAGTFLCKDDHRKIVACTNSHQVRLYDTALQRRPVISVEFKESPIKAVAADPNGHDVYIGTGTGDLASFDMRTGLDSYLRIWDTNTRQLLSAVFLKQHLTTVVLDSHFSVEEPGEMKSKQLESSVETEAEVRKEKKKKSKAITGDETEAQIR

SEQ ID NO: 81106 - protein, 445 aa, Salmonella enterica subsp. arizonae serovar 62:z4,z23:--
MSSDADAHKVGLIPVTLMVSGNIMGSGVFLLPANLAATGGIAIYGWLVTIIGALALSMVYAKMSSLDPSPGGSYAYARRCFGPFLGYQTNVLYWLACWIGNIAMVVIGVGYLSYFFPILKDPLVLTLTCVAVLWIFVLLNIVGPKMITRVQAVATVLALVPIVGIAVFGWFWFKGETYMAAWNVSGMNTFGAIQSTLNVTLWSFIGVESASVAAGVVKNPKRNVPIATIGGVLIAAICYVLSTTAIMGMIPNAALRVSASPFGDAARMALGDTAGAIVSFCAAAGCLGSLGGWTLLAGQTAKAAADDGLFPPIFARVNKAGTPVAGLLIVGVLMTIFQFSSMSPNAAKEFGLVSSVSVIFTLVPYLYTCAALLLLGHGHFGKARPLYLAITFIAFIYCIWAVVGSGAKEVMWSFVTLMVITALYALNYNRIHKNPYPLDAPVKQD

SEQ ID NO: 81107 - protein, 1295 aa, Neptuniibacter caesariensis
MFDPKQAIEWLIAKQQLCLKMELPLTELIVEIHQYVDQFSEQDLSGLADLLALYAELLESLEGADISEYQPLISDVASQLESVFSHSPETVTDALVSLLQDTRWPEPVAEEDASFLIELLESDCAQLCAADFQSDASASGEQLSEPELIDKPLIEEVDASETLLEAPAHLQQPLSGIFTLLSELSNNLPVFHEALSDQFYELIDQCSENDWAGIADLLALYGELLVQLPEMADTGIAKQLNDALLNLLSELTESAIDPVFELLQNATWDEPVAQEDTDFLKALLLDDLHRLSAHSEQAPESENAVDLQAFEATEDDLAELHLLGPMEQASSQDVKDLDVAAEPTEEPVSFCTIDFSLLEEQGPQIDPAVMEMLSHSLSQLVQQWQTENPDKGLISESEESLSTVLRALETVNLIGAKVLVEGLLFNLELLKAGEGALTIERTQAIESCLSAFIEYFADIGSFDSQQTLLDQFVDAPLLCRPATEEASFIMGLLAQASIQTSDDIVQEYAEPEDILLSESDEIDPQLLDMLHNELPTLSDELLGNMQQVLDQDDKEALAGAQRAVHTLKGLANMAGIRGLANLAHRLEDVMDFLTEAGQMPGLGLKEDMLEACDCIAAMSDTVTEGGNAPENAQGVLQSIMDWDFRLKTEGLEALQAEPTRQKPQAASSQDSAPAESAEPEEVQDNPQEGSRSDTPVFRVPRNILDNLFRLAGESSTLNTQLDEEITQLRGFTRVNRDRHRNLQRILFELEQQFSEQMNLQPQLDESSEEFDPLEMDRYNEMHTIISRVQEAVADVREVTQEMDGHIHNLSSLHIAQSGLQKETLENVLSTRLVEVRTITSRLQRILRQACRATGKMAQLVVEGEETLVDSHILNQLADPLLHIIRNAVDHGLESPQLRKQRGKDEQGTITLSFALVDDQISVKCADDGDGINTQKVLAVANEKALVDPDQPMSEQEAHRLILIPGFSTRGEISQLSGRGIGMDVVYQQILRLQGTLDIASVSGQGTTFSLSMPSSSLMIRTLLVRCAKQVFALAGHGVEQSLLSLDGIIRREDEQLIFTYKNEDYPAFALEGLLDQGGFNYLEEGAVNPVLIVNMGQGERVAVLVREVIAHRELAFKQMGDFVPELPGIPGLTILANGEAAPIIDLPGRIRHKRASLTDQPLLLDNSDELELPRLLVVDDSLSARKSLEILLKDTGYEVMTAIDGLDALNQIRKRQPDLILSDMEMPRMGGIELATVLNNREETADIPVIMITSRSTEKHRNEAVNAGVAAYLTKPWTENQLLDLVDNLLAEAYV

SEQ ID NO: 81108 - protein, 152 aa, Musa acuminata AAA Group
MAAIASVKARRIFDSRGNPTVEVDVCLTDGTCARAAVPSGASTGVYEALELRDGGSDYLGKGVLKAVANVNTIIGPALIGKDPTEQVEIDNFMVQHLDGTSNEWGWCKQKLGANAILAVSLAVCKAGASVKKIPLYQHIANIAGNKNLVLPV

SEQ ID NO: 81109 - protein, 195 aa, Thermoplasma acidophilum DSM 1728
MIELYSNARLPTEFGLFRIYTFVNDENKDHAVIVRGDPRGKEDVPVRIHSECLTGDVLGSLRCDCRDQLIQSLRYLGRQDYGMLIYLRQEGRGIGLLNKIKAYSLQDSGADTVEANLKLGLPVDSRDYSFASEVIKFFEIKSIYIMTNNPEKMKALIESGINVKGRIPIFSDPTPYDKFYLETKKIKLGHEIENI

SEQ ID NO: 81110 - protein, 366 aa, Daucus carota
MASVMNLSITHFCSSHLKQKSPNKLVFHGLNSNPNFSKSKPPQNVIPYSSLSISSVQTTKIVMDSSPTPSTFDFKSYMLEKAISVNKALDASVSLQEPVKIHESMRYSLLAGGKRVRPLLSIAACELFGGHEAVAMPSACAVEMIHTMSLMHDDLPFMDNDDLRRGKPTNHKVYGESVAVLAGDAMLALAAFHLVATETRGVSSDQVVRVIVELAKAIGAEGLVAGQIVDVCSEGDPNLGLEDLEFIHRSKTAALLEGSVVMGAILGGANDEEVEKVRKYARCIGLLFQVVDDILDVTKSSKELGKTAGKDLVADKTTYPKLIGIEKSREFSDELKREAIDQLAGFNSDKTAPLIAMANYIANRDN

SEQ ID NO: 81111 - protein, 564 aa, Erwinia carotovora subsp. atroseptica SCRI1043
MKTHGINGIRPFSALIDACWREKYTLQRFTHDIIAGVTVGIIAIPLAMALAIASGVPPQYGLYTSAIAGIVIAVSGGSRYSVSGPTAAFVVILYPVSQQFGLSGLLVATLLSGVFLLLMGLCRFGRLIEYIPLSVTLGFTSGIAITIGTMQIKDFFGLQMAVVPEHYVEKVAALAQALPTLHLADTLIGATTLLVLIVWPRLGIRLPGHLPALLAGVAVMGIMSLVGENVATIGSRFSYMLADGSQGQGIPPILPQLVLPWNIPSPDGKTMTLDWQSISALLPAAFSMAMLGAIESLLCAVVLDGMTGKKHNSNAELMGQGFGNIIAPFFGGITATAAIARSAANVRAGANSPVSAVIHALLVLLALLILAPWLSYLPLAAMASLLLIVAWNMSEAHKVVDLLRHGPKDDIIVMLLCMSLTVLFDMVIAITVGIVLASLLFMRRIAQMTRLSELPDTKIPDHLVLRVNGPLFFAAAERIFNDLTVRSEGYQNIILQWDAVPVLDAGGLNAFLRFSETLPEGKQLIITDIPFQPLKTLARAKVHPIEGRLSFYGSLAQAIEATTK

SEQ ID NO: 81112 - protein, 269 aa, Vitis vinifera
  misc_feature (19)..(19): Xaa can be any naturally occurring amino acid
  misc_feature (55)..(55): Xaa can be any naturally occurring amino acid
MAIWLVNGLRGLFSVLGCXMLATLLYTISTDGLPFRRDLLTPWMAATLVDFYINXVALAAWVSCKESNWVSAILWTILLVCFGSITTCAYIVLQFSKMSSESVQDAIYHVLLRNQSKWMTATLIDFYINVVALSVWVAYKESSWISAFLWIILLICFGSITTCIYIVQQLFQLSSQDPLYLVLLNNGNRCMGVVDCDFHPDLMGSAKKNERTASKLEFKNLLAKNKTKELVTRLKEIYLFSLYAWTGIGTLIRKHAFWNTLTAWVVQES

SEQ ID NO: 81113 - protein, 534 aa, Chlamydophila pneumoniae TW-183
MLSAMSIVLDKIGKSLGTRILFDDVSVVFNPGNCYGLTGPNGAGKSTLLKIIMGMIEPTRGSISLPKKVGILRQNIDSFHDTTVLDCVIMGNTRLWEALQRRDNLYLQEFTDAIGMELGEIEEIIGEENGYRADSEAEELLTGIGIPNEMFDKKMAMIPIDLQFRVLLCQALFGHPEALLLDEPTNHLDLYSINWLGNFLKDYEGTVIVVSHDRHFLNTITTHIADIDYDTIIIYPGNYDDMVEMKTASREQEKADIKSKEKKISQLKEFVAKFGAGSRASQVQSRLREIKKLQPQELKKSNIQRPYIRFPLSDKSSGKVVLSLEAITKDYGDHQVIHPFSLEIYQGDKLGIIGNNGLGKTTLMKLLAGVEAPSSGSIKLGHQAICSYFPQNHSDVLADCGQETLFEWLRNRKTGINDQEIRSVLGKMLFGGDDAFKQIQALSGGETARLLMAGMMLENHNVLILDEANNHLDLESVSALSWAINDYKGTAIFVSHDRGLIQDCATKLLIFDKDKITFFDGTMVDYTAGHKQLL

SEQ ID NO: 81114 - protein, 382 aa, Zea mays
MERMLARLMRRRSSVPLSGLLHHGGAPAPLQAAGATGASPLILSHQQQQQHTAASAVLPGLKIRDSASQLIGRTPMVYLNKVTEGCGARVAAKLEFLQPSFSVKDRPAISMLEDAEKRGLITPGKTTLIEPTSGNMGIGLAFMAALKGYELVLTMPSYTSLERRVTMRAFGANLVLTDPAKGMGGTVRKATELYERHPSAHMLQQFQNPANVKVHYDTTGPEIWEDTLGQVDIFVMGIGSGGTVTGVGKYLKEKNPNAKIYGVEPAEANVLNGGKPGPHLITGNGVGFKPDILDMDVMEKVLEVKGEDAVKMARELAVKEGLLVGISSGANTVAALELAKRPENKGKLIVTVLPSLGERYLSSALFDELRKEAQAMEPVAVD

SEQ ID NO: 81115 - protein, 488 aa, Salmonella enterica subsp. enterica serovar Paratyphi B str.
MKKINHWINGKNVAGNDYFQTTNPATGDVLAEVASGGEAEVNQAVAAAKEAFPKWANLPMKERARLMRRLGDLIDQHVPEIAAMETADTGLPIHQTKNVLIPRASHNFEFFAEVCQQMNGKTYPVDDKMLNYTLVQPVGVCALVSPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPTNPNTQVGALISQQHWEKVSGYIRLGIEEGATLLAGGAEKPTDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 81116 - protein, 173 aa, Psychrobacter arcticus 273-4
MSNLQQQRNDVTHIDGNLHQNEDVRIGIVVGRFNGFVVESLVDGAIDALLRHGVLGSNITVIRVPGAFELPLVAQRAAESDRFDAIVALGAIIRGSTPHFDFVASESAKGLSSVAIDYNIPVANGVLTTDSIEQAIERAGTKAGNKGSEAAMVVLEMLAVLSQLDIDDGSDDA

SEQ ID NO: 81117 - protein, 158 aa, Vibrio campbellii AND4
MIRIGHGFDVHKFGGEGPVIIGGVAVPYEQGLIAHSDGDVALHALTDALLGAIAAGDIGRHFPDTDDKWKGADSRELLKDVYRRVKEQGYRLGNADVTIMAQAPKMAPHIDAMCAVIAEDLETDISNINVKATTTERLGFTGRKEGIATEAVVLLFKQ

SEQ ID NO: 81118 - protein, 633 aa, Xanthomonas albilineans
MSRSAWWCAPWSASIRIRRFRKPIRSCWPSWRGCAATTPSCTHTERGLRMRRSVRCVLLLAWVLMSSAWAQASLGASAAAPTSHPPGDAIASGHRLATEAGLQILREGGNAFDAAVAVSSTLSVVEPISSGLGGGGFFLLHDARTGQDTMLDAREVAPESATPDTFLDAKGALDHDRSVNGPWSAGIPGLPAALVELATRHGRLPLRQSLAPAIRIARDGFPVYARMAEGYQARRKVMERYPGTREVYLRHGRPIAEGDLFKQPELAVTLQLLADKGFDGFYRGVTARKLLAGVKQAGGRWTADELAGYTVKQRTPIRFDYKGWTITTAPPPSSGGIALASMLQILEAYDLKAMDPVHRIHLTVEAMRRAYRDRTFFLGDPDFTVVPQRILLSKDYAVGLRSTINPDKATPSDLLSGQPTPLEDDETTHFSIIDREGNRVGATQTVNLLYGSGLIPKGTGVLLNDEMDDFALRPGTPNVFGVMGYAANAPKPGKRPLSSMTPTFMENADKAIVLGTPGGSRIITMVLLGILGYDDGLDPQQVAALKRYHHQWLPDVIEAETGTFDAATVQGLKAMDHPLKLPGDSAKDGRGSSHVWGNLQTVEWDKRRDELGAASDPRNKVGSAEVQLAMPAH

SEQ ID NO: 81119 - protein, 289 aa, Oryza sativa Japonica Group
MATPPEPSSWLSLKVFFLRVSRCEVNESMLDSVTVTHAPLTPDTVLEVSGGSVASNGHVSLRLDRAGGVCAAATEGGDSCTFVSTADVRVSGSARFDVQCRGERLVVGILDTRDAGAGGGGWVMKCQVAAQRGSGLVRRGSKEAKPPVVEVYVAGLARGAPVVFTRAMQLRFRRRRHVKAFMEPIPEHGEPAEDSKETLPPKHETEVSEYRCYKPEQDAGDADYDGFYVKPAGEEDDDGDFSWFTAGVRVGVGISVGICLGIGIGAGLLARSYHSTSRSLRSRLISSLF

SEQ ID NO: 81120 - protein, 627 aa, Bacillus pumilus SAFR-032
MSLLNVEGLYKTYGEKTLFDHISFHIEPKERIGLIGPNGTGKSTLLKVIAGLESFEEGDITKAGTLDIEFLEQDPEMDGDETILDYIFSGTAPMIQTMKAYEQALADLEHDPQNEAKQEALMRMQNRMDQEDAWDANLSAKTILTKLGVKDVSRSVHALSGGQKKRVAIAKNLIQPAGLLILDEPTNHLDNATIEWLEGYLSQYSGAVILVTHDRYFLNRVANRIYELNQGQLYTYKGNYEVFLEKRAEREAEAQVKETKRQNLLRRELAWLRRGAKARTTKQKARIGRAEELMDQKGPDAKGELDFAIGSHRLGKQVIEAEDLSISFAGQTLVEQFTDLVVPGDRIGFIGPNGVGKTTLLNCLAGKIEPTSGQLTIGQTVRIGYYTQDHKEMDEELTIIEYIKETAEIVKTSDDAIVTAEQMLERFLFPRSMQRTFIRKLSGGERRRLYLLKVLMEEPNVLFLDEPTNDLDTETLSILEDYLEQFPGVVMTVSHDRYFLDRVVHRLLVFEGNGRISHYQGAYSDYMEQEKEQKRTETKPAEKQVEAAPKKRKKLSYKDQLEWDGIEDRIQALEEKHQQLEASIAEAGSDFGKIQELMDEQKAVAEELEQAMDRWTELSIMIEELEG

SEQ ID NO: 81121 - protein, 520 aa, Oryza sativa
MGKFRKLGRHAAHRVSMLRTMVSQLVKHERIETTVAKAKEVRTKADQMVQLGKEAAFSTHGAAAIAGAALSPPPSESRRPRLAQRTATAPPGIGRVQQGSGGINSIGFAVIRKGSLKLRCYAIGGLGGGENLNDPLKESNNGPVLQGFNGSSASFRTVGAKITQETGDFFVSDAEGDPDKPTDGFSSIDEAIGALHEGKFVIAVDDESGDNEGDLVMAATLADPESIAFMIRNGSGIISVGMKEEDLTRLMIPMMSPIAEIEDISAAASTVTVMALEHDIPIVSIADLIRYRRKREKLVELIAVSRLPTKWGLFRAYCYQSKLDGTEHIAVAKGDIGDGEDVLVRVHSECLTGDILGSARCDCGNQLDLAMQLIDKAGRGVLVYLRGHEGRGIGLGQKLRAYNLQDDGHDTVQANVELGLAVDSREYGIGAQILRDMGVRTMRLMTNNPAKFVGLKGYGLAVVGRVPVISPITKENQRYLETKRTKMGHVYGSDLPGNVPEEFLNPDDIAGDQDEDDTHN

SEQ ID NO: 81122 - protein, 367 aa, Daucus carota
MAFIQTNTAHENSLLSKNLLFDHLKNTGKTPSSYCTRHHPMKIQGANAVNSTLVQSVNVQELLTNPRVTPGPEFHFEGYMKTSGKKINKALDEAVPVQKPAIIHEAMRYSLLAGGKRVRPVLCIASCELVGGLESWAMPMACALEMIHTMSLIHDDLPCMDNDDLRRGKPTNHKVYGEETAILAGDALLSLAFEHVADATDMVTPGRVVRAIAELGSAVGSQGLVAGQIMDICNQGKDVDLNDLEYIHVHKTSKLLEASVVCGAILGGGNVIEVERLRKYARCIGLLFQVVDDILDVTKSSAELGKTAGKDLVTDKTTYPKLMGLERAKRFATELVAQAEEELSYFGSSARVAPLYHLAKYIAYRQN

SEQ ID NO: 81123 - protein, 312 aa, Glycine max
MASQIREWSGINTFAPATQTKLLELLGNLKQENVNSLTILVMGKGGVGKSSTVNSIIGERVVSISPFQSEGPRPVMVSRSRAGFTLNIIDTPGLIEGGYINDMALDIIKRFLLNKTIDVLLYVDRLDVYRVDNLDKVVAKAITDSFGKGIWNKAIVTLTHAQFSPPDGLPYDEFFSQRSESLWKVLRSGARIKKEAFQAASIPVVLVENSGRCNKNDSDEKVLPNGTAWIPNLVQTITDIALNQSESIHVDKNLIEGPNPNQRGKLWTPLVFAIQYFLIMKPIKGLIEKDIANERKPTWERRDAAFRKRDLY

SEQ ID NO: 81124 - protein, 748 aa, Vibrio parahaemolyticus RIMD 2210633
MLSQLREIVEKVSRVDDVHLALDILVKETCAALRTECCTIYLANEEMQRLELMATQGLIFEGDSIHINFNEGLVGLVKRSAEPLNLAEASKHPEFKFFPQLGEQVYHSFLATPIIHRKQVLGVLVIQQKTPRLFSEMEESFLVTLSAQLAVIIAHAQSLGHWQLASKPTVLKGLPASTGVAIGEFWFDNTQPSLSDVFPSSTLDKEREQELLLVAIERALNDFRRMRKKFDSEINKDALAIFDLFTHLLNDPMLRGDLKKQIEKGDRADWALRQVVETYSNRFARMSDVYLRERAQDIRELGQRLLYFLHNSEQENAAIDRPIILVANELTATLLASVPKEHLLAVVSLEGGANSHAAILSRALGVPAVMGANINTDVVNGKLGIVDGYTGEIFLEPNRQLLREYRSLVSEESELFAMVNKDLALPAVTLDNQYIEVMLNAGLSADSNIAINTGVDGVGLYRTEIAFLLQHHFPSEDEQYHQYRAILNSYSNQRVVMRTLDIGGDKPLPYLPIEEDNPFLGWRGIRFTLDHPDIFLIQLRAMLRASAESGNLSILLPMVSGIKELDDAMTLINQAYSEVVLLDERIQAPKVGVMIEVPSMVYLLPAIAHRVDFVSVGTNDLTQYLLAVDRNNSRVADVYESMHPAVLLALKQIHDVCDKYHVPVCICGELAGDPFGALLLLGLGYTSLSMNTSNVAKVKYLIRHSQQQELEKLAEQAMTKSYGEEIHQMMHDFFIQQGFAGFVRAGKK

SEQ ID NO: 81125 - protein, 509 aa, Carboxydothermus hydrogenoformans Z-2901
MASKVIVLDFGGQYSQLIARRIRELKVYCEMLPYNTPLEKIVQENPGGIVFSGGPSSVYGEGAPTVDPEIYRLNIPILGICYGMQLMAHQLGGIVRPAEGREYGKTPLFILNRDRLFAGLNETEICWMSHGDFVAKAPEGFLVTAKTEYTPIAAMENRERNLYAVQFHPEVVHTPKGKEILKNFLYEICGLTPDWTMESFAQKAIREIKEQVGEEKVVCALSGGVDSSVAAVLVHKAIGDNLTCIFVDHGLLRKGEAEEVVRTFKEQFQMNLVFVDAKEQFLAKLKGVRDPEQKRKIIGHEFIRVFEEEAAKLGDIRFLVQGTLYPDVVESGTATAATIKSHHNVGGLPEDMKFQLIEPLKWLFKDEVRELGLELGLPESIVWRHPFPGPGLAVRVLGEITEEKLAILREADYIFIDELKKSGWYRKTWQAFAVLPNLQSVGVMGDERTYAYTIALRAVTSEDGMTADWVRLPYELLEKISARIVGEVKGVNRVVYDITSKPPATIEWE

SEQ ID NO: 81126 - protein, 71 aa, Brassica napus
MIIPVRCFTCGKVIGNKWDAYLDLLQLDYTEGDALDALNLVRYCCRRMLMTHVDLIEKLLNYNTLEKSDNS

SEQ ID NO: 81127 - protein, 572 aa, Staphylococcus aureus subsp. aureus COL
MSKLIKGIAASDGVAIAKAYLLVEPDLTFDKNEKVTDVEGEVAKFNSAIEASKVELTKIRNNAEVQLGADKAAIFDAHLLVLDDPELIQPIQDKIKNENANAATALTDVTTQFVTIFESMDNEYMKERAADIRDVSKRVLSHILGVELPNPSMIDESVVIVGNDLTPSDTAQLNKEFVQGFATNIGGRTSHSAIMSRSLEIPAIVGTKSITQEVKQGDMIIVDGLNGDVIVNPTEDELIAYQDKRERYFADKKELQKLRDADTVTVDGVHAELAANIGTPNDLPGVIENGAQGIGLYRTEFLYMGRDQMPTEEEQFEAYKEVLEAMGGKRVVVRTLDIGGDKELSYLNLPEEMNPFLGYRAIRLCLAQQDIFRPQLRALLRASVYGKLNIMFPMVATINEFREAKAILLEEKENLKNEGHDISDDIELGIMVEIPATAALADVFAKEVDFFSIGTNDLIQYTLAADRMSERVSYLYQPYNPSILRLVKQVIEASHKEGKWTGMCGEMAGDETAIPLLLGLGLDEFSMSATSILKARRQINGLSKNEMTELANRAVDCATQEEVIELVNNYVK

SEQ ID NO: 81128 - protein, 207 aa, Bradyrhizobium sp. ORS278
MSERLLVLVRHGQSEWNLKNLFTGWKDPDLTAQGVSEAKDAGRKLKAHGLSFDVAFTSELTRAQHTLKLILDELGQPGLPTSKNLALNERDYGDLSGLNKDDARAKWGEEQVHVWRRSYDVPPPGGESLKDTLARALPYYVQEILPGVLNGQRTLVAAHGNSLRALIMVLEKLTPEGILKRELATGVPIIYRLKADSTVESKLDLAG

SEQ ID NO: 81129 - protein, 221 aa, Nocardia farcinica IFM 10152
MALIDPRAGLSGIAPSSPQARYILPSFIEHSSFGVKESNPYNKLFEERIIFLGVQVDDASANDIMAQLLVLESLDPDRDITMYINSPGGSFTSLMAIYDTMQYVRADVATVCLGQAASAAAVLLAAGTPGKRACLPNARVLIHQPSLEGGIQGQVSDLEIQAAEIERMRRLMETTLARHTGKDPDTIRKDTDRDKILTAEDAKEYGIIDTVFDYRKLSAQK

SEQ ID NO: 81130 - protein, 132 aa, uncultured marine bacterium 159
MAKKITKSESEWATCLTPDEYSILREKGTEMAFTGKYYKHKDDGKYVCAACDYELFSSNTKYDSDTGWPSFYAALDKDRILEKRDNTLGMVRTEILCARCESHLGHLFPDGPRPSGLRYCVNSISLDFKKTE

SEQ ID NO: 81131 - protein, 409 aa, Alkaliphilus metalliredigens QYMF
MDIENIRNEFPILINNPDKIYFDSASTTQKPYAVIHTLNNFYTNCCANIGRGSYEWANKLDIEVNEARKKVASFINAPSPNEIVFTSGTTHSSNTIIYSWALHHLKEGDEVLVCYSDHKSAIMPWIHIKNILQGFSIKIKVIPILINSQGDYNEIDLYEKVNRKTKVINLTHIHNVFGIEMGIKEMISNLRSNKEIVFIVDASQSIGHVRVDVQDLEADFLYFSGHKMFAANGTGVLWVNKRLHSQIRPFMVGGNNKIEVSGEGFYHEDKIQNLLESGTMDIPSILTLGAAIDFIKEIGIEQIEAYLLHLTQYLIEELKTIKEVQFLPGPALCSCIIGNGIVSFKIQGEKSQDIGYVLNDYGVFIRAGSHCMGDESLAEDSIRVSLQIYNTVEEIDRFISIIKEIVEAI

SEQ ID NO: 81132 - protein, 338 aa, Streptococcus agalactiae NEM316
MKAVVVNQASTGVEVVEHDLPKVGHGEALVKVEYCGVCHTDLHVAHGDFGQVPGRILGHEGIGIVEEIGEGVTSLRVGDRVSIAWFFEGCGHCEYCTTGRETLCRSVKNAGYSVDGGMSEYAVVTADYAVKVPEGLDPAQASSITCAGVTTYKAIKEAGAAPGQWIAVYGAGGLGNLAVQYAKKVFNAHVVAVDINADKLQLAKEVGADLTVNGKEIKDVAAYIQEKTGGCHGVVVTAVSKVAFNQAIDSVRAGGTVVAVGLPSEYMELSIVKTVLDGIRVVGSLVGTRKDLEEAFAFGAEGLVVPVVEKVPVDTAPQVFDEMERGLIQGRKVLDFTK

SEQ ID NO: 81133 - protein, 258 aa, Brassica napus
  misc_feature (237)..(237): Xaa can be any naturally occurring amino acid
  misc_feature (246)..(246): Xaa can be any naturally occurring amino acid
MESLALRSLSTTASSPLSYLSLRRSYSRSLTIPHPSISLHSSSSTVLSLSLSSPRLTLRAAAPSASSSPEIQNNPQSSSSSSSPPQGAKLIPLAISISIGLIVRFLIPKPEQVTSQGWQLLSVFLFTISGLVLGPLPVGAWAFIGLTASIVTRTLSFSTAFAAFTNELIWLIAISFFFARGFVKTGLGDRIATYFVKWLGRSTLGLSYGLVLCETFMGLIMPSTMARAGGVFLPVIXSLSLSAGSXTGDSSSRRGGCF

SEQ ID NO: 81134 - protein, 260 aa, Oryza sativa
MAIAVRSAAAAAAVARHSLRPPLAAPGSIRGASLLPPQRARGVGPCRARARAASSSATGGGGHLPPLFSVAPMMDWTDNHYRTLARLISKHAWLYTEMVVAETIVHQKDNLDRFLAFPAEQHPIVLQIGGSNLDNLAKATELANAYSYDEINLNCGCPSGKVAGHGCFGARLMFDPEFVGDAMSAIAANCNVPVSVKCRIGVDDRDSYEELCEFVDKVVSKSPTRHFIIHARKALLSGLSPAENRNVPPLKYVTPMIFFV

SEQ ID NO: 81135 - protein, 298 aa, Triticum urartu
FSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADV

SEQ ID NO: 81136 - protein, 371 aa, Legionella pneumophila str. Paris
MSFSTSTNLTPIEMQDDDLEKIQSQNNPSAINEVKTNTFVINLQQAIFGLETGSEAVDFDSHKNTGFPFPAGEYKPRHFLTGTELAREEIQFVLSQARSLKQNPGLYNQALANKSLVMIFEKPSFRTRLSFALAIQSMGGIVVESIANSRKQETPADMARVLNGYADFVMVRTHEDSFLQEMAEYSKIPIINGLSALHHPCQTLADLLSLEEQFGALEGLTLTYIGDGNNILHSLMLLAPQLGVTVHYCCPKSNQPNEAIIKEAQSKTGKQMIYCFDKPEEAVKQADAVYTDVWTSMGFDNPEAVKIFKGFQVNETLMSHAKPDSVFMHCMPMERGKEVSATLPDSASSIIFRQSENRMHVQKALMLFLDQ

SEQ ID NO: 81137 - protein, 298 aa, Triticum turgidum subsp. dicoccoides
FSLAPLVPRLSELLGIAVKKAEDVIGPEVEKLVADLENGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADV

SEQ ID NO: 81138 - protein, 535 aa, Bordetella pertussis Tohama I
MMKFDWNNPYPSTRIPVFARNVVATSHPLAAQAGLRILALGGNAADAAVASAATLALVEPASNGLGSDCFALVWDGARLHGLNASGTAPAAWSPGYFQRKHQGAIPLRGWDSVTIPGCVAGWASLHDKLGSLPFADVLAPAIEYAERGFAVPPTVQRRWADQVDPLRSLPGFAEHFLPHGRAPEVGEHFVLAGAAATLRRIAASGGRDFYEGETAQKLVAHAQAHEAALTLGDLRDYAPQWVEPISQAYRGHALHQLPPNGQGLAALIALGIVEHFDLASRPAEHPDTQHILIEAMKLAFADVHAHVADAAHIRIRVEQLLDPAYLAERARLIDLRRARVYNAAQAPQGGTVYLACADRNGMMVSFTQSNYMGFGSGIVVPGTGISLQNRGCCFSMDPDHPNVVGGGKRPFHTGIPAFLTQDGAPLMSFGIMGGNMQPQGHLQALVRMLDYRQQPQAACDAPRWKWNRGLSVDIEAAMPAQVTDALRARGHIVEVAAPADKDFGSGQFIWRLGDPAVDGYVAASDSRRDGLAAGF

SEQ ID NO: 81139 - protein, 726 aa, Guillardia theta
MFFILPKPALRVYKNFKNIVLYDKKNVHNLSKNGKSVQKYYNNIIYLYKNIKVKEKFTNLKIIFFLLLLVDLTIGNSEKIFLDKKKINLSMNDNTIVKNENVKNYDIKNNSNLLFIDITPLNVINDKFYEIIKEMDHHVSRPVKDALILLLATVFVVPLMRKFNTSPILGFLAAGLFLGPNGFGLVHRIGASKTLAEFGVVFFLFEMGLELSLSRLKSLGMDVFGLGYLQWLITGFILAFISLCNNASIEISLVIGFGLALSSSAFVLQLLSERGEVGTRFGRASFGILLFQDLAVVPLLVVVPLLATGGGDFTSLMNALILAAGKAAVALGIIFLGGRTCLEPVFRFGASAKSPEAFVATILVTVLAMSTLTESLGLSDTLGAFLAGVLLAETKYRHQIEADIAPFRGLLLGLFFITVGFGIDISLISGNFLTVITMLITLLVIKASIITTLGFFFGINFASAQRTGLILAQGGEFAFVTFGLAQKSNLMSPQLSQLLFLIVALSMVMTPFLATTGFKIASSIESKRGLMGARKEDIANAKDYVVVAGFGRVGQSVCDLLNARLIRYMAFDMNPARVIEARNKGLPVFFGDACRPEVLKAAGIKNPKAVVVTLDDKDGASKAVNALRREYPSIQIFVRAKDAKHQKMLQLGGATAIVPELLESSLLLGGAVLLSYGTPIEEVNSLIEEARKKTLIDAGLDVTGLTNFSSHNKNDDKKSDNDCNEN

SEQ ID NO: 81140 - protein, 517 aa, Bacillus pumilus SAFR-032
MILSVKDLSHGFGDRAIFHEVSFRLLKGEHVGLIGANGEGKSTFMNIITGKLEPDAGKVEWAKNVRVGYLDQHTVLEKGRTIREVLQDAFHYLFSMEAAMNDIYGKMGEADPDELEKLLEEVGVIQDALTNNDFYIIDSKVEEIARGLGLTDLGLDRDVTELSGGQRTKVLLAKLLLEKPEILLLDEPTNYLDEQHIEWLKRYLQEYENAFILISHDIPFLNSVINLIYHVENQELTRYVGDYDQFKQVYEVKKSQLEAAYKRQQQEVAELKDFVARNKARVSTRNMAMSRQKKLDKMDMIELAAEKPKPEFHFKAARTSGKLIFETKDLVIGYDEPLSRPLNLKMERGQKIALYGANGIGKTTLLRSLLGEISPISGEVERGEFLHIGYFEQEVKEQNSNTCIEEVWSTFPSYTQYEVRAALAKCGLTTKHIESRVSVLSGGEKAKVRLCKLINEETNLLVLDEPTNHLDVDAKEELKRALKEYKGSVLLISHEPEFYQDVATETWNCESWTTKVL

SEQ ID NO: 81141 - protein, 144 aa, Zea mays
MAAYMRVTHRDEEGKKVTEKMPVPETRRPDTAKHFERKLEEQGLHRFERHPANAPRGVGIGAPPPKSGRGGKYTWEGPGSVVEDQLDPAPPAIDPNDPNYEEAEDDEAAREVVVGEVEVAKVAEGRDGVARVDVAPGLLQDQKQ

SEQ ID NO: 81142 - protein, 325 aa, Streptococcus thermophilus CNRZ1066
MEEIMSYTNLKLFALSSNQELAAKVADKIGIELGRSSVREFSDGEIQVNIEESIRGHHVFILQSTSSPVNDNLMEILIMVDALKRASAETINVVMPYYGYARQDRKARSREPITSKLVANMLEVAGVDRLLTVDLHAPQIQGFFDIPVDHLMGAPLIADYFDRAGLTGNDVVVVSPDHGGVTRARKLAQCLKTPIAIIDKRRSVDKMNTSEVMNIIGNVEGKTCILIDDMIDTAGTICHAADALAEAGATNVFASCTHPVLSGPALDNIQKSAIEKLVVLDTIYLPEERLIDKIEQISIADLISEAIIRSHEKRPLSPLFEMGHK

SEQ ID NO: 81143 - protein, 339 aa, Ustilago maydis 521
MAANIPSFTLNTGAKLPSVGMGCWQGQPGPGRDNELVDALVRAIKVGYRHLDTATGYRNEAEVGQAVRQSGVARSEIFVTTKLRPGGVHDVVQELENSLNELGIDYIDLWLLHWPQGFTKDDGGFGTGESFGLEHQKHLGPTFNETWAKMEDVFLNSHKGKVKAIGVSNFSIKNLEILAKTSKVTPAVNQIEAHPYLPEHELVKYCKHKSIHVTAYSPLGQYNASIHEDKDLNEIAKKHDVTAATVALSWAVQRGTSVAPKSTNEKRMKQNITLIKLTDEEMKQVDVISQDPTRSTRLNYFVVNKETGTVLGWTMDEMGWEVGFLEEPGKSTKRIAERK

SEQ ID NO: 81144 - protein, 251 aa, Nicotiana tabacum
MPIHQIAVGSHEELRQSGTLKAALAEFICTLIFVFAGQGSGMAFNKLSADGTATPAGLISASIAHAFGLFVAVSVGANISGGHVNPAVTFGAFVGGNITLFRGILYIVAQLLGSTVACFLLEFATGGMSTGAFALSAGVSVWNAFVFEIVMTFGLVYTVYATAVDPKKGDLGVIAPIAIGFIVGANILAGGAFTGASMNPAVSFGPALVSWTWTHQWVYWAGPLVGGGIAGVVYELIFINHSHEPLPSGDF

SEQ ID NO: 81145 - protein, 394 aa, Streptococcus thermophilus CNRZ1066
MTVMDLTQRFNKNLDKIEVSMIRQFDQSISDVPGIKKLTLGEPDFTTPDHVKEAAKTAIDANQSHYTGMAGLPDLRQAAANFVKEKYNLTYNPDNEILVTIGATEALSASLTAILEPGDTILLPAPAYPGYEPIANLVGAKIVEIDTTANDFVLTPEMLEKAILEQGDKLKAVLLNYPTNPTGVTYSRQQIEDIAEVLKKYDIFVVSDEVYSELTYVDQHVSIAEYLPEQTILINGLSKSHAMTGWRIGFIFAPESLTAQLIKSHQYLVTAAATMAQFAAIEALSAGKDDAQPMKVEYLKRRDYILEKMTELGFKIIKPDGAFYIFAKIPEGYNQDSFKFCQDFAREKAIAIIPGVAFGKYGEGYVRLSYAASMDTIETAMTRLKEFMEEHAEA

SEQ ID NO: 81146 - protein, 241 aa, Bacillus pumilus SAFR-032
MNKFVDELQSMIHHFTFQEKNYLLVGPVNLPISIQHEEVPFKWYAFAPVEGETKPTIESIVKMSTAQQTFSSCLLFGDFENEMPPLVRIHSVCQTGDVFGSLKCDCGPQLALSLKKITDYGKGMLVYMANQEGRSIGLMAKALTYKLQEMQLDTFEANRLIGCGDDDRHYEEAAAVLHYLNKGKPMHLLTNNPDKVDSIAAYGLPVLRFDHTVEASLYNEAYLKAKAASGHMVDEKKLINQ

SEQ ID NO: 81147 - protein, 183 aa, Glycine max
  misc_feature (73)..(73): Xaa can be any naturally occurring amino acid
MSSPSKRREMDLMKLMMSDYKVEMINDGMQEFYVHFHGPNESPYHGGVWKVRVELPDAYPYKSPSIGFINKIXHPNVDEMSGSVCLDVINQTWSPMFDLVNVFEVFLPQLLLYPNPSDPLNGEAAALMMRDRPSYEQRVKVYCEKYAKPEDIGEATEEKSSDEEMSEDEYDSSDEQVVGKADP

SEQ ID NO: 81148 - protein, 368 aa, Xanthomonas campestris pv. campestris str. ATCC 33913
MKTRAAVAWGPHQPLSIEEVDLQPPRPGEVLVRLVATGICHGDAHALAHAPASSFPAILGQEGSGVVEEVGIGVTSVRVGDHVIPLDMPECGVCKFCRSGRTNLCQAIRSSQERGLMPDGSSRFSLDGRPILHHMGTSTFSEYTVLPEIAVARIHPDAPLDQVCLLGCTVTTGVGAVLNSIHVRPGDCVAVFGLGGIGLSVIQGAVLAQAGRIIVVDIAPGKFALARALGATDCLDPRDYGAPIQQVIVDLTDGGADHSFECIGDVGAMRAALECCHKGWGESVILGVADGAQEISTRPFQLVTGRVWRGSAFGGVKGRSELPGYVERYLRGDLQLAPLITRTLALDDINQALADLRAARGIKSIVLY

SEQ ID NO: 81149 - protein, 645 aa, Saccharomyces cerevisiae YJM789
MVEKRSRQSSSSGSQFSVPPDVDNPPLSIPLKTLSDRYQLIEKLGAGSFGCVTLAKAQFPLSNILGKQHDIRGTLMDQPKNGHQNYITKTQGVVAIKTMMTKLHTLQDYTRVKEIKFILAIPANDHLIQIFEVFIDSENYQLHIVMECMEQNLYQMMKHRRRRVFSIPSLKSILSQILAGLKHIHEHNFFHRDLKPENILITPSTQYFEKEYMNQIGYQDNYVIKLADFGLARHVENKNPYTAYVSTRWYRSPEILLRSGYYSKPLDIWAFGCVAVEVTVFRALFPGANEIDQIWKILEVLGTPIKRSDFVNTNHITAPPPGGFWDDASNLVHKLNLKLPYVEGSSLDHLLSSSQLSDLSEVVKKCLRWDPNERATAQELCEMPFFENTVASQVDARGNVTNTEQALIFAGINPVATNTKPIYFNSSTKLPAETESNDIDISNNDHDSHAMCSPTLNQEKLTLVEFLNEFVEEDNDDHSIPDVGTDSTISDSIDETELSKEIRNNLALCQLPDEEVLDHSLSNIRQLTNDIEIINKDEADNMEQLFFDLEIPEKDEFQRKQPFNEHADIDEDIVLPYVNNSNYTHTDRSHHRGDNVLGDASLGDSFNSMPDFTPRNFLIPTLKKSREKFEPHLSNPNQHFGNVTF

SEQ ID NO: 81150 - protein, 376 aa, Bradyrhizobium sp. ORS278
MSTKRCYYETLEVERDADETKLKSAFRKLAMKWHPDKNPGDASSEVKFKEINEAYEVLRDADKRAAYDRYGHAAFEQGAGGGPHGFGAGFASSFSDIFEDLFGMAGQRRGGTGRERGADLRYNMEITLEEAFLGKTAQIEIPVSVTCEPCSGTGAKAGTKPKTCAMCGGAGRVRQAQGFFTLERTCPGCHGRGQMIEDPCPSCSGSGRVTRDRTLSVNIPQGVEDGTRIRLAGEGEAGLRGGPPGDLYIFLSLTPHEFFQRDGADLHCRVPISMVTAALGGEFEVPTIDNGKTKVKIPAGAQSGRRFRIAAKGMPVLRSRQTGDMYVQIVVETPQNLTKKQQELLAEFEKLSSGATQPEAAGFFTKVKDFFGKAAS

SEQ ID NO: 81151 - protein, 443 aa, Hyphomonas neptunium ATCC 15444
MAINITMPALSPTMEEGTLAKWLVKEGDTVKSGDIIAEIETDKATMEVEAVDEGTVAKIVVAEGSEGVKVNAVIAVLAEDGEDASSVKTPSADAAPKKEEKKEDAPKAGEKKPDEKKPEPKKEEAKPEPAKAAAPAKSDDGARLKASPLAKRIAANKGIDLKALKGSGPHGRIIKRDVESAKPGAQAATAGAAAPASPDGLILPQILDDRVYAPDTYELKPLDGMRKTVARRLTQSFMQVPHFPLNIDITLDNLLTSRASINNAAREGVKVSVNDLLIKAAALALMDEPDCNASFTDKGIAYHKHANVSVAVAVEGGLITPVIFKAETKGLAEISEEMKDLAARARERKLKPQEYMGGTFSISNLGMFGIKSFASIINPPEGMILSVGAGEKRAVVDEKGNVAVRTIMSVTLTCDHRVIGGAEGAKWLTAFKRYVETPEAMLL

SEQ ID NO: 81152 - protein, 365 aa, Mesembryanthemum crystallinum
MTTYTNGNYTQPKTLDKDEQLAGLAVTLANAAAFPMILKSAFELKILDIFSKAGEGVFVSTSEIASQIGAKNPNAPVLLDRMLRLLASHSVLTCKLQKGEGGSQRVYGPAPLCNYLASNDGQGSLGPLLVLHHDKVMMESWFHLNDYILEGGVPFKRAHGMIQFDYTGTDERFNHVFNQGMAHHTILVMKKLLDNYNGFNDVKVLVDVGGNIGVNVSMIVAKHTHIKGINYDLPHVIADAPSYPGVEHVGGNMFESIPQADAIFMKWVLHDWSDEHCVKILNKCYESLAKGGKIILVESLIPVIPEDNLESHMVFSLDCHTLVHNQGGKERSKEDFEALASKTGFSTVDVICCAYDTWVMELYKK

SEQ ID NO: 81153 - protein, 383 aa, Carboxydothermus hydrogenoformans Z-2901
MPTIYFDNSATTYPKPPEVLEAMIYFAEKVGANPGRGSHQRALKASQIILEAREAVKKLINGVSADRVIFTANATESLNLALKGLLQAGDHVIASPFEHNAVQRPLNRLRREGVEVSYLSSSPAGEIDPDEIKKLLKPNTRAVVVTHASNVLGCITPVAEVGKICREAGVALIVDAAQSLGTIPVDVQSYNISLLAFTGHKGLYGPQGTGGLYIAPEWEKVLKTLKEGGTGGHSEEELPPEILPDKYESGTLNTIGIAGLKAGVEFVLKIGVEKIFQHEKKLTRKLYQGLKELGAEILGPDPENDRAPLVSFNFPGADAATVSFMLDKLYDIATRPGLHCAPKAHEVAGTLDRGAVRASFSYFNTEEEVEEFLEAIKEIKDEL

SEQ ID NO: 81154 - protein, 770 aa, Zea mays
MAGQERRTIDLEEGWAFMQKGITKLKNILEGKPEPQFSSEDYMMLYTTIYNMCTQKPPHDYSQQLYDKYRESFEEYITSMISYSERSKAAWMGVFLAFVDGEQIVLSEPGAHMSTSNLVLPSLREKHDEFMLRELVQRWSNHKVMVRWLSRFFHYLDRYFISRRSLTPLKEVGLTCFRELIYQEIKGQVKDAVIALIDKEREGEQIDRGLLKNVLDIFVEIGLGQMECYENDFEDFLLKDTTEYYSVKAQSWILEDSCPDYMIKAEECLKREKERVGHYLHISSEQKLLEKVQNELLAQYATPLLEKEHSGCSALLRDDKVEDLSRMYRLFSKISRGLEPISNMFKTHVTNEGTALVKQAEDSASNKKVFVWKIIELHDKYVAYVTECFQGHTLFHKALKEAFEVFCNKGVSGSSSAELLATFCDNILKKGCSEKLSDEAIEDALEKVVRMLAYISDKDLFAEFYRKKLARRLLFDKSANDEHERSILTKLKQQCGGQFTSKMEGMVTDLTVARDHQTKFEEFVAGHPELNPGIDLAVTVLTTGFWPSYKTFDINLPAEMVKCVEVFKEFYQTRTKHRKLTWIYSLGTCNINAKFDAKPIELIVTTYQAALLLLFNGSDRLSYSEIVTQLNLSDDDVVRLLHSLSCAKYKILNKEPASRSISPNDVFEFNSKFTDRMRRIKVPLPPVDEKKKVVEDVDKDRRYAIDASIVRIMKSRKVMGHQQLVAECVEQLSRMFKPDFKAIKKRIEDLITRDYLERDKDNANTYKYLA

SEQ ID NO: 81155 - protein, 514 aa, Nocardia farcinica IFM 10152
MTNHAERYGNSALDAARRTRELHQLGDLGTVDVLVVGGGVTGAGAALDAASRGLRTVLVERHDLAWGTSRWSSKLVHGGLRYLAGGRVGIARESAIERGILLGTVAPHLVRPLPQLVPLLPGIGRAQQALIRAGFLAGDALRRSAGTPAATLPRARRVAAAEALRLAPTVRRAGLRGGLQAWDGQLVDDARLVVALARTAAAHGALVLTRVSAEAITGDSAVLRDTLTDETLTVSAKAVINATGVWADQLDPSISLRPSRGTHLVFAAEAFAGLSASLTVPVPGSVGRFVFAFPAAHNRVYLGLTDEDAPGPVPDEPQPTDAEVDFLLDTVNPALREPLTRADIRGRYAGLRPLLRTGDGNTADISREHAVLHSPSGVFTIVGGKLTTYRRMAQDVVDAAVRAYRLPAGPCRTHTLPLVGAVAGAARDRIAAPPLLVDRYGSEAPQILALGERDPALREPVGPGLDVTAAEFAFARSHEAALTPDDLLDRRTRIGLVAADRAAALAAATAAFEG

SEQ ID NO: 81156 - protein, 1164 aa, Physcomitrella patens subsp. patens
MCNQDGNARNDEEEEEDKEDEEVGLFLVRELRVLGISYLNGVDSWNWSSLGTDVEGGLRQGRKQSLGGLRTSSHASCGTASRMVTRIGAENRCDIEHMIHTKRLVGAVDPNPIVSANGAGRSHLVEAISFVLGVRSFQLRGVVQRAGLDDREFGESRGKIAFVKLVYRTASGEEIKFGRAITGSGTSEYRINNIPVTWEIYNNTMKGLDILGEVDSDGSREFKEPGSEPQPASVPDELKKIHVELEIEKARSEEKIPAHQKRKMFAAERKQKKEQKESEAEKQLRHQKELDERAAEVRMEMEWLASAGSERANSDFEALGLEYESLREQGKWIEEEALKVKAARKAAIEASDLWKASNRPRVGCNGRECQQCSICRGLTMRASLLTQFYSEGCSRPASPMPMSKEDDAASDASSATKAADFTSSKSRPNDVKNAKGRNEMMGLPVVSISSKGTYNDHRIEELNREYRELVEYQSQNRDGNGAEASLELENKHNESGYSGLEAEEKVGHGRPAHAEGSTWADGSARDAQASQRLKDYDGQMWGCEAEEDEMDPDKDSLSKAEILAEELYRDAMELHDRLVAEAEINAGVGICGVDGKGHSWIAETKETCGAIMYANNHAQNGRCGTMGEDSGLNSAGSSESRSLSFSQTSQSSDLAKGESRNGGDHAMASMVEFKGGENGGSPRSALEKEMARLRGSNMRKQLKIDSLQKWKAYYKLELEDRERKLRQIEERYRRELKKREKAVQKVVKAHAKDIAVRESKQEGMEEKLRGEIKELNRVVEELSEQLYEMEEHLASRGIPYKPSVNESTGPSSKTLLSAVIGVKEAAHTFSRTFMSHLKQHLTKARDLDEQICLESEVIVARPSDYKFLVQSFILRRMFLDFDSECFNIESCMTEIFDIEEHSKSCFQEYLKYRTVSETVTLLTDNRAHSGFLREFCFKKFLHIVSESTEEAFFGDFNHSDEICAGRHPSSRFYESYLKLAVSVWLLHRLAFSFQPPARMLSVRKGSQFNPTYMESAVPGISNGEIVVEGEGGALPFEALVGLMVHPECGLAKQVQNHEPPNQLYDKRQALNMQSGIASCLLDERTCVVGAKHLALAFLWTKHGVPKCFSGCTRWMRSSLHRSDLAYRSVMRQVGDSQVVSFGGFQGAAICHTALRFITANPTRS

SEQ ID NO: 81157 - protein, 220 aa, Triticum aestivum
MAASPATSSSAARATSFARLSNAPLRAPRAGAVSFPSPNSARPAHEVADARASRLPVVAAAAAGHQRLMGSLTNTEGLRFAVVVARFNEIVTNLLLQGALEAFERYSIKAENVTVVSVPGSFEIPVAAQKLGKSGKYDAILCIGAVIRGDTTHYDAVANSAASGVLNAGLSAGVPCVFGVLTCDDMDQALNRAGGKAGNKGAETAITAIEMASLFRHHLA

SEQ ID NO: 81158 - protein, 2056 aa, Physcomitrella patens subsp. patens
MLERMAHRGACGCEENTGDGAGILVGIPHSYFSQVVPEEIGCELPPLGDYAVGMMFLPTSEIRREHAKKVFTEVAEALGHTVLGWRRVQTDNSDLGKSAIQTEPLIEQVFLTASTLSKVDFETQMYILRKTSMLAIRAVLNLKRGAAKDFYICSLSSKTVVYKGQLKPNQLTKYYYADLGDERFTSFMAIVHSRFSTNTFPSWDRAQPMRMLGHNGEINTLRGNVNWMHAREGLFKCKNLGLSPEELKKLLPIVDAGSSDSGVFDGVLELLVRAGRSLPEAVMMMIPEAWQNDPNMDPERRALYEYFSCIIEPWDGPALVTFTDGKYLGATLDRNGLRPGRFYVTHDGRVIMASEVGVVDVEPENVAQKGRLHPGTMLLVDFENHKVVDGDDLKKQQSSRYPYAEWLERQKFTLEDVVNSVPEKLRAPPAIIGDKNMASLNFSADNMGVKGLLTPLKAFGYTMENLEMLLLPMAKDGSEALGSMGNDAPLAMMSNRPKLLFEYFKQMFAQVTNPPIDPIREAVVTSTRCMVGPEHDLTEKVEEQCNRLSLSGPLLTVEEMESVKKMEYRGWKTMVVDITFDKSEGPAGLENALTRICAEARNAVAEGYSMLVLSDRATSAQRVPVSSLLATGAVHHHLVQSMERTRIGLVVESAEPREVHHFCTLVGFGADAICPYLAIETIFRVQVDGKIPMKVSKDDLVKKYFYASNSGMLKVLAKMGISTLASYKGAQIFEALGLSSEVVSRCFKGTPSRVEGATFEMLAKDSLRLHEMAFPAREAPEGSADANALPNPGDYSWRKGGEVHLNDPMAMAKLQEAARTNSVDAYKEFSKLTHELNKKINVRGMLKFKEQPESARIPLEEVEPAAEIVKRFCTGAMSYGSISLEAHSTLAIAMNKLGGKSNTGEGGENPKRLEPLQDGSQNPQRSAIKQIASGRFGVTSYYLTNADELQIKMAQGAKPGEGGELPGHKVIGDIAITRNSTPGVGLISPPPHHDIYSIEDLSQLIHDLKNANPDARVSVKLVSEAGVGVVASGVVKGHADHVLISGHDGGTGASRWTGIKNAGLPWELGLAETHQTLVANDLRGRTILQTDGQLKTGRDIMVAALLGAEEFGFATAPLITMGCIMMRKCHKNTCPVGIATQDPVLRAKFAGQPEHVINYFFMVAEEAREYMANLGIRKMDDLVGRADLLEVDEEVIAQNEKLTNIDLSLLLRPAADIRPGAAQRCVMKQDHELELALDQKLINLSRAALESKLPVYIETPVVNVNRAVGTMLSHEVTKRYKLEGLPIDTIYVKLNGSAGQSLGAFMCKGITMELEGDSNDYVGKGLCGGKIIVYPPRSSTFDPKENILIGNVALYGATSGEAYFNGMAAERFAVRNSGAKAVVEGVGDHGCEYMTGGTVVVLGKTGKNFAAGMSGGVAYVLDKEGTFKSTCNMGLVDLDPVVENEDVMTLKALIQQHQRHTKSQLAGEILANFDALLPSFIKVFPRDYKRVLQEIKAKEAAEQLKETPAVTVEVVTTVANGAPSGKASVTEEAAPSTIRPTQVLSPVKHGGFVKYERKPLPYRPADERMKDWGEVLASDNQDGLVKTQAARCMDCGTPFCNQDKTGCPLGNKIPEWNELVYQNRWREALDRLLETNNFPEFTGRVCPAPCEGACVLGIIENPVSIKTMECTIIDKGFENGWMVPRPPLKRTGKKVAIVGSGPAGLAAADELNKKGHSVTVFERADRIGGLMMYGVPNMKTDKVQVVQRRVDLMEAEGVQFVTNAHVGVDPVYSVEKLRSDYDALLLTTGATKPRDLPVEGRDLAGVHFAMEFLHKNTKSLLDSNLEDGQYISAKGKKVVVIGGGDTGTDCIGTSVRHGCTRVVNLELLPQPPQTRAANNPWPQWPRVFRVDYGHEEAATKFGKDPRSYEVLTKRFIGNDKGEVTGMETVRVKWDKSADGRFQMSEIPGSNEIIETDLVLLAMGFLGPEQLISEKLGLETDARSNFKADYGKHATNLQGVFAAGDCRRGQSLVVWAIAEGREAAVQVDNYLMVEESSEEQLPSGEEIREFTTTTSVQ

SEQ ID NO: 81159 - protein, 458 aa, Neptuniibacter caesariensis
MSSGTIVQIIGAVVDVEFPRDSVPKVYDALTVTKNGLTLEVQQQLGDGVVRAIAMGQTEGVSRGQDVANTGAPVSVPVGTATLGRIMDVLGNPIDECGEIGEEERMPIHRKAPSYDEQAASNELLETGIKVIDLVCPFAKGGKVGLFGGAGVGKTVNMMELIRNIAIEHSGFSVFAGVGERTREGNDFYYEMKESNVLDKVSLVYGQMNEPPGNRLRVALTGLTMAEKFRDEGRDVLLFVDNIYRYTLAGTEVSALLGRMPSAVGYQPTLAEEMGVLQERITSTKTGSITSIQAVYVPADDLTDPSPATTFSHLDATVVLSRQIAELGIYPAVDPLDSTSRQLDPLVIGTEHYEIARNVQGVLQRYKELKDIIAILGMDELSEEDKSLVARARKIQRFLSQPFFVAEVFTGAPGKYVPLKETISGFKGILEGQYDDLPEQAFYMVGGIDEAIEKAKGM

SEQ ID NO: 81160 - protein, 255 aa, Bacillus thuringiensis serovar konkukian
MNDYIVVKCGGSMLDQLNDVFFDCIKKLQQQYKVVIVHGGGPEIDAKLKDCNINVEKRDGLRVTPKEVMDVVQMVLCGSTNKKFVMNLQKHNLLAVGCSGCDGKLLQVQPVSEEIGYVGEVSYVETALLKGLINMNYIPVIAPIGIHDNEIYNINADTAAAGIAAALSAKELILITDVDGILHEGKLVKKTDESEIATFIEKGVITGGMIPKVQAALASLKMGVQKISIVNGTKDFTEDTGECIGTTVTRGVSIV

SEQ ID NO: 81161 - protein, 487 aa, Salmonella enterica subsp. enterica serovar Dublin
MKKINHWINGQNVAGDDYFQTTNPATGDVLAEVASGGEAKLNQAVAAAKEAFPKWANLPMKKRARLMRRLGDLIDQNVPEIAAMETADTGLPIHQTKNVLIPRASHKFEFFAEVCQQMNGKTYPVDDKMLNYTLVQPVGVCALVSPWNVPFMTATWKVAPCLALGNTAVLKMSELSPLTADRLGELALEAGIPAGVLNVVQGYGATAGDALVRHHDVRGVSFTGGTATGRNIMKNAGLKKYSMELGGNSPVLIFEDAEIERALEAALFTIFLINGERCTAGLSIFIQQSIYPEFVKRFAERANRLRVGDPTDPNTQVGALISQQHWEKVSGYIRLGIEEGATLLAGGAEKPTDLPAHLKGGNFLRPTVLADVDNRMRVQEEIFGPVACLLPFKDEAEGLRLANDVEYGLASYIWTQDVSKVLRLARAIEAGMVFVNTQNVRDLRQPFGGVKASGTGREGGEYSFEVFAEMKNVCISMGDHPIPKWGV

SEQ ID NO: 81162 - protein, 514 aa, Legionella pneumophila str. Paris
MSHNAPLVLMILDGWGYNENDRYNAIAKANTPQWDEWWQTCPHILLKASGLPVGLPDEQMGNSEVGHMHIGAGRVIQQDFTRINEAINNGKFAKNAVFHEVIDQLKKTEKSLHIMGLLSPGGVHSHEQHLFALLALCNQKKFRSVHLHLFLDGRDTPPQSALDSLKCLNEELAKHPVATINSICGRYYAMDRDKRWERVEPVYNLLTQGKSERQFPDAETAIHFYYKNKISDEFVPPTLIGKEHSIQDGDAVLFFNFRADRARQLTSTFLDPLFKGFERKTLPKLSCFVSMTQYDKNLFTTTAFPPVPLNNTLGEVLSSHGLSQLRIAETEKYAHVTFFFNGGCESVFTNEERIMVPSPQVATYDLQPEMSAHELTKTLIAAINSRDYHVIICNYANADMVGHTGNFEATVQAIECLDQCMQQVWQALKNNGGKLLITADHGNAEEMFSEATNQAHTAHTSEPVPFLYVGGGWHFTHSEGSLIDIAPSLLALLGITPPPEMTGRILLEKNHAHA

SEQ ID NO: 81163 - protein, 139 aa, Nocardia farcinica IFM 10152
MTEQTLVLIKPDGVSRGLVGEVLARIERKGLKIAALELKQVSDELAREHYAEHADKPFFGSLIEFITSGPVVAAVLEGPRAIAAFRQLAGGTDPVEKAAPGSIRGDFGLETQYNLVHGSDSPESAKREIGLWFPEFPVA

SEQ ID NO: 81164 - protein, 254 aa, Coprinopsis cinerea okayama7#130
MADWDASSDEEVKAKSVPAPKPIVPVRVAKKWEGEDEDDKPASDWEDSSSEEEEVKPAVVAPPKKKGTLKAKLAEKEAMKAQKAANGEFDYDSDDVLDPREKARRDKEKELKADLNNAADLLGAAALGGTSSSELDSIISAQPRTKEDFQKLSTQIYEYIIKRHSTKPLYASFVEHLAREMAQPLKDVEVRKVASGLTTLANEKQKEQRDRASGKKKKASAKPALGGAKSAKSVDTTVYDEALDDFGNDPNDFM

SEQ ID NO: 81165 - protein, 405 aa, Hyphomicrobium methylovorum
MTVTPHLFIPGPTNIPDAVRMAMNIPMEDMRSPEFPKFTLPLFEDLKKAFKMKDGRVFIFPSSGTGAWESAVENTLATGDKVLMSRFGQFSLLWVDMCERLGLKVEVCDEEWGTGVPVEKYADILAKDKNHEIKAVFVTHNETATGVSSDVAGVRKALDAAKHPALLMVDGVSSVGSLDMRMGEWGVDCCVSGSQKGFMLPTGLGILAVSQKALDINKSKNGRMNRCFFSFEDMIKTNDQGFFPYTPATQLLRGLRTSLDLLFAEGLDNVFARHTRLASGVRAAVDAWGLKLCAKEPKWYSDTVSAILVPEGIDSNAITKTAYYRYNTSFGLGLNKVAGKVFRIGHLGMLDEVMIGGALFAAEMALKDNGVNLKLGSGTGAAAEYFSKNATKSATALTPKQAKAA

SEQ ID NO: 81166 - protein, 298 aa, Aegilops speltoides subsp. speltoides
FSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVAASAIPDGWMGLDIGPDSVKTFNDALDTTQTIIWNGPMGVFEFDKFAVGTESIAKKLAELSKKGVTTIIGGGDSVAAVEKVGVADV

SEQ ID NO: 81167 - protein, 393 aa, Arabidopsis thaliana
MSCFKSKFAGKSYFRRTFHSSIIQFHPQLSILIWHRRYSIIRTYELIANAAYIGTPGKGILAADESTGTIGKRFVSINVENVESNRRALRELLFTTPGALQYISGIILFEETLYQKTASGKLFVDVMKEAGVLPGIKVDKGTVELAGTNGETTTTGLDGLGDRCKKYYEAGARFAKWRAVLKIGNNEPSELAIHENAYGLARYAVICQENGLVPIVEPEILVDGSHDIEKCAYVTERVLAACYKALSDHHVILEGTLLKPNMVTPGSDSGSKVKPEVIAKHTVRALQRTVPAAVPAVVFLSGGQSEEEATVNLNAINQLKGKKPWSLTFSYGRALQQSTLKAWGGKEENVDKAQKAFLARAKANSEATLGGYKGDAQLGEGASESLHVKDYKY

SEQ ID NO: 81168 - protein, 115 aa, Nicotiana tabacum
MGVPSGLILCVLIGAFFISMAAAGDSGAYDWVMPARSGGGCKGSIGECIAEEEEFELDSESNRRILATKKYISYGALQKNSVPCSRRGASYYNCKPGAQANPYSRGCSAITRCRS

SEQ ID NO: 81169 - protein, 736 aa, Oryza sativa Japonica Group
MKLRLRSMDQRVGAGGAAETHRVQLPDTATLSDVKAFLATKLSAAQPVPAESPQPQAQPLPRNPNPDVPSIAGAADPTKSPVESGSSSSMPQALCTNPGLPVASDPHHPPPDVVMAEAFAVIKSKSSLVVGDTKREMENVGGADGTVICRLVVALHAALLDAGFLYANPVGSCLQLPQNWASGSFVPVSMKYTLPELVEALPVVEEGMVAVLNYSLMGNFMMVYGHVPGATSGVRRLCLELPELAPLLYLDSDEVSTAEEREIHELWRVLKDEMCLPLMISLCQLNNLSLPPCLMALPGDVKAKVLEFVPGVDLARVQCTCKELRDLAADDNLWKKKCEMEFNTQGESSQVGRNWKESFYETMTTVCFCFDQAFSARTFGCAHKPVTQPGRWLIILVYHSLLCQYITIGLSLLWYHLVDLVQDAPAAGIHFDCIIPLPINPYQLPPSAGACCSTTQASASAKDGGNMYSPPCSAAASSQGHCFAVGANQLASLDLAMDFDEPILFPVHNASLQEGIQFYNPTGDTQLSRNMSIDKCLKGSKRKGSGEGSSSLHSQEETGEMPQRELSMEHAGEKAGDADASREEYVHVRAKRGQATNSHSLAERFRREKINERMKLLQDLVPGCNKITGKAMMLDEIINYVQSLQRQVEFLSMKLSTISPELNSDLDLQDILCSQDARSAFLGCSPQLSNAHPNLYRAAQQCLSPPGLYGSVCVPNPADVHLARAGHLASFPQVYI

SEQ ID NO: 81170 - protein, 378 aa, Hyphomonas neptunium ATCC 15444
MTETVAIIVAGGRGQRAGAERPKQWQMLLGKRVIDWSIAAFVDHPQISQVVIVAGDELGDCSAEPKIIQAKPGNTRTQSVLSGLAAATISEDATVVIHDAARPGIDAATISSLIARLQDPSVSGAAPAMPVADALKTNSGQSWTNVDRTGLVRVQTPQAFRLGEIRAALSAAGPDLVDDLTAIEAAGGRVEIVSGSARLTKITYPEDFDMLARLLSPTGAPRIGKGYDVHEFEAGDHVTLCGVAIPHIAKLKGHSDADAAWHALTDAILGAVALGDIGDHFPPSDPQWKGADSGLFLKEAQRLAEAKGYVIANCDITVICEAPKVKPHREAMRARTAELLGLPLDAVSVKATTTEGLGFTGRREGIAAEAVALLMPKG

SEQ ID NO: 81171 - protein, 303 aa, Carboxydothermus hydrogenoformans Z-2901
MNKSYLYLGITVVLFSTYEVVGRALAGLVNPFQLNFLRFFFGGFVLLPVALSNIKRKNVKLTGSDFLFAFLIGLLNVVLSMSFLQIGINMTKASLAAAIFSSNPLFVVLFAYLILDEKLNFQKILGLFIGIVGVVIVFYKDLELGISHVYGILMLILAAVTYGLYTVLGKRFSQKTDSVIMNSFSFILGSVFLLPIILLKHYPLFSLQPKAILPMAYLTFFVTGLAYYTYFLGLTNISAGNGSMVFFIKPVLASFFAWAILGEKITFEFIAGTMVILLGIYIVQWAGQVNDGATCEKLRTLEK

SEQ ID NO: 81172 - protein, 260 aa, Zea mays
ASASDRTGTAPIHPSPSSSPVQRNPSHERRLQEALPGRQVPRPLRFSPLTNFGRKTLPTAYLSYHKQGSHHAASGWGAIAAAVPAAAYMLQDQEAHAAEMERTFIAIKPDGVQRGLISEIMSRFERKGYKLVAIKLIVPSKEFAEKHYHDLKERPFFSGLCDFLSSGPWVVYFFSSGPVLAMVWEGEGVIKYGRKLIGATDPQKSEPGTIRGDLAIVVGRNIIHGSDGPETAKDEIALWFEPKELVSYTSNAEKWIYGVN

SEQ ID NO: 81173 - protein, 275 aa, Zea mays
  misc_feature (166)..(166): Xaa can be any naturally occurring amino acid
MEGKEEDVRLGANKFSERQPIGTAAPLFEPGELKSWSFYRAGIAEFVATFLFLYITVLTVMGVSKSTSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGXLGAEIVGTFILVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 81174 - protein, 444 aa, Nocardia farcinica IFM 10152
MSGTDPTYISSMEHFESMSHEEIHAKTREIDAGEILRASGVWLEAAATLASAMPLTRAAADRVMNSMEWEGAAAEAAYASTRSFAASVEELSAVMGEVGARLGAVAAAAETVKLAVVPPGDSGPVGAIARLLEAAKVIDAQMMQEALRQEAVLAMNMVYKPAYSGAGTGVPALPDPPGTMTVPDAGDALPQPGSTPGGDYSSPGAAPEPDGAEPPLVPEGSTPPETASPEAGSAAPAPDGTPGSPSPESGTPAPSPTEEVPAPDGATPTPEAPAPPSADPAPPVPPDPSPPATEAPTPDPAPESPGPAPEPAPSTPDAPPSTETPVPPRAEVPSPPPAPETPPAPEPAPQPAPEPAPEPEPESAPEPAPAPEPAPEPEPAPAPEPAPEPEPAPPQEVPPPAPDPRAPLPDPGGQPGVTGPIPEGEQGAAHQSGTDQPGVIPTRT

SEQ ID NO: 81175 - protein, 717 aa, Arabidopsis thaliana
MASSAFAFPSYIITKGGLSTDSCKSTSLSSSRSLVTDLPSPCLKPNNNSHSNRRAKVCASLAEKGEYYSNRPPTPLLDTINYPIHMKNLSVKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKNNNVVAVIGDGAMTAGQAYEAMNNAGYLDSDMIVILNDNKQVSLPTATLDGPSPPVGALSSALSRLQSNPALRELREVAKGMTKQIGGPMHQLAAKVDVYARGMISGTGSSLFEELGLYYIGPVDGHNIDDLVAILKEVKSTRTTGPVLIHVVTEKGRGYPYAERADDKYHGVVKFDPATGRQFKTTNETQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEADLFNMVATAVAIDDRPSCFRYPRGNGIGVALPPGNKGVPIEIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALF

SEQ ID NO: 81176 - protein, 425 aa, Zea mays
  misc_feature (244)..(244): Xaa can be any naturally occurring amino acid
MASLFGNGGYIYSSGSEGEDEDEGTEGYRKGGYHAARPGDRFAGGRFVAQRKIGWGNFSTVWLAYDTLHSRFVALKIQKSARDYAHAALHEIELLSAVAKGDPTNSKCVLRLLDHFKHAGPNGQHVCLVTEFLGDSLLRLIRYNRNKGIGLSRVKEICRSVMVGLDYLHSELGIIHTDLKPENVLLESTINPAKDPVRSGFTPILDRPVGNQYGGTVISFSEKMLKMRARRAVAKISQRRVSLXGGLGQNRRKERCLDGISLKCKIVDFGNACWADQQHAGEIQARQYRAPEVIIGSGYSYSADIWSFACIAFELATGDLLFAPMNRQGCSEDEDHLALMMETLGKMPRKIASSGTRSKDYFDRYGDLKRVRRLKFWPLDRVLVERYSFSEPDAKGFADFLRPMLDFAPEDRPSAAQCLKHSWLN

SEQ ID NO: 81177 - protein, 521 aa, Gibberella zeae PH-1
MSKSDVSRPHGHMTSDEEKHAGSGASRDSFQAAETVPISNDLHRTLTPREIHIISLGSSVGSGLFIATGKALANGGPGTMFIAYLIVCSGVWANLQTLGEMTIAFPVSGNYIDYAARWVDPALAFGAGFAEWLGWTAVFAAEAEFFVVLVNYWAQGSVPHGALLTIFLAISLVVFLLPNKAFAWLQCFGSLVKVALFVFVVIFSIVLFAGAGPERSHEWGASWHNGLAFQNGFGGFASCALLAIWAVGDQVFVGVMVGEAASPRYSMGHASTLVPIRVGVMYMTCVVLIGLLISSDNPDLLGASGSAASPFVIAAKGIKVIPDLINACIIIGIVAIALESIYLPSRILRTMALQGLIPGKFAECDERGRPRWALALTAVVAVVMSYMSLNAGGTEALNWFVSITSASFFSNWAIIAFTSFFFHRALKAQGDEIFSGRYAWRSFAWPSSPAYLMMGGGGFTAYNFFQNIIGYKVIMRTKWQSAKTADLQTGRNELRQDEIEFLDQYYSRPWWKRLGTYLSLY

SEQ ID NO: 81178 - protein, 349 aa, Cryptomeria japonica
LRDHDASQHLFQVSSGLDSLVLGEGQILAQVKQVHKVGQGVVGFGRNIGGLFKHAITAGKRVRSETSIAAGAVSVSSAAVELAVMKLPKDGIFSARMLVIGAGKMGKLVIKHLIAKGSKRIVVVNRSEERVSLLQEELTGAELIYQPLTEMLSNAAEADVVFTSTASETPLFLKEHVENLPPVASNVGGIRLFIDISVPRNVGPCVSEVNLARVYNVDDLKEVVEANKEVRQKKALEAQMIIDEELRQFDAWRDSLETVPTIKKLRAYAERIRMAELEKCLSKLGDDVSKKNRKLVDDLSRGIVNKLLHGPMQHLRCDGSDSRTLSETLENMHALERMFNLETEISVLE

SEQ ID NO: 81179 - protein, 133 aa, Arabidopsis thaliana
  misc_feature (29)..(29): Xaa can be any naturally occurring amino acid
MAPTVMASSATSGAPFQGLKSTAGLPVSXRSNSAGLGSVSNGGRISCMQVWPIEGIKKFETLSYLPPLTVEDLLKQIEYLLRSKWVPCLEFSKVGFVYRENHRSPGYYDGRYWTMWKLPMFGCTDATQVLKEL

SEQ ID NO: 81180 - protein, 691 aa, Ustilago maydis 521
MSSDPVGAAIALAGIPDEPSSLHSKALRPSINLSHRGSLESKPSSDSILLPEEHEDEEDFVVFEDRNTLPAPKLADGDFDELEATSSRNDVEKRSTLGSIARASVESLSFGYRDHLLPLTLSGDGDESLGGDYGEREGSVSATARGSRSTLGSTSSSRRRRHNRGYSRDRLAERRVTLIDGIALTIGVQIGSGIFSSPGVVTLNTGSIGASIVVWLLSGLLAWTGASSFAELGASIPLNGGSQAYLNYSFGPLSAFLYTWSALTALKPGAGAIIATIFGEYVARIIFHATGKVADHPHETGLDGIPAWSIKLLAVAIVALITAAHAFSNKLGTRTQIATTVVKLLALTAVPILAIVQAARGKTSPSSQQAFSSLSAMFAGSSTSPSSYALALYSGLWAFDGWDQSCFVAGEMKRVEKDLPRVIHMSLATVILIFLSAVVSYFVVLPAELVKRTNTVALDFGSAIFGTVGGIVFAVLVAFSCFGALNGQIYTTARLILAASREGYLPERLGDLNRQTGTPIAALLLQLVLISAFVLFGSGFASLVNFYGVCSWTFYLASVLGLLVLRIKEPNLNRPYRTWLGTPILFAAVALFLLLMPIGSAPLEGLAALLFIGAGVPVYYLTQSRSGWVSNVPLLSRLKAWFARARGAGGVHDARGHHVVLPTTDAAAGETEQEDEEQIEMLPKKGTDHKA

SEQ ID NO: 81181 - protein, 332 aa, Saccharomyces cerevisiae YJM789
MIRIAINGFGRIGRLVLRLALQRKDIEVVAVNDPFISNDYAAYMVKYDSTHGRYKGTVSHDDKHIIIDGVKIATYQERDPANLPWGSLKIDVAVDSTGVFKELDTAQKHIDAGAKKVVITAPSSSAPMFVVGVNHTKYTPDKKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLAKEATYDQIKKAVKAAAEGPMKGVLGYTEDAVVSSDFLGDTHASIFDASAGIQLSPKFVKLISWYDNEYGYSARVVDLIEYVAKA

SEQ ID NO: 81182 - protein, 298 aa, Escherichia coli CFT073
MTRIACVGITVQDRIYSLPTLPEGGGKYQANHYLEIGGGPAATAAVAIAKLGVEVDFIGRIGDDSCGNTLLAELEGWGVNTAFCRRYPNARSSQSAILVDQHGERIIVNYPSPDLGTDAEWLEAIDFSRYDLILADVRWHSGTEKAFSLARLAGVTTLLDADMTPQDISPLVALADHAVFSTPGLKRMTGLQSPEEGLFQATTQTAGKVYVTLGSEGSLWIEDGHLCQQEAFSVNVVDTTGAGDVFHGALAVALAEKMPTKEAIRFASAVAAMKCTQPGGRAGIPNREQTESFLSLYA

SEQ ID NO: 81183 - protein, 292 aa, Triticum aestivum
GPKRNSPPPIPGAGPELPGPTRPATGSKTLWMGNLSFNIEYDQVKQFFAQIGEVVDVRLATHEDGHPKGFGHVEFATAEDAQKALDSLNGGDLMGRPVRLDMAAERGATPRTRDGGSFGKPSGGPSLSVFVKGFDSSQQEDAIRSSLQEHFSKCGEITRVSVPMDYENGASKGIAYMDFTDESSFSKALELSGSDLGGCNLYVAEAKPKGQFGGVGGRSGGRDGGRSGGGRFGRSGGRDGGGRFGRSGGRDGGGRFGRSGGRDGGRGGGRGFQSRQSAGTASAGKKTTFGDD

SEQ ID NO: 81184 - protein, 227 aa, Bradyrhizobium sp. ORS278
MPDSTVATSSSPSALAAVEQEIQRACSDAKRDRSAVTLIAVSKTFAADAIEPVILAGQRVFGENRVQEAKGKWPVMMAAHPGLSLHLIGPLQSNKAKEAVALFHAIHSVDRPSLCSALAKEIGAQGRHPQLFVQINTGEEPQKAGIAPGDADAFIAACRRDYGLEISGLMCIPPVDEAPGPHFALTAKIAARNGLANLSMGMSADFAAAIQFGATHVRVGSAIFGHR

SEQ ID NO: 81185 - protein, 729 aa, Escherichia coli CFT073
MLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLVEGAMAILRQAINGDLDWKAKRQPKLEPLKLSKIEAAMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDVVVEAVVENPKVKKAVLAETEQKVRPDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFNANRFGQKNGLGFWRYKEDSKGKPKKEEDVVVDDLLAKVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 81186 - protein, 421 aa, Erwinia carotovora subsp. atroseptica SCRI1043
MKNSELNQRRLAATPRGVGVMCDFYAERAENSTLWDVEGREFIDFAAGIAVLNTGHRHPKIVAAVREQLDRFTHTAYQIVPYGSYVTLAERINALAPIQGAAKTTFFTTGAEAVENAVKIARAYTKRPGVIAFNAAFHGRTLLTMTLTGKVAPYSTGFGPFPGSIFHALYPNEQTGITVEQALESVERLMHTDIAADQVAAIILEPVQGEGGFHVAPPAFISGLRKLCDEHGILLIADEVQTGFARTGKLFAMEYYTEKADLITMAKSLGGGFPISGVVGRAEVMDAPSPGGLGGTYAGNPLSVASALAVLDVIEEEKLCQRAQRLGAALVETLEKVKAQCPALVAIRAQGSMVAAEFNDPNTGKPSAEITRQFQKSALEAGLLLLTCGVHGNVIRFLYPLTVPDEQFSKAMNILTRVLTR

SEQ ID NO: 81187 - protein, 490 aa, Erwinia carotovora subsp. atroseptica SCRI1043
MQLKQSISLKQQVLFRQHCLIDGEWQDSQSGERLNVTNPATGEVLGTVPLVTVSQTEQAIAAAEQALVEWRKKTGKERAALLQAWARLIMDNQDDLAVLLTAEQGKPLAEARGEIAYATSFIDWFAEEAKRIEGSVLQSPQGQQRLMVIKQPIGVCAAITPWNFPAAMITRKVGPALAAGCTMIVKPAEQTPFTALALAELAQQAGIPRGVLQVIVGDAQSVGKVLCDSPVVRKLSFTGSTEVGRILMAQSAPTVKKLSLELGGNAPFIVFDDADVDQAVKGILASKFRNSGQTCVCANRIYVQNGIYPTLVERLIEEVRKLNVGDGTQPGVTQGPLIDDDAVSKVEQHIADALSHGATLLLGGQRHERGGTFFTPTIVGDVTREMRFAREETFGPVAPLFRFSDEAEVIAMANDTEFGLAAYVYTRDAIRQWTVPEALDYGMVGINTGLISNEVAPFGGVKQSGLGREGSRFGIEDYLEMKYLCVDLSR

SEQ ID NO: 81188 - protein, 328 aa, Lentisphaera araneosa HTCC2155
MTKIRLVITSALAVMLSNGLVMAKDKPLLSIAAVADPQYADAPRRGGREPKKALNRMHHAVSEFNKRDIDWGVILGDIIDWDDIEYGRFPHKIIAKEPIGWIHKNAILNAWGKADFPTYLVLGNHDYYVPNEDKDGTIKPYNVYRAFGFKDKAYYDFESKGFRFVVLDGDFHYLNYSPKHPNYKKAYNYYRNFKGPQKKWWNAAISKEQQTWLIDVLDRALSKQESVVIMCHYPIHKSGQHSLLNDTEILKILDQYPNICLYLNGHAHGGDYKLMGKRHHFNLRGMQGDADAWYQIDFYSDKIKVLQAEKTSKPIYELKIDKSWQDKK

SEQ ID NO: 81189 - protein, 428 aa, Erwinia carotovora subsp. atroseptica SCRI1043
MTSEMTATEALLARRQRVLGGGYRLFYEEPLHVARGEGVWLFDHQGKRYLDVYNNVASVGHCHPAVVEAVARQSAQLNTHTRYLHHAIVDFAEDLLSEFPAELNNVMLTCTGSEANDLALRIARHVTGGTGMLVTRWAYHGVTSALAELSPSLGDGVVRGSHVKLIDAPDTYRQPGAFLTSIREALAQMQREGIRPAALLVDTIFSSDGVFCAPEGEMAQAAALIRQAGGLFIADEVQPGFGRTGESLWGFARHNVVPDLVSLGKPMGNGHPIAGLVGRSALFDAFGRDVRYFNTFGGNPVSCQAAHAVLRVIREEQLQQNAQRVGDYLRQGLQQLAQHFPLIGDIRAYGLFIGAELVSDRESKTPASESALQVVNAMRQRGVLISATGPAANILKIRPPLVFLEEHADVFLTTLSDVLALIGTRAQR

SEQ ID NO: 81190 - protein, 287 aa, Nocardia farcinica IFM 10152
MTTPVIAVLGSINMDLVTTTARRPAPGETVLGSGFDTVPGGKGANQAVAARRSGGRVEFLGAVGTDVFAPQLRGALESVGVGTAGLRTVPGPSGVASIVVDESGENSIIVVGGANAAMTALRETDRAMIAAADVLVCQLEIPVPTVAAGLRHARANGTTVLLNPSPAQDLPPQLWADVDVAVVNRGEERQLGAVLDRVPHVVVTLGGAGARYRGPDGAELAVPGVPVEVVDTTGAGDAFTGALAVTWRHGPAAALRWACAAGALATTRLGASASIPERAAIEDLLAR

SEQ ID NO: 81191 - protein, 192 aa, Triticum aestivum
  misc_feature (36)..(36): Xaa can be any naturally occurring amino acid
  misc_feature (70)..(70): Xaa can be any naturally occurring amino acid
  misc_feature (148)..(148): Xaa can be any naturally occurring amino acid
RRPTPSVPGSRSNNTLPWSPAVMASSATTGAPFQGXKSTAGLPVGRRSSGSLGSASHGGWIMCMQVWPIXGIKKFETLSYLPPLSTEALLKQVDYLIRSKWVPCLKFNKVAFLFREHNSFPGYYDGRYWTMWKLPMFWCTDTTQVLNXEVEDVKKEYPDSYIRVIRLDNLRQLQCVIFIAFRPSGCEEYDKA

SEQ ID NO: 81192 - protein, 369 aa, Salmonella enterica subsp. enterica serovar Paratyphi B str.
MATLSRLFIHPVKSMRGIGLTHALADISGLAFDRIFMVTEPDGTFITARQFPQMVRFTPSPLHDGLHLTAPDGSSALVRFTDFTPQDAPTEVWGNHFTARVAPTAINQWLSGFFSRDVQLRWVGPQLTRRVKRHNAVPLGFADGYPYLLTNEASLRDLQQRCPAGVQMEQFRPNLVVSGVAAWEEDSWKVLRIGDVIFDVVKPCSRCIFTTVSPEKGQKHPSGEPLATLQAFRTAQDNGDVDFGQNLIARNSGVIRVGDEVEILATAPAKAYGATTVDDSVTPEKHPDASVTIDWQGQTFCGNNQQVLLEQLENQGIRIPYSCRAGICGCCRIRLLEGEVSPLKKSAMGDDGTILSCSCVPKTALRLEN

SEQ ID NO: 81193 - protein, 144 aa, Triticum aestivum
  misc_feature (49)..(49): Xaa can be any naturally occurring amino acid
  misc_feature (106)..(106): Xaa can be any naturally occurring amino acid
RGLKEEEAAATPSTGGEMVFFALLVGAELDGLTNLQPRGGCEEPRLPYXYFKLRCESCGETSAKTTCVSLNEVVELPTGEGTSNLLQKGTPLTAEQSPKGEITCFXLSFECRGYEPIEFAFGNGWKAESVHWTPFDIDLSEGEF

SEQ ID NO: 81194 - protein, 318 aa, Cytophaga hutchinsonii ATCC 33406
MKKYPFTEKKDTRSGFGDGMTELGKTNPNVVALCADLTPSLKLNDFEKQNPERFFQIGIAEANMISMAAGMTIGGKIPFTATFANFSTGRVYDQIRQSVAYSDKNVKICASHAGLTLGEDGATHQILEDIGLMKMLPGMTVINPCDYNQTKAATIAIADHKGPVYLRFGRPALPVFTDPNQKFEIGKAWMVNEGTDVTIIATGHMVWEAILAGQQLEELGISAEIINIHTIKPIDEEAILKSVGKTGCVVTAEEHNILGGLGESVARVLASNLPTPIEFVAVKDTFGESGTPDELMEKYGLKDRHIVEAVQRVIKKKK

SEQ ID NO: 81195 - protein, 394 aa, Xanthomonas campestris pv. campestris str. ATCC 33913
MDSLLSPVSGYSRRSQDIAPFHVMALLARANALEQAGHDVIHLEIGEPDFTTAAPVVAAGQAALAAGHTRYTAARGLPALREAIAGFYAQRYGCHIDPERVLVTPGGSGALLLASSLLVDPSKHWLLADPGYPCNRHFLRLVEAGAQLVPVGPDSDYQLTPALVDACWTADSVGALVASPANPTGSVLSRAQLAALSQALQARGGHLVVDEIYHGLTYGLDAHSVLEVDDSAFVLNSFSKYFGMTGWRLGWLIAPPSAVPELEKLAQNLYISASSIAQHAALACFTPESIAIFEARRAEFQQRRDYLLPALRALGFDIAVEPQGAFYLYADISAFSKDAQAFCTHFLETEHVAFTPGIDFGFHRANQHVRIAYTQSLPRLEQAVERIARGLRHI

SEQ ID NO: 81196 - protein, 526 aa, Burkholderia thailandensis E264
MSPVSAFKLVLLSFLAIVALELLAKRLKLPPAAALLVGGAGIAFLPGLPPINLDPDLVLIVFLPPLLMDGAYFSVWEEFKRNVGGIMMLAIGAVAFTTLAVGVAVHLVAPGLPWAACFALGAIVSPPDAVAAKAVLERVALPRRLMVLLEGESLLNDAAGLVLFRFAVAAALTGAFSAGDALVRFAELGFGGVAVGFVVGWLIVRFLKLIEDDYLVITVAVLAAWISYIAGEMFEVSGVIATVTTGMMLGWHQHEVFSASVRNRGTAFWQVIVFLLEALVFVLIGLSLRGVIERLGGLGEVFATMTPAVVAVLVAVVASRFVWVFAVELLKAPVARVRGRGLRGDWKAATVMSWAGMRGVVTLAIALSLPDAMPGRDLILVAAFAVILVTVLLQGTTIGPLIRLLKLRDPGRAAHHLTEPQTWARVEAAQLAAIQPLVHDAEGNVIHPRLLEQYTYRANVTARHQNEPAFPQSEREAHYDVVLAAIAAGRAELLRLHRGGQIHDEMLYLLERDLDLQEIAAQHAKG

SEQ ID NO: 81197 - protein, 255 aa, Nocardioides sp. JS614
MIELRTPAQIEQMRPAGRFVADVLTALAEKADVGVNLLELDALAHSMIRECGAESCYIDYHPSFGASPFGKVLCTSVNDAVLHGLPHDYRLADGDLLSVDFAANVDGWVADSALSVVVGTPRPEDLDLIEVTSRALDAGIDAARPGNRLGDVSAAIGDVARAAGLGINLQFGGHGVGRTMHGEPHVSNDGRPGRGLKLRPGLVIAIEPWFLHTTDEIYTDDDGWTLRSKDGSRGAHMEHTVAITEDGHVVLTARA

SEQ ID NO: 81198 - protein, 314 aa, Escherichia coli CFT073
MDIPNMQNAGSLVVLGSINADHILNLQSFPTPGETVTGNHYQVAFGGKGANQAVAAGRSGANIAFIACTGDDSIGESVRQQLATDNIDISPVSVIKGESTGVALIFVNGEGENVIGIHAGANAALSPALVEAQRERIANASALLMQLESPLESVMAAAKIAHQNKTIVALNPAPARELPDELLALVDIITPNETEAEKLTGIRVENDEDAAKAAQVLHEKGIRTVLITLGSRGVWASVNGEGQRVPGFRVQAVDTIAAGDTFNGALITALLEEKPLPEAIRFAHAAAAIAVTRKGAQPSVPWREEIDAFLDRQR

SEQ ID NO: 81199 - protein, 715 aa, Pseudomonas oleovorans
MIYQGKAITVKALESGIVELKFDLKGESVNKFNRLTLNELRQAVDAIQADASVKGVIVSSGKDVFIVGADITEFVDNFKLPEAELVAGNLEANRIFNAFEDLEVPTVAAISGIALGGGLEMCLAADYRVMSTSAKIGLPEVKLGIYPGFGGTVRLPRLIGSDNAIEWIAAGKENRAEDALKVGAVDAVVAPELLMAGALDLVKRAISGELDYKAKRQPKLEKLKLNAIEQMMAFETAKGFVAGQAGPNYPAPVEAIKTIQKAANFGRDKALEVEAAGFAKLAKTSVAESLIGLFLNDQELKRKAKAHDEIAHDAKQAAVLGAGIMGGGIAYQSAVKGTPILMKDIREEAIQLGLNEASKLLGNRVEKGRLTPAKMAEALNAIRPTLSYGDFANVDIVVEAVVENPKVKQAVLAEVETQVKDDAILASNTSTISINLLAKALKRPENFVGMHFFNPVHMMPLVEVIRGEKSSEVAVATTVAYAKKMGKNPIVVNDCPGFLVNRVLFPYFGGFAKLVSAGVDFVRIDKVMEKFGWPMGPAYLMDVVGIDTGHHGRDVMAEGFPDRMKDERRSAVDALYEANRLGQKNGKGFYAYETDKRGKPKKVADASVLDVLKPIVFEQREVTDEDIINWMMIPLCLETVRCLEDGIVETAAEADMGLVYGIGFPPFRGGALRYIDSIGVAEFVALADQYADLGPLYHPTAKLREMAKNGQRFFN

SEQ ID NO: 81200 - protein, 667 aa, Shewanella sp. MR-7
MQKPQPLNQTREQITHLDNELLSLLAERRRLSLEVARSKEVDVRPIRDTQREKELLARLVTAGREKGLDAHYVISLYQSIIEDSVLNQQAYLHGRANPETQKQQYCIAYLGARGSYSYLAASRYCQRRQVEMLDLGCQSFDEIVQAVESGHADYGFLPIENTSSGSINEVYDVLQHTSLSIVGETTIEVSHCLLGKPGSKLSDIKTVYAHPQPISQCSRYLSQHKDLRLEYCSSSAEAMEKVNQSADNSAAAIGSTEGGALYQLESIESGLANQKINQSRFIVVARKAVAVPEQLPAKTTLIMATGQKAGALVEALLVLKAHQLNMSKLESRPIPGTPWEEMFYLDIDANISSEAMQQGLKQLERITRFIKVLGCYPCETVKPTQLSNSQLLIEPNTSKAEVISTASLDPSPYRFSKAYKAQASEIHCGPFTIGAGHIGAIAKITLSKSLLQQESSQAALSAFERRVKQLKEAGFQAVILDGCHSLASAEAIIPKLRQTLHQYDLLCVIAIEQATEMPLATSHADMLFLTGKQMFNQSLLTQAGTLPLPLFLERNDMASYEEFMAATETILSQGNQQLILCDSGIRTYNNANLPTLDLASLIQIKANSHLPIVINPCYAISEDALPLQTQGIKQLKADGLVLNCSLEEDKAHDSLALMSEVVRELYR

SEQ ID NO: 81201 - protein, 434 aa, Shewanella sp. MR-7
MTSYQILCILCALALVTSVASSRLHKLQETVAITALALGMSLLLLLGGKALGGHVYGYFVAGLEKLDFQALLLNGMLGFLLFAGALQIRLKILRHQKWEILILAFVSTLLSTFIVGGLLYYIAPMLGLPLALSHCLLFGALISPTDPIAVLAILKKMGAPEDIAIQVEGESLFNDGIGLVIFVAISHLAFSTEPLTFSQISLLFIQEALGGVVYGAVLGVLLHHFFRYCEEETQLMLVTLLIPTAGYVIAEVLGVSGPLAMVSAGIIIGNYSVPKYFVRHERVKLYTFWSLIESFFNALLFLLLGLLLLLVTFKTPLWWFMLVAIPLVLTARAVSVLLPYIGFRLVKSYNPYAESILIWGGLRGGLALAMAMSLPEGVIIDSQSGVELRELVLVMTYAVVVFSILVQGSSMTGLIRRSNAVATEANHQIATERT

SEQ ID NO: 81202 - protein, 219 aa, Nocardia farcinica IFM 10152
MSKYAGVRTLILLRHGQTEWNATDRMQGQIDTDLTELGRRQAKEAARELVSRNAIAIVSSDLRRAHDTALALAEHTDVPVALDPRLRETHLGDWQGLTHLEVDADYPGARVAWRLDATYRPPGGESKLEVGARALPVVRELYNERQDWPGRTIILVAHGGLIAALTAALLELPPQNWPALGGLANTSWVQLSSHGPGIDQPGWRLDVWNAAAKVAPDVL

SEQ ID NO: 81203 - protein, 300 aa, Triticum aestivum
  misc_feature (50)..(50): Xaa can be any naturally occurring amino acid
RRQDFIDYLGAIWPQVQCPGPQTRISCPAQYVINVIMGKLTISADVQKYXNIEYMRCSPENGFFPDLSKVPRTDIIFFCSPNNPTGAAASRDQLTQLVKFAKDNGSIIVYDSAYAMYISDDSPKSIFEIPGAKEVALETASFSKYAGFTGVRLGWTVVPKELLFSDGHPVAKDFNRIVCTSFNGASTISQAGGLGCLSPEGLKAMQDVVGFYKENTKIIVDTFESLGFNVYGAKNAPYVWVHFPGRNSWDVFAEILEKANVVTTPGSGFGPGGEGFVRVSAFGHRENIIEAARRLKQLYK

SEQ ID NO: 81204 - protein, 298 aa, Secale cereale
FSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVVIADKFAPDANSQTVAASAIPDGWMGLDIGPDSVKTFNDALDTTQTIIWNGPMGVFEFDKFAVGTEAIAKKLAELSKNGVTTIIGGGDSVAAVEKVGVADV

SEQ ID NO: 81205 - protein, 1551 aa, Venturia inaequalis
MAYAGTKGDGIIRTASGHETYAPDGLGTPQREYEEEIAPSEDPSRATSERYAPITGHLYRRNSSDTEKGSDEDFTMATRSKSFTENMDTDDKDKLNRILTSLSQHQTRSSTLRRNDTISGLKEDDPVFDPSHKDFDLYKYLRLFMRDLQADGRETKKAGIVFRNLSVSGSGAALQLQSTVSDFVLAPFRLRELFSSSKSHKQIIDKFDGVLKSGELLIVLGRPGSGCSTFLKTLCGELTGLTVDKGSVIHYNGIPQKKMIKEFKGEVVYNQEVDKHFPHLTVGQTLEFAAAVRTPSNRLHGESRTEFSSQVAKVVMAVFGLSHTYNTKVGNDFVRGVSGGERKRVSIAEMAVAGAPLAAWDNSTRGLDSATALKFVEATRISADLTGSSHAIAIYQASQAIYDRFDKAVVLYSGRQIYFGPASKAKQFFEEQGWYCPKRQTTGDFLTSITNPSERRPREGMEKQVPRTPEDFEKYWRNSEMYQSLQKEIEDHETEFPIGGETLGKLQQQKRNAQASHTRPKSPYMISVPMQIKLCTKRAYQRIWNDMSSTLTMFISQIIMSLIIGSVFYGTPNATAGFFSKGAVLFFAVLLNALVAMTEINSLYDQRPIVEKHNSYAFYHPATEAIAGIVSDIPVKFLLAVGFNVIFYFLAGLRREPSQFFLYFLVSYVIMFVMAAVFRTMAAVTKTISQAMSLAGVLVLALVIYTGFVIPVSYMKPWFGWIHYINPIYYAFEILIANEFHGRDFTCSAIIPAYTPLQGDSWICSIVGAVPGRRTVSGDDFIMQMYQYSYSHVWRNFGILLGFLCGFMCIYFVGVEVNSSTSSAAEFLIFRRGYVPAYMQDDPKHAGNDEEKMADGTTDAKEDGGDVSAIPPQKDIFTWRDIVYDIQIKGEDRRLLDHVTGWVRPGTLTALMGVSGAGKTTLLDVLAQRTTMGVITGDMLVNGKPLDASFQRKTGYVQQQDLHLETATVRESLRFSAELRQPKTVTLQEKFDYVEDVIKMLNMEDFAEAIVGSPGEGLNVEQRKLLTIGVELAAKPKLLLFLDEPTSGLDSQSAWAICAFLRKLADAGQAVLCTIHQPSAILFQEFDRLLFLAKGGKTVYFGPVGKNSETLIDYYESNGARKCGEEENPAEYMLEIVNKGSSGQGQDWHEVWKGSKEREAVNEELKQIHKEKEGEAIAGANEEGAQDEFAMPFTAQVKAVTVRVFQQYWRMPSYVFAKWALGIASGLFIGFSFFQANTTQQGVQNVLFSAFMIATIFSSLVQQIMPLFVNQRSLYEVRERPSKAYSWKAFMIANIVVEIPYNIFLGVPVFACYLYAIAGIISSVRQVLILLLMIQFFVYAGTFAAMCIAALPDAETAAAVVTLLFATSLTFNGVMQSPQALPGFWIFMYRISPFTYWISSLVSTMLHGRRIECSSSETSRFSPPAGQTCQQYLADYLQTAPGTLQNPNDTTNCRYCSLSTADQLLAGSNVKYDTRWRDFGIVWSYVIFNIFVAVLTYYLFRVKKWNKGTGKSDGAKKAGFLGKILKKGANKGNDAKTEKGEQQANQHQRAI

SEQ ID NO: 81206 - protein, 651 aa, Arabidopsis thaliana
MDSKGVVSLPLIHNHQMMPWNDLRKGDCCGHFEAISDGYYCKRCDFFVHKTCGDGVSEYIEHPSHPNHTLELCSNLRFHCDLCGRRTNYLSYYCEICGFIVDLHCAMYPPPEFIENSERHHHKLTLLKERIAAFDCDAKCGKISGNEFAYKCQECDLTFHVDCVWHPSEVYHPLEVNHSYHPSHPLKLHTGQRPDYSDGACRLCARKIDDRYFYHCSSCNFTLDMRCVLHPPQQSLLNLKAHDHQLTLLPRLDSFTCNACGLKGDRSPYVCFQCGFMIHQDCLSLPRLININRHDHRVSRTSVLGVVNSVCEVCHRKVDWTCGGFSCQRCSGYVVHSKCATNKDVWNGKELEGVPEETEDIKPFVVIDNNTIQHFSHKKHYLRLHVNGVLCDDKKRCRACTHPICLQSFYGCMDCDFILHQNCAGFPRKRWHVLHNERLTLVSYEYDFFQCQACNRFSNGFSYQYSGITFDVGCGSISEPFVHPSHPDHPLYYTLLDEETKSSCNGCNKSSYSVLRCIEDDCRFAICFKCATFPQVVKHRVDDHPLSLCFDKEASGKYWCDICEKETNPETWFYTCKDYRASLHIKCVLGDFSWLMPGSTIDLSELSKVVLNNSISRPFCSGCKMHCIFPIILKIVGTSDKYFCSIECAFG

SEQ ID NO: 81207 - protein, 298 aa, Hordeum vulgare subsp. vulgare
FSLAPLVPRLSELLGIEVKKADDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVVIADKFAPDANSQTVAASAIPDGWMGLDIGPDSVKTFNDALDTTQTIIWNGPMGVFEFDKFAVGTEAVAKKLAELSKKGVTTIIGGGDSVAAVEKVGVADV

SEQ ID NO: 81208 - protein, 1489 aa, Venturia inaequalis
  misc_feature (846)..(846): Xaa can be any naturally occurring amino acid
MGPDGPAPAHARGIEKESLQNPHSHDGTIADLTDEKESQSSHEGHERTWGAIQSPTSVNVSSAEAQFAELSKELSRNSHKDRLSRQQSHQSRRTISKNVDQEKTIGLSDSASSDSSEPFDLEAILRGNKREDEAAGIKTKKIGVVWEGLSVSGIGGVKNYVKTFPWAFVSFLNVYETAKGILGVGKKGKEFQILRDFGGVVKPGEMVLVLGRPGSGCTTFLKVIANQRFGYTKIDGEVMYGAFGSEEFSKRFRGEAVYNDEDDLHHPTLTVGQTLDFALETKVPGKRPAGLSRPDFKNKVIDLLLNMFNIAHTRNTIVGNPFISGISGGERKRVSIAEMMVTGATVCSWDNSTRGLDAATAVDWSRSIRVLTNIYKLTTFVSLYRASENIYEQFDKVMVIDEGRQVFFGPANEARGYFESLGFLEKPRQTTPDYLTGCTDPFEREYKDGRSSDNAPNSPDTLAEAFKNSKYHAQMKETMDTYKEQIGKEKEVYDDFQLAFKESKRHTSGRNVYTIPFYLQVWALMKRQFLLKWQDKFSLSVSWITSIVIAIVVGTVWLDIPTSSAGAFTRGGVLFIALLFNAFQAFSELASTMMGRPIVNKHRAYAFHRPSALWIAQIMVDMVFSSAQIMVFSIMVYFMCHLVRDAGAFFTFYLMIVSGYLAMTLFFRTVGCLCPDFDVAIRLAACIITLFVITSGYIIQWQSQQLWLRWIFYINSLGLGFAALMMNEFKRIDLTCEGTSLVPPGPGYTDLNHQVCTLAGSVPGQARVSGSAYIGSAFSYDPSDLWGYWGITIGLIIGFLLANAFLGEFVKWGAGGRTVTFFAKENKETKKLNEELTRRKDSRQKXETQGSSELNITSKAVLTWEDLCYDVPVPSGQLRLLNNIYGYVKPGELTALMGASGAGKTTLLDVLASRKNIGVITGDVLVDGIAPGIAFQRGTSYAEQLDVHEPAQTVREALRFSADLRQPYETSQEEKYAYVEEVISLLEMESIADAIIGEPENGLAVEQRKRVTIGVELAAKPELLLFLDEPSSGLDSQSAFNIIRFLRKLSAAGQAILCTIHQPNSALFENFDRLLLLQRGGQCVYFGDIGKDASVLREYFAKSGAHCPPKANPAEWMLDAVGAGMAARIGDKDWGEIWKDSDEFAQAKAEIVRLKAERTKAIGDLAPVEQKEYATPMWHQIKLVCKRQSLSFWRTPNYGFTRFFNHVAIALITGLAYLTLDDSKTSLQYRVFIIFQVTVLPALILAQVEPKYAIARMISYRESAAKAYKTFPFALSMVIAEMPYSVLCAVGFFLPIYYIPGLNSASSRAGYQFLIVLITELFSVTLGQMIAACTPSPFISALVNPFIIITFALFCGVTVPKPQIPGFWRAWLYELDPFTRLIGGMIVTELQDLPVQCTPQELNAFTAPAGQSCGEYMSAFFQTGGAGYLVNNATSNCEYCAYTSGQQFFQPLGYEFAHRWRDLGIFAAYIGSNLIILFLAARFLNFNKR

SEQ ID NO: 81209 - protein, 298 aa, Zea mays
FSLAPLVPRLSEFLGIQVIKADDVVGPEVEKLVSALPNGNVVLLENVRFYKEEEKNDPEFAKKLASLADLYVNDAFGTAHRAHASTEGVTKFLKPSVAGFLLQKELDYLVGAVSNPKRPFAAIIGGSKVSSKIGVIESLLEKCDILLLGGGMIFTFYKAQGHSIGSSLVEDDKLELATSLLRKAKEKGVSLMLPFDLVVADKFAPDASSQVVPASAIPDAWMGLDIGPDSISAFSSALETTQTVIWNGPIGVFEFDKFAVGTKAIAKKLAELSGKGVTTIVGGGDSIAAVEKVGVADS

SEQ ID NO: 81210 - protein, 409 aa, Legionella pneumophila str. Paris
MSIEVKVPVLPESVADATVAAWHKKVGDKVSRDENLVDLETDKVVLEVPSPVDGVLSDILFNTGDTVGSGDLLAKISQSVSVESQKTEKEEKPVKKEEIKISESESVSTKEDKSTSPVVRRMMAENDLKAGQIQGTGKDGRITKEDVLSYIESNREKSNQTAEVQKESSMRTLSFGGREEKRVPMTRLRAKIAERLLQAQHNAAMLTTFNEVNLKAVMDMRSQYKDSFEKKHGVKLGFMSFFTKAVVESLKRFPAVNASIDGQDIVYHGFYDIGIAVSTERGLVVPVIRDADQLSMAEIELAINDAASKARTGKLSMEEMQGGTFTITNGGVFGSLLATPIINPPQTGILGMHKIEERPIVEKGQIVIRPMMYVALSYDHRLIDGKDSVQFLVSVKELLEDPSRLLLNV

SEQ ID NO: 81211 - protein, 387 aa, Legionella pneumophila str. Paris
MNLHEYQAKQLFASYGLPVPRGEVAYNVEDALLVASQLSTSRWVVKAQVHAGGRGKAGGVKLVSSKDELAAVAKSMLGTRLVTYQTDARGQPVNAILVEETCEIDKELYLGAVVDRATRRVVIMASTEGGVEIEKVAHETPEKIFKVVVDPLVGVMPFQCRETAFKLGLKDDQIKQFTHLMMGLGKMFVDCDLSLLEINPLVITKSGQLICLDGKINIDGNALFRQPKLKNMRDVSQEDDRENRASDWELNYIPLDGTIGCMVNGAGLAMATMDVIKLHGGEPANFLDVGGGATKERVSEALKIIVSDEKVKGILVNIFGGIVRCDLIADGILAAVKEVDVKIPVVVRLEGNNAQLGAEILNKSNLNVIAATSLTDAAKKIVAAVSE

SEQ ID NO: 81212 - protein, 327 aa, Triticum aestivum
MEMRLHLHVLAILVIISARPPSVAGGLCRDSCGDVPVRYPLGIDDGCGSPYYRSMLTCADNTTLRLRTPSGTYPVSGADYADPHLVVTDPSMWTCARPFTAVHAAPFSLDTSTRFSLSPRNDHLFFNCDEERVIVAPRPAICDRYPDRCDSACDSAGYLCRNLPGCRGALEEGNMSCCAYRPRAAESLRAMLRHCEAYTTVYWRAVGDKFPPYDQVPDYGVRVDFEIPVTTRCLQCQDRRRGANGTCGFDPATRDFVCICDGGRNSTTDCADGRVTGHGASAGVVAATVVFSISAAIGIGGLVMYIRKMRSSKVVTCGVQSNENRFF

SEQ ID NO: 81213 - protein, 471 aa, Burkholderia thailandensis E264
MGKQAIGVVGLAVMGRNLALNIESRGYAVSVYNRSREKTDELIAEFPDRKLVPAYTLEEFVASLETPRRILLMVKAGEATDATITALKPLLDKGDVLIDGGNTHFTDTIRRNQELAQAGLHFIGTGVSGGEEGALRGPSIMPGGQRDAYDLVEPILKQIAAKAPADGEPCVAYMGPDGAGHYVKMVHNGIEYGDMQLIAESYAVLKQVAGLTNDELGAVYAEWNQGELDSYLIEITAKIFGKKDDETGEHLVDVILDRAAQKGTGKWTSQNALDLGVPLPLITESVFARVLSSLKDQRVAASKVLAGPAPAPLEGDRAAFVESVRRALYLSKVISYAQGFAQLDTASKEYGWKLDLGAIAKIFRAGCIIRARFLQKITDAYAKNAALANLLLDPYFQDIAANYQSALRDVVIAAVKAGVPVPAFASAVAYFDSYRSARLPANLVQAQRDFFGAHTFERTDKPGSFHASWAE

SEQ ID NO: 81214 - protein, 221 aa, Burkholderia thailandensis E264
MMHSMKSSHPESPQPDDGAASECVTLVATATLPTRYGTFTSYAFRVAGGDAEHLALVMGDVAEQPSVLTRLHSECLTGDVFGSYRCDCGEQLDLALRYIAAEGRGVLLYLRGHEGRGIGLSNKIRAYALQEQGRDTVEANLDLGLPDDAREYDSAAAILRILKVTSVRLMSNNPKKFDTLARHGIPVCERVALAVPVREENERYIRTKQLKFGHYYFDENE

SEQ ID NO: 81215 - protein, 388 aa, marine gamma proteobacterium HTCC2080
MSDIYPIAVPKWGIEMVEGTITTWNKSQGDAVAKGDEVFEMESDKIVNVWEAPVDGVLRRVLAEPGDAHPVGALLGVIAPAAVSDGDIDTFIAGYAGDDAKEAPAQATAEPAKPVAQTSDAYTRSSPSVRKLADELNVDLSTVTGTGRRGRITDNDVRDAAGGNDEAVGVQVIPLSPTRKTIARRLTEAKQTIPHFYLSADYALDGLMAHRQTLNGSGDTKVSVNDLLVWCVGQALMREPRVNVNLVGDDIHQFEAANIAVAIATDDGLYPATIPGVEAKSPAEVAQATGALAEKARSNSLTKEDISGGSFTVSNLGMYGISEFTAIINPPMGAILALGKAEPKVVVKDGEQSIATVLTATLSCDHRVIDGAVGAQFMAALRDVIDGL

SEQ ID NO: 81216 - protein, 280 aa, Glycine max
MGSQQAAVSFLTNLARAAFGLGASATLLSSSLYTVDGGQRAVLFDRFRGILDETVGEGTHFLIPWVQKPYIFDIRTRPHTFSSVSGTKDLQMVNLTLRVLSRPDTDKLSLIVQNLGLEYDEKVLPSIGNEVLKAVVAQFNADQLLTDRPHVSALVRDGLIRRARDFNILLDDVAITHLSYGAEFSRAVEQKQVAQQEAERSKFVVMKAEQERRAAIIRAEGESDAAKLISDATASAGMGLIELRRIEASREVAATLAKSPNVAYLPGGKNLLMALNAGGR

SEQ ID NO: 81217 - protein, 278 aa, Triticum aestivum
  misc_feature (124)..(124): Xaa can be any naturally occurring amino acid
MAPSQEVAPPAAAITKDPSTNGNGNGNGNGTAAPAPKTKTPALNERILSSITRRSVAAHPWHDLEIGPDAPTIFNCVIEIPKGSKVKYELDKKTGLIKVDRVLYSSVVYPHNYGFIPRTLCDDXDPIDVLVIMQEPVVPGCFLRAKAIGLMPMIDQGEADDKIIAVCADDPEYRHFNDIKELPPHRLAEIRRFFEDYKKNENKEVAVNDFLPSEDAYEAIQHSMDLYATYICEGLRRYIIDPVMPCRLLEDVDEKLFVSKRYIHSCFVLPTCIHKYTY

SEQ ID NO: 81218 - protein, 664 aa, Vitis vinifera
  misc_feature (658)..(658): Xaa can be any naturally occurring amino acid
MATSVGAANAAVFKDPKIQTQIQTFKAFKPWTALPVTTSRSRPRSSPSVIRAVSTPKRSKVEIFKEQSNFIRYPLNEELLTDAPNINEAATQLIKFHGSYQQANRDERGPKSYSFMLRTKNPCGKVPNKLYLAMDDLADEFGIGTLRLTTRQTFQLHGVLKKDLKTVMSTIIRSMGSTLGACGDLNRNVLAPAAPFARKDYLFAQETADNIAALLTPQSGFYYDMWVDGERLMSAEPPEVTRARNDNSHGTNFLDSPEPIYGTQFLPRKFKVAVTVPTDNSVDIFTNDVGVVVVSDANGEPLGFNIYVGGGMGRTHRLETTFPRLSESLGFVRKEDILYAVKAIVVTQRENGRRDDRKYSRMKYLIDSWGIEKFRSVVEQYYGKKFEPIHELPEWEFKSYLGWHEQGDGGLFCGLHVDNGRIGGKMKKTLREVIEKYNLDVRLTPNQNIILCNIRSAWKRPITTALAQAGLLHPRYVDPLNLTAMACPALPLCPLAITEAERGIPDLLKRVRAVFEKVGLKYNESVVIRVTGCPNGCARPYMAELGLVGDGPNSYQIWLGGTPNQTSLARTFMNKVKIQDLEKRQTKESFGNFTNRMGFEKLQELVDKWEGPVMSPSRFNLKLFADKETYEAVECTCKAPEQECPSVSHGSNSQFCCXPAKWQR

SEQ ID NO: 81219 - protein, 131 aa, Candida albicans SC5314
MSGGKGKAGSSEKASTSRSAKAGLTFPVGRVHRLLRKGNYAQRIGSGAPVYLTSVLEYLAAEILELAGNAARDNKKSRIIPRHLQLAIRNDEELNKLLGDVTIAQGGVLPNIHQSLLPAKKAKAGAASQEL

SEQ ID NO: 81220 - protein, 193 aa, Brassica napus
MGSDETKSTIDTEKTTVPGGSCTTSKSCWMVQVVLRLFLFAATLTSIVVMVTSKQSKTIPIFPFHTQAKFTHSPAFIYFVVALSVACFYSIISTLATLSAFKKPSSCSAILLLNLAIMDAVMVGIVASATGASGGVAYIGLKGNKNVQWRKICDLYDTFCRHVGGAIAVSLVASIILLLLSIISVLSLYKRIR

SEQ ID NO: 81221 - protein, 572 aa, Physcomitrella patens subsp. patens
MSNHRLGDGSAAGLQSGAAGSVAGEHPYGEHPSRTLFVRNINSNVEDTELRQLFEQYGAIRTLYTACKHRGFVMISYYDIRAARSAMRALQNKPLRRRKLDIHFSIPKDNPSDKDVNQGTLVVFNLDASVSNDELRLIFGVYGEVKEIRETPHKRHHKFIEFYDVRSAEAALRALNRSDIAGKRIKLEPSRPGGARRSLLQQLNQEAGDEDPRARQQPHSPLNTSPPVRPGSGGLMFPSSNGNGSLSGQQFSLWGTPSSSFSHMSQSPPPALWSNSSSVGQSFYGMGQAQLQAHAFNSSLLSGLSRHHVGSAPSGEPSLLERRHSYIGGESLGESSSLLRSSSGTGLGGNAAHAINIGVSHQHGMMNSSSSLGGSSGMEHASSPNVGMMSPQARTRFLQNGGPLGPSSIEGASDRGRSRRGESVAAQADNKKQYQLDLERILRGDDPRTTLMIKNIPNKYTSKMLLAAIDEHHRGTYDFIYLPIDFKNKCNVGYAFINMMSPSRIVPFYKAFNGKKWEKFNSEKVASLAYARIQGKAALVAHFQNSSLMNEDKRCRPILFHSDGAHMGDQLE

SEQ ID NO: 81222 - protein, 546 aa, Glycine max
  misc_feature (196)..(196): Xaa can be any naturally occurring amino acid
  misc_feature (211)..(211): Xaa can be any naturally occurring amino acid
MATSLSVSPSLSLNTLFFAKALPLSRPSLLSLPLPKSLLSLSTRRRTFAVRAESQNGADAVPAHYDFDLFTIGAGSGGVRAARFAANYGASVAICELPFSTISSETTGGVGGTCVIRGCVPKKLLVYASKFSHEFEESNGFGWRYDSEPKHDWSSLIANKNAELQRLTGIYKNILNNAGVKLIEGHGKNIDPHTVXDVNGKLYSAKHILVXLGGRPFIPDIPGNEYAIDSDAALDLPTKPEKIAIVGGGYIALEFAGIFNGLKSEVHVFIRQKKVLRGFDEEIRDFVSEQMSVRGIEFHTEESPQAITKSADGSFSLKTNKGTVDGFSHIMFATGRRPNTQNLGLESVGVKIAKDGAIEVDEYSQTSVPSIWAVGDVTNRINLTPVALMEGGALVKTLFQDNPTKPDYRAVPSAVFSQPPIGQVGLTEEQAVQQYGDIDIFTANFRPLKATLSGLPDRVFMKLVVCAKTNEVLGLHMCGDDAPEIVQGFAVALKARLTKADFDATVGIHPSAAEEFVTMRTPTRKIRKSESSEGKSGSEAKTAAGV

SEQ ID NO: 81223 - protein, 330 aa, Zea mays
MCSCACARLLPPLFSPAPSPNLRPAFPHSPTPARSRAVVALAGAASRDDAPAPLSSFDFLALKRELDEEEEAVVAVDAKEGAGAVNEDDGELGAERSAGGTRRRRRRQMARRSALLAKQVISVTSARSLGFVSQLWIDTASWAVALVEVKPSLLSGEAEKFLFEDIYQVGDVVLVANESVIDNEHKLVGLHSLVGYNVVTSRRRNVGKVRGFTFDISSGAMESLELDSFGLSIVPSSLVSTYCLFVEDVLDIVSDTVVVHEDAVSRVQRLTQGILGTQNIHGPGGEIDEYGRFGGRGRRRRANGQGKSGGRELRSEPKHPDDEWELPMDY

SEQ ID NO: 81224 - protein, 589 aa, Glycine max
MSSASLKEMRNGGEDYSNGHGGGGVRDLYGEDCATEDQLITPWTFSVASGCSLLRDPRYNKGLAFTEGERDAHYLRGLLPPAIFNQELQEKRLMHNLRQYEVPLHRYMAMMDLQERNERLFYKLLINNVEELLPVVYTPTVGEACQKYGSIFRRPQGLYISLKEKGKILEVLKNWPEKSIQVIVVTDGERILGLGDLGCQGMGIPVGKLSLYTALGGVRPSSCLPITIDVGTNNEKLLNDEFYIGLKQKRATGQEYAELLEEFMHAVKQNYGEKVLIQFEDFANHNAFDLLEKYSSSHLVFNDDIQGTASVVLAGLLASLKLVGGTLVDHTFLFLGAGEAGTGIAELIALEISKQTKAPVEETRKKIWLVDSKGLIVSSRLESLQQFKKPWAHEHEPVKSLLDAVKAIKPTVLIGSSGAGKTFTKEVVETMASLNEKPLILALSNPTSQSECTAEEAYTWSKGKAIFASGSPFDPVEYEGKLFVPGQANNAYIFPGFGLGLIISGAIRVRDEMLLAASEALAAQVSQENYDKGLIYPPFSNIRKISAHIAAKVAAKAYDLGLASHLPRPKDLVKYAESCMYSPGYRSYR

SEQ ID NO: 81225 - protein, 570 aa, Triticum aestivum
MAGGGVEDVYGEDRATEEQLITPWSFSVASGHQLLRDPRHNKGLAFSEAERDAHYLRGLLPPAIVSQEHQEKKIMHNLRSYTVPLHRYIAMMDLQERNERLFYKLLIDNVEELLPVVYTPVVGEACQKYGSIYRRPQGLYISLKDKGKVLEVLKNWPERSIQVIVVTDGERILGLGDLGCQGMGIPVGKLSLYTALGGVRPSACLPITIDVGTNNETLLNDEYYIGLRQRRATGEEYHELLQEFMNAVKQNYGEKVLVQFEDFANHNAFDLLAKYSKSHLVFNDDIQGTASVVLAGLLAALRMIGGGLVDQTYLFLGAGEAGTGIAELIALEMSKHTELPVDDCRKKIWLVDSKGLLVESRKESLQHFKKPFAHEHEELKTLLEAVQSIKPTVLIGTSGVGKTFTQEVIEAMASFNEKPVIFSLSNPTSHSECTAEEAYTWSKGTAVFASGSPFDPVEYEGKTFVPGQSNNAYVFPGFGLGVVISGAIRVHDDMLLAASEALAEEATQENFDKGLIFPPFTNIRKISASIAAKVAAKAYDLGLASRLPRPDDLVKYAESCMYTPLYRSYR

SEQ ID NO: 81226 - protein, 592 aa, Xylella fastidiosa 9a5c
MSFSKHFGKLMLATCLSLSAAPVFSYSISHGKVIDDKGNQIQLKGGSWFGFETTNHVVHGLWTRNWKEFITQIQSMGLNAVRLPFCPASLNSNTSPSSIDYNRNPDLQGLSSLQIMDKVVKELSDRGIYVLMDHHTPDCAAISELWYTDSYSEKQWIDDLRFVAHRYANVPGVIGLDVKNEPHGRATWGTGDPKTDWNTAVEHAAAAILEAAPKWLIGVEGIGENPSCSSTIGHFWGENLEPMDCTPLKVPADHLLLIPHVYGPDVYVQPYFNSPDFPNNMAAIWDKHFGHFAKAGYAMAIGEFGGKYGEGDPRDVAWQNALVDYLISIGVTDTFYWSINANSSDTGGLFRDDWNHVREDKLTLLKKLWNGKDGSGGGGGSGGGSGSGGGSGSGGGSGSGGGSGSGGGSGSGGGSGSGGGSGSGGGSGSGGGGGSGGGSGSGGGSGSGGGSGSGGGSGSGGGSGSGGGGGSGGGGSGGGGGSGGGSGSGGGSGSGGGSGTGGGGSDPTKSKISVNTIVDSDWHTGYCERIQVTNISNSPTTWTVTISIRGNIQTLWSARWSVKGNALTASGMDWNKTLDPKGTTEFGFCSNY

SEQ ID NO: 81227 - protein, 233 aa, Solibacter usitatus Ellin6076
MNLPNALTILRIFFVPLLVAALVQENVGFQVGAVKVTNEWLSLAIFLVAAATDLLDGYLARRWKQVTTIGTLLDPIADKLLVSAALISLVQVRSLPGWMAVLIIGREFAVSGLRSIAATEGYTIKASDLGKTKMFCQVVAISVMMLAVRHPGLRTTGLALMWGVVFFAMASAISYFSKFWHKVDEGIKNRRRRELLVLDRKRRRALRRQRRSSGSMGAAGGLAGTIWKPPEVN

SEQ ID NO: 81228 - protein, 342 aa, Rhodococcus sp. RHA1
MAPGVTAVPPTDAARLNDSSLIDHWIATLRGENRIVGLADGEDERAIRAAHHLHHKCVVSPRLFGRRDVIRRIAEAAGIPLAEELVVDLAEAAADPAIRDAVESGFARYPDRIESALSDPVCLAAAALRAGVVDACVAGASRPTSDVLRAGLRIVGLAPGSSILSSSFLMLLSDGRQLTFSDCAVVPDPTVEELVDIALAASATHFQLTEQTPIAAMLSFSTQGSASHPRVEKVREAAELVRVRDPQLHVDGDLQFDAALVAEIGASKAPGSRVAGRANVLVFPNLDAGNIGYKIAQRLGGAIALGPILQGLAAPWNDLSRGCTGSDIELMALVSAVQSLAT

SEQ ID NO: 81229 - protein, 315 aa, Legionella pneumophila str. Paris
MSTMMIFTGNANPELALKISSHLQIPIGKATVGTFSDGETMVEILENVRGKDVFVLQSTCAPANNNLMELLIMADALRRSSAGRITAVVPYFGYARQDRRVRSARVPITAKVVADMMASVGICRVLTVDLHADQIQGFFYMPVDNVYSTPVLLEDITKQKLNNIMIVSPDVGGVVRARAVAKRLNDAELSIIDKRRSGPNKSEVMHIIGEPANKNCIIVDDIVDTAGTLCTAAQELKKNGAKSVRAYITHPVLSGPAVNNIKHSGLDEVVVTDTIPLSAEAQNCEKIRVVSLADMLAQAIKRVNVEESVSSMFAE

SEQ ID NO: 81230 - protein, 454 aa, Rhodococcus sp. RHA1
MDVTELRARARRHLGPHFTRKDTWESDFPVFVRGEGSYLIDTEGDRFLDGLAGLFCVNIGHGRDDIAKAASEQIGTLAYASNWGSAHIPAIEASALIADLAPGDLGTTFFVNSGSEAVETAVKFARQYHRSQGNPQRTKIISREMAYHGTTLGALSVTQLPKIKDPFGPLLPGVRSVPNTLGYLGDCGPANELDCIAAIEAVIEEEGADTIAAVFAEPVQNGRGALVPPDGYWSALRALCDKHGILLVSDEVICSFGRLGHWFGHGLTGVVPDMITFAKGSTSGYAPLGGLIVREQLVRELYDSPKGGVFTHGATWGGHPVSTAVAVANITAMRDENVLGNVTARGPKLKSALDSLMSAHRCVKDVRGTGFFYAIELMADSDSGREFTEQESLTVLRKVLPEAFARTKVILRGDDRGATMLMISPPLVADDEVLSELLHGIDSMLTDIEKAIQP

SEQ ID NO: 81231 - protein, 396 aa, Salmonella enterica subsp. enterica serovar Paratyphi B str.
MFENITAAPADPILGLADLFRADDRPGKINLGIGVYKDETGKTPVLTSVKKAEQYLLENETTKNYLGIDGIPEFARCTQELLFGKGSALINDKRARTAQTPGGTGALRIAADFLAKNTPVKRVWVSTPSWPNHKSVFNAAGLEVREYAYYDAENHTLDFEALQASLSEAQAGDVVLFHGCCHNPTGIDPTLEQWQVLAELSVEKGWLPLFDFAYQGFARGLEEDAEGLRAFAALHKELIVASSYSKNFGLYNERVGACTLVAADAETVDRAFSQMKSAIRANYSNPPAHGASIVATILSNDALRAIWEQELTDMRQRIQRMRQLFVNTLQEKGANRDFSFIIKQNGMFSFSGLTKDQVLRLREEFGVYAVASGRVNVAGMTPDNMAPLCEAIVAVL

SEQ ID NO: 81232 - protein, 574 aa, Legionella pneumophila str. Paris
MKYNYKWLSCLFFLICNIYQVNAKTFPQHPPGYAVASAHPLATHAGLEILAAGGNAFDAAVAVAAALAVVEPYHSGLGGGGFWLLHQEKEHLNLFIDGREVAPLAASKDMYLAPDGQVIPGLSLNGGLSAAIPGQPAALVYIAKNYGRLPLSKTLAPAIKLAEEGFPVDPQFRYFSTLDDRLENLKKYPDTAAIFLKNDKPFEIGEKLVQKDLAKTLRLIAKYGNAGFYSGETASLLVQGVNAAGGIWSLDDLAQYKIKVRPPLISAYHNMLIITAPLPSAGGVALVTMLNILSKFPLSSFPKLKWVHYVVESMRLAYWQRDQFLGDPDFIKIPLDKLISSDNAKQLSRLISPDKAIDSKVLQGSVPIGKHSNTSHISIIDTEGNRVAATMTINYIFGSSVVAKGTGVLLNDEMDDFSTKVGEQNVFGLVGSERNAIEPRKRPLSSMAPTFLEMPGRVAILGTPGGSRIPTMVLLASLLFYDGYGAISMVSAMRFHHQYLPDVLQFEPDTFPSSIQQGLQAMGYHLMPLKQYYGDMQAITWDKESNVLTAASDPRHIGLAAAISNMAYGYGVNY

SEQ ID NO: 81233 - protein, 495 aa, Burkholderia thailandensis E264
MSDIPLLPEVSRFLAQDHAHFVGGAYRASTSERRIAITNPATEQTIAHVRNADAADVEAAVAAAKAAFRGAWRDTSPGRRAEILNRLADLIERHGEEIAQLETLCSGKPIHVSRAIEVAQSATFLRYYAGWATRINGETIAPSLPSRAGERYTALTFREPVGVVAGIVPWNFSVMIAVWKIASALVTGCTVVIKPSEFSPLTLLRLAELATEAGVPPGALNIVNGDGDIGRMLIDHADVAKVSFTGSAATGIRVGTQAIGANLTRATLELGGKNAAGFLEDVDVDDAVSGLLTAGYTHQGQICASPERVYVHRSKLDEVLEKVRAGLQAIRVGSPLDESMAFGPLANKPHLEKILGYFDWARENGEVVFGGRRVERAGYFVEPTAVLAKHRDDRLLHEETFGPIIAFLPYDTDDELISLFNDTPFGLTASLWTNNLSKALRLIPRIEAGTLWINMHTFLDPAVPFGGLKSSGLGREFGSAFIHDYTELKSVMIRY

SEQ ID NO: 81234 - protein, 334 aa, Xylella fastidiosa 9a5c
MSIEQLAETAQAMVASGKGIIAIDESAGTIAKRFSSVGIENIEENRRAYRELLLTTPKLSDYISGAILFDETIRQSTKAGVPFPKYMADHGIIPGIKVDKGAYPLAGCPGELVTEGLDGLRARLEEYYKLGARFAKWRAVINIGDDIPSGMCIDANVHALARYAALCQEQGLVPMVEPEVIMDGNHDISAAYEVTEATLRSLFNALYEQNVVLEGTILKASMVIPGTDCEEQASIDEVAESTVMCLKSTVPAILPGIVFLSGGQTDAQSTAHLNAMNQLDPLPWPLSFSYGRAMQQAALKLWSQDMKGNFAKAQQVVYERAKENGLAALGKWKG

SEQ ID NO: 81235 - protein, 171 aa, Erythrobacter sp. NAP1
MKIQSAESERHVLTVTVDNEPGILAKITGLFTARGYNIDSLTVADITEDHAVSRITIVTNGPPAVIDQIEAQLERLVPVHKVTDLTTAGPHVERELALIKVAGKGDARVEALRIAELFRANVVDTTTHSFVFELTGAPDKINSFISLMRELGLVSVGRSGVVGMMRGAEEV

SEQ ID NO: 81236 - protein, 574 aa, Erythrobacter sp. NAP1
MECLVDQGVEFVFGYPGGAVLPIYDELFGDERIRHILVRHEAGAGHAAEGYARATGKPGVVLVTSGPGATNAVTAIADAYMDSIPMVVITGQVPTALIGTDAFQEADTVGITRHCTKHNYLIKDPADLVATVEEAFRIATTGRPGPVVVDIPKDVQIAVPSQSSAYVAPGSHRYAPQMVAPAEQIAEAIELIENAQAPILYTGGGVINSGPEASELLRKLQDLTNAPITSTLMGLGAFPNTHPDWLGMLGMHGTYEANMAMNKCDVMICVGARFDDRVTGRLDAFSPDSKKIHIDIDRSSINKTVPVDIGIVGDCATVLGQLVEAWGTRKPQDLGEWKARIAGWRARECLAYPQRSKKNPEAIMPQKAVERLYALTKDRKPIVSTEVGQHQMWAAQYFGFDEPNKWLTSGGLGTMGYGMPAAIGAQLGCPDALVIDIAGEASIQMNIQELGTASQYRLPIKVFILNNEYMGMVRQWQELTYESRYSNSYSDSLPDFVALAEAYGWKGIRITEEAGLDAGIKAMIDHDGPVIVDCCVAKDANCLPMIPSGAAHTDMLLYGDSVDGTMDDEAKALV

SEQ ID NO: 81237 - protein, 237 aa, Oryza sativa
MAAAGSIGVYKAVFAALGALMLGTLVYTCVTDGSPFRLELLTPWLVATLIDFYVNVTAISTWVIYKEVNWISSFFWVVLLYCFGSIATCAYVVVKLFEIKTSGPSQDPLDLLFLRQGNLSERKSSFVIIGRIIFSILGAMMAAVVIYTVITDGLPFRKDLLTPWMAATLIDFYINVFAISVWVAHKESNWISTAIWICLLICFGSITTCGYIVIQFFQVSYQDPIYHVLLNTRNKKI

SEQ ID NO: 81238 - protein, 514 aa, Escherichia coli CFT073
MSVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTTVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVEGGKLSDIAPTMLSLMGMEIPQEMTGKPLFIVE

SEQ ID NO: 81239 - protein, 384 aa, Leptospira interrogans serovar Copenhageni str. Fiocruz L1-130
MMIPEDLAANLKKEFPSNEEKIRFFTAPGRINIIGEHVDYAGGIVLPAAIDFSIRIAIRKNQTRKFRIYSVASKEKIEVESITYDPKHAWVNYVYGIVEEFRKLDFISDFFDLVVWGNIPQGAGLSSSAAFEVVVAFALSEIHNWNLSKEEIALLSQRAENHFVGVNCGIMDQFIISTAREGYCISLDTESLEYDFHKMDLEGCEFYLIDSKIKHSLKDSAYNERRKEVESAFQKIKRYKSSVKTLYQVELEDLDNVSFGLSEIEKKRAKHVIGERLRTSKAIENLKNGNVQGLGEILFECHSSLSKDYEVSCKETDFIVHELKMEEVLGARMIGGGFGGCVLVLDKVGRKNILFEKIKTRYFDKFQNELKLYSFKVSDGVREI

SEQ ID NO: 81240 - protein, 327 aa, Salmonella enterica subsp. arizonae serovar 62:z4,z23:--
MATRIEFHKHGGPEVLQAVEFTPTGPAELEIQVENKAIGINFIDTYIRSGLYPPPALPAGLGTEAAGVVSKVGSGVEHIRVGDRVVYAQSTLGAYSSVHNVPADKIAILPDAISFEQAAASFLKGLTVFYLLRKTYQVKPDDPFLFHAAAGGVGLIACQWAKALGAKLIGTVGSAQKAQRALDAGAWQVINYREESIVERVKALTDGKKVRVVYDSVGKDTWEASLDCLQRRGLMVSFGNASGPVTGVNLGILNQKGSLYATRPSLQGYITTREELTEASNELFSLIASGVIKVDVAENQRYALKDARRAHEVLESRATQGSSLLIP

SEQ ID NO: 81241 - protein, 345 aa, Salmonella enterica subsp. arizonae serovar 62:z4,z23:--
MHGNLEMVKTSQTSAIAENTNNHWSGRFSVAPMLDWTDRHCRYFLRLLSRQTLLYTEMVTTGAIIHGKGDYLAYSEEEHPLALQLGGSDPAQLTHCAKLAEVRGYDEINLNVGCPSDRVQNGMFGACLMGNAQLVADCVKAMRDVVSIPVTVKTRIGIDDQDSYAFLCDFIDTVSGQGECEMFIIHARKAWLSGLSPKENREIPPLDYPRVYQLKRDFPHLNMSINGGIKSLEEAKEHLRHMDGVMVGREAYQNPGILAAVDREIFGADTTDADPVAVVRAMYPYIERELSQGTYLGHITRHMLGLFQGIPGARQWRRYLSENAHKAGADIGVLEQALKLVADKY

SEQ ID NO: 81242 - protein, 356 aa, Salmonella enterica subsp. arizonae serovar 62:z4,z23:--
MKAMVYYGEHDIRFEERQKPQILNSGDVIIRMIKTTICGTDLGILKGKNPEIEETALNKFGTFNGRILGHEGVGVIEEAGSSVTKFKKGDKVIISCISRCGSCENCQKQLYSHCQNEGGWIMGYMIDGTQAEYVRVPYADNSLHLLPENLNEDTGVLLSDALPTGHEIGVLNGEIKPGDTVAIVGAGPVGMSCLLTSQLYSPSNIIMVDIDDNRLTMAKGMGAHYTVNSVKEDAINKIMALTQQRGVDCAIEAVGIEPTWNICQSIIKEGGNLANVGVHGKSVKFSIEKLWSKNMTITTGLVNTNTTGLLMNSCCSGRLQTEKLVTHHFKFNDIEKAYDVFKHAANEKAMKVIIEF

SEQ ID NO: 81243 - protein, 347 aa, Deinococcus radiodurans R1
MMTLCFGGGFSRSGAPLSPIYYPAPMPASLPRLALIHTGGTIASRPSPDGRGLTPQTPPALPGLEGVQVSEHQPFNLPSPHVTPAHMQQLAHLIEQLAGGHDAVVVTHGTDTLEETAFFLHLCLPAGLPVVLTGSMRHAEEVSWDGPGNLLDAAQVALCPQTAGRGPLVVFGGDIFDARTVTKVHTSAVDAFGGYPGPIGRIDRTAAGPQVHYFARPEPRPTFRPVTLERRVEILYAYAGWQGEGYAGALERADGLVIAALGTGNLPPELLPLIAATDKPVVLATRTHAGPILPVYGYAGGGATLVEAGAIPASFLNAHKARLLLLVLLNLGASREDIRRVFTQGVF

SEQ ID NO: 81244 - protein, 72 aa, Oryza sativa
  misc_feature (21)..(21): Xaa can be any naturally occurring amino acid
GPSLNREVLKIMPVQKQTRAXSAYSFKAFVAIGDNNGHIGLGVKCSKEVATAIRGAIILAKLSVLPVRRGYW

SEQ ID NO: 81245 - protein, 304 aa, Dracunculus vulgaris
MGGHDSGRSDISFGGRFASSAFAACFAELCTIPLDTAKVRLQLQKKSVAGDGVSLPKYRGMLGTVATIAREEGLSALWKGIVPGLHRQCLFGGLRIGLYEPVKSLYVGEGFVGDVPLSKKILAGLTTGALAITVADPTDLVKVRLQAEGKLPPGIPRRYSGALNAYSTIVKQEGLGALWTGLGPNIARNAIINAAELASYDQVKQTILKIPGFSDNIFTHILAGLGAGFVAVCIGSPVDVVKSRMMGDSTYKSTLDCFIKTFKNDGPLAFYKGFIPNFGRLGSWNVIMFLTLEQVKKVFIKEAP

SEQ ID NO: 81246 - protein, 439 aa, Streptococcus agalactiae NEM316
MKKYDVIVLGFGKAGKTLAAKLATQGKSVAMVEEDDKMYGGTCINIGCIPTKTLLVSASKNHDFQEAMTTRNEVTSRLRAKNFAMLDNKDTVDVYNAKARFISNKVVELTGGADKQELTADVIIINTGAKSVQLPIPGLADSQHVYDSTAIQELAHLPKRLGIIGGGNIGLEFATLYSELGSKVTVIDSQSRIFAREEEELSEMAQDYLEEMGISFKLSADIKSVQNEDEDVVISFEDEKLSFDAVLYATGRKPNTEGLALENTDIKLTERGAIAVDEYCQTSVENIFAVGDVNGGPQFTYISLDDSRIVLNYLNGDKDYSLKNRGAVPTSTFTNPPLATVGLDEKTAKEKGYQVKSNSLLVSAMPRAHVNNDLRGIFKVVVDTETNLILGARLFGAESHELINIITMAMDNKIPYTYFQKQIFTHPTMVENFNDLFNF

SEQ ID NO: 81247 - protein, 389 aa, Triticum aestivum
DVTFDMLVRFFCRGGMVERAIEVLQQMSQHGCTPNTTLCNIVINAMCKQGRVDDAYDFLNNMGMYGCNPDTISYTTVLRGLCRAGRWEHAKELLPEMVRKNCPPNEVTFNTFICILCQKGLIEQAIKLIQLMPEYGCSVGIVTYNALVHGFCVQGRVDSALELFNNLPCEPNTITYTTLLTGLCHTEQLDAAAELLAEMIQKDCPLNAVTFNVLVSFFCQKGFVEEAIELVYQMMEHGCTPNLITFNTLLDGITKDCNSEEALELLHGLVSKGVSLDTITYSSVVDVLSREDRTEEAIQMFHAVQDMGMRPKAGMYNKILFALCKRCETDQAIEFFAYMVSNGCMPNESTYIILIEGLAHEGLLKEAQYVLSELYTKGVLSKSLIEDHQ

SEQ ID NO: 81248 - protein, 217 aa, Sulfolobus solfataricus P2
MVKMAEEVPSLNIEEWKPRTSIGSLVKEGKISSIKELFDRNLPITEPEIVDVLLPKLKYEVVDIKVVQKQTDAGEISRYKVLVIMGNMDGYVSIGTGKAKQLRVAIQKAIRDAKMNIIPVRRGCGSWQCTCGEPHSLPFKVVGKAGSVEVDLLPAPKGTGLVVGSVLKTLLTYAGIKDAWSTTKGETRTTENFVRAGYSALYNTYKFVTLQDWVRKR

SEQ ID NO: 81249 - protein, 332 aa, Xylella fastidiosa 9a5c
MCTSSLITSTETFMTIYNTILDTIGHTPVVKLNRIAPAHVDLYIKVESFNPSGSVKDRLALAIILDAEQQGLLKPGDTIVEATSGNTGVALAMIAAARGYTFVATMVETFSIERRKLMRAYGAKVILTPAAERGSGMVRKAKELAEQHGWFLASQFSNPANPAYHRNTTAAEILRDFAGRRLDHFVSGWGTGGTLTGVGEVLKIARPDITITASEPASAALLQGKEWQPHKIQGWTPDFVPEVLNRSVPHHILSVTDDDAITVARRLAAEEGVFSGISGGATVATALQIAQQAQPGAVILAMLPDTGERYFSTPLFADINEHSDDAWLASLG

SEQ ID NO: 81250 - protein, 246 aa, Legionella pneumophila str. Paris
MDKMIAIVTGGTGGIGSAISQRLADSYQVVACYYKDGRHEEAKKWQDEQKQLGYDIDIVYGDIAQYSDCEKITSLVMERYGRIDVLVNNAGITKDCSLRKMTPQQWQQVLDANLTSVFNMTRNVVPVMLERGYGRIVSISSINGRKGQFGQCNYASTKAALFGFTKSLALEVASKGITVNTVSPGYIETPMLAALKEDVLNSIISSIPVGRLGYPKEIADAVAFLASPDSGFITGANLDVNGGQYM

SEQ ID NO: 81251 - protein, 124 aa, Arabidopsis thaliana
  misc_feature (18)..(18): Xaa can be any naturally occurring amino acid
  misc_feature (32)..(32): Xaa can be any naturally occurring amino acid
  misc_feature (39)..(40): Xaa can be any naturally occurring amino acid
  misc_feature (56)..(56): Xaa can be any naturally occurring amino acid
  misc_feature (67)..(67): Xaa can be any naturally occurring amino acid
  misc_feature (79)..(79): Xaa can be any naturally occurring amino acid
  misc_feature (82)..(82): Xaa can be any naturally occurring amino acid
  misc_feature (86)..(86): Xaa can be any naturally occurring amino acid
  misc_feature (88)..(88): Xaa can be any naturally occurring amino acid
  misc_feature (93)..(93): Xaa can be any naturally occurring amino acid
MASSMLSSATMVASPAQXTMVAPFNGLKSSAXFPATRKXXNDITSITSNGGRVNCXQVWPPIGKKKXETLSYLPDLTDXELXKEVXYXYPQPXGFLCDEPLEHRATFPVLTHHEISPPVIRLLP

SEQ ID NO: 81252 - protein, 349 aa, Bacillus cereus E33L
MLTQEQIMNALKHVEDPELHKSIVELNMVRNIQMNGTEVKLEVVLTIQGCPLKAKIQQDIEESLYAIGASKVDLTFGSMTKEERADLTEKLKKNTRTETGMPNMLRPDSGVQFLTVTSGKGGVGKSTVTINLATALARMGKKVGILDADIYGFSIPAMMETKQKPTMIDQTAIPVISHGVKIMSMGFFTEGNNPVMWRGPMLNKWIQNFLANTHWGELDYLLLDLPPGTGDVAIDVAAMIPQAKEIIVTTPHNVASFVASRVGVMAKHTKHEILGIVENMAYYEEQDGSKNYLFGKGGGEMLAEQLKTEVIAQVPFAKREENNGSSVYDEDSLVGEVFTALAEDIIYKG

SEQ ID NO: 81253 - protein, 450 aa, Streptococcus mutans
MTKQYDYIVIGGGSGGIASANRAAMHGAKVILFEGKQVGGTCVNVGCVPKKVMWYGAQVAETINNYAADYGFDVTTQTFHFDALKQNRQAYIDRIQDSYERGFDSNGVERVYSYATFVDAHTVEVAGEHYTAPHILIATGGHALLPDIPGSEYGITSDGFFELDAIPKRTAVVGAGYIAVEISGVLHALGGETHLFVRRDRPLRKFDKEIVGTLVDEMKKDGPHLHTFSVPKEVIKNTDNSLTLILENGEEYTVDTLIWAIGRAANTKGFNLEVTGVTLDSRGFIATDAFENTNVEGLYALGDVNGKLELTPVAVKAGRQLSERLFNHKPQAKMDYKDVATVIFSHPVIGSIGLSEEVALDQYGEENVTVYRSTFTSMYTAVTSHRQACKMKLVTVGEDEKIVGLHGIGYGVDEMIQGFAVAIKMGATKADFDNTVAIHPTGSEEFVTMR

SEQ ID NO: 81254 - protein, 241 aa, Vibrio sp. Ex25
MLRYNRQIILRQFDFEGQEALKQSSVLILGAGGLGCASSQYLATAGVGNITFIDDDIVELSNLQRQVLHHDADIGRKKVDSAADALRELNPHIEVNTVAKRLDDIQLQALIEQHTVVVDASDNVDTRNQLNRLCFATKTPLISGAAIRMEGQVSVFTYDDPTQPCYQCLSALFGSSALSCVEAGVMAPVVGIVGAVQAMETIKVIANYGQPKKGKILILDAFSMSWREMNLMKMPTCPVCG

SEQ ID NO: 81255 - protein, 459 aa, Xanthomonas campestris pv. campestris str. ATCC 33913
MSDPSAPDHLQRSLSNRHLQLIAIGGAIGTGLFMGSGRTISLAGPSILFVYLIIGVMLFFVMRAMGELLLSNLDYKSFIDFSTDLLGPWAGFFCGWTYWFCWIITAIADVIAIAAYAQFWFPELAPWVPAVLCVLLLLALNLVTVKLFGEMEFWFALIKIIAICALIITGAGLVMWGFRSPSGHVASLSNLWNDGGMFPMGIGGFFAGFQIAVFAFVGIELVGTTAAETADPQRNLPKAINSIPVRILIFYVLALIAIMAVTPWRQVVADKSPFVELFVLAGVPAAASLINFVVLTSATSSANSGIFSTSRMLYGLAEERNAPRGFAKLTRAAVPARGLLFSCICLLLGAMLVYLIPDLVTAFTLVTTLSAVLFMFVWSLILCAYIAYRRKRPEQHAASAFKMPGGVLMCYVCLAFFAFIIVLLTLQPDTLHALLVSPLWFLVLAIAYWVRRNQSPTAR

SEQ ID NO: 81256 - protein, 513 aa, Arabidopsis thaliana
MTHNISVKQNNIQMDSIWILSLLFFIIFLLLAAFKRKNHGKHRRIPSPPGFPIIGNLHQLGELQHQSLWKLSKKYGPVMLLKLGKVPTLILSSSETAKQALRDYDLHCCSRPSLAGGRELSYNNLDMSSSPYNEYWKELRKLCSQELFSANKIQSIQPIKDEEVKKVIDSIAESSSLKNPVNLSKTFLALTTSVVCKAAFGVSFEGSVLNSDRFNKLVRDTFEMLGSFSASDFIPYVGWIIDKFNGLQGWRKKSFRDLDAFYEQIFDLHKEEKEVGSEDLVDVLLRLEKEEIVVGNGKLTRNHIKAILMNILLGGIDTSAITMTWAMAELAKNPRVMKKVQAEIRNQIKNKERISFDDTDKLEYLKMVIKETWRLHPPTPLLLPRDVITEFEINGYTIPAKTRLHVNVWAIGRDPDTWKDPEMFLPERFNDSNIDAKGQNFELLSFGSGRRICPGLYMGTTMVEFGLANMLYHFDWKLPEGMVVEDIDMEEAPGLTVSKKSELVLVPVKYLDH

SEQ ID NO: 81257 - protein, 716 aa, Oryza sativa
MRDRDQDGTTKFYLSIVPLVNRYTTRTGWCNSICHKFFFPQDAGNSSHDNNSSKAAKQANATAARLGSAMAMAGNHRSSQLHLLLLFCCTTTLRAAALSFDYDFSADAAKNLVFMGDAAHAGDRINLTNLGVWRAGRVAHRQLVRLWDDDVGGGRTTTTSFTTAFSFAIGRNSTNQPADGMAFFVGLPRDNLPPHSDGAFFGLLSNNYFGPYGSPRTVGVEFDTFSNPMWDPEGTVDHVGIDVNTVTSKNTTAMPTLSLLAGVMRAEVSYDAAAARMAVTLRTLDGMSYSVEAAVDLRAAGLPQDAAVGFSAATGDLVESHQLLYWSFNSSTDGSVSSTGSPLVSESKKKRIKTYIIASTSSLLGISVLVLAVFLVYKKHKCLLPWQRSTTAPRLHSLLRSQLKSYTYSEVRKMTKSFTHTLGKGGYGTVYKGSLSDGSTIAVKILEDSNNDGEDFINEVSSIGRISHINVVTLLGLCQHGSKRALIYEYMPNGSLDKFAVGGNDTMQQEKFLISWEKLYDILVGVAQGLDYLHHWCNHRVVHLDIKPQNILLDQDFCPKISDFGLAKLCKPKESKISIGCARGTIGYMAPEVFWGHRGAVTTKSDVYSYGMLILHMVGERENINASTESGSKYFPEWLYDNLNQFCGVPSGGIDGSNSTSEVAHKLVIIGFWCIQSAPTDRPSMSEVIDMFDRSLTELQLPPRISCCGNYNESFG

SEQ ID NO: 81258 - protein, 304 aa, Erythrobacter sp. NAP1
MALASVENDVLGDALKRVQGEIDSVFDAFLPVPHDTSARLVEAMRYAAMGGGKRVRPLLLVSTAELYGVDRTAALCAAAAVEAIHVYSLIHDDLPCMDDDDLRHGKPTVHKVYDDATAVLAGDALHALAFEILADSQTSADPFVRSELIATLGKASGMGGMAGGQMMDMVADEEGVEYDLRTITRLQQLKTGALLAASVEMGAILGKVAPEGRAHLRAYSRDIGLAFQIADDLLDVEGDADKAGKALRKDDEQGKQTFVTLMGVDKAREQARALVDQAVAHLSSHGSEADTLRALARFIVERDR

SEQ ID NO: 81259 - protein, 357 aa, Deinococcus radiodurans R1
MRPMKHFTPQDPTPRDLGFAMPPEWAPHEATWMGYPADDELWFGHLAGVRDEYAGLVRTIARFERVELLVRDEESERDARARLTGHNVRFHRVPLDDSWLRDSGPLFVTRGEKDPEVALVNWRFNAWGGKFEWENDNRVPEYVAQFLGMGHWDRPEVLEGGGLEIAGDGAALTTRSCFLTDTRNPGLSEEGYTFLLSDQLGVKKLHWLDGGLENDHTDGHIDTITRFAAENVIVTSVEADPNDANHAVMQRNLATLRELRTPGGDFYQIVELPLPAHRLEGAEGRLPPTYANFYIGNGFVVVPQYGDPNDKQALDVLRPLFPGREVIGVPSRKIIEGGGSFHCLTQQQPAGRVWSGE

SEQ ID NO: 81260 - protein, 130 aa, Marinobacter sp. ELB17
MDDNFGNLKVMVIDDSKTIRRTAETLLKKVGCDVITATDGFDALAKIADSKPDIIFVDIMMPRLDGYQTCALIKNNSTFKNTPVIMLSSKDGLFDKAKGRIVGSDQYLTKPFSKDELLNTIRHFVPQAQH

SEQ ID NO: 81261 - protein, 496 aa, Haloferax volcanii
MALKEFKLPDVGEGVAEGELVTWHVAPGDEVTEDQVLAEVETDKALVDVPSPFDGTVKELLAEEGEVVPVGDVIITIQEDGDDEEAAEAADADAEAAGSESAEGDDGASDDESGSGGRVFAPPSVRRLARELGVDLDAVDGSGPSGRVTEGDVRAAADDDGDEDDEPSGPRTVQTNGKSATAKRDEGTSASASSSAPTESADREQTLAAPATRALAKEEGVDIDAVPATEMRDGEAFVSPEAVQEYAQAQREAQAADAEAVSAEADAGTATAEATVDAASEPAPPEAGPGAGERVPYKGVRKAIGDQMQRSKYTAPHVTHHDEVDVTELVELREQLKPVAEERGSRLTYMPFVMKAVVAALKGFPYLNSQLDEENEEIVLRDEYNIGVAAATDAGLLVPVVHDADRKGMLELADEMNEKVEKARNRKIAPEEMRGGTFTITNVGGIGGEYATPIINYPEVAILALGAIKEKPRVVDGEVVPRNVLTLSLSFDHRVV

SEQ ID NO: 81262 - protein, 250 aa, Philodendron bipinnatifidum
MGGHDSGRSDISFGGRFASSAFAACFAELCTIPLDTAKVRLQLQKKSVAGDGVSLPKYRGMLGTVATIAREEGLSALWKGIVPGLHRQCLFGGLRIGLYEPVKSFYVGEGFVGDVPLSKKILAGLTAGALAITVANPTDLVKVRLQAEGKLSPGIPRRYSGALNAYSTIVKQEGLGALWTGLGPNIARNAIINAAELASYDQVKQTILKIPGFSDNIFTHILAGLGAGFVAVCIGSPVDVVNRNSIVSPK

SEQ ID NO: 81263 - protein, 501 aa, Escherichia coli CFT073
METKDLIVIGGGINGAGIAADAAGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGLRFGANSVLKPEIKRGFEYSDCWVDDARLVLANAQMVVRKGGEVLTRTRATSARRENGLWIVEAEDIDTGKKYTWQARGLVNATGPWVKQFFDDGMHLPSPYGIRLIKGSHIVVPRVHTQKQAYILQNEDKRIVFVIPWMDEFSIIGTTDVEYKGDPKAVKIEESEINYLLKVYNTHFKKQLNRDDIVWTYSGVRPLCDDESDSPQAITRDYTLDIHDEDGKAPLLSVFGGKLTTYRKLAEHALEKLTPYYQGIGPAWTKESVLPGGAIEGDRDDYAARLRRRYPFLTESLARHYARTYGSNSELLLGNAGAISDLGEDFGHEFYEAELKYLVDHEWVRRADDALWRRTKQGMWLNADQQSRVSQWLVEYTQQRLSLAS

SEQ ID NO: 81264 - protein, 303 aa, Streptococcus agalactiae NEM316
MSNIVIIGSISMDLVMETNRIAKEGETVFGQRFSMVPGGKGANQAVAIGRLSQDRDNITILGAIGEDSFGPILLDNLNKNHVTTDFVGTIPSSSGVAQITLYNNDNRIIYCPGANGKVDTKKWSQEWSIIKEADLVVLQNEIPHQANMKIANFCKEHSIKLLYNPAPSRKTDIEMLDKVDYFTPNEHECQELFPNQKLEDILATYPEKLIVTLGTKGAIYSDGKESHLIPALETKAVDTTGAGDTFNGAFGYAISKKFKIANALRFATLAAHLSVQKFGAQGGMPTIKEMEDNQHYEKDWHIK

SEQ ID NO: 81265 - protein, 425 aa, Physcomitrella patens subsp. patens
MAFRAPGSPESLLRRALSVVNHVCLSGRDHFVAPSLILPPGFSSGPGPGPGPTGLLTSPAAAALQFPKQGADKSVCSREFSSSGGSIKATLFPGDGIGPEIAESVKKIFDAVKVQVEWDVHFVGKTVDPKTGSYITWDSMESVRQCGIGLKGPMATPIGKGHKSLNLTLRKELGLYANVRPCLSIPGYKTRYDNVDLITIRENTEGEYSGLEHQVVKGVVESLKIITHNASKRIAEYAFHYAKLHGRKRVSAIHKANIMKKTDGLFLQASELYPCCREVAEKYSDIVYEEVIIDNCCMMLVKNPGLFDVLVMPNLYGDIISDLCAGLIGGLGLTPSGNIGDKGLALMEAVHGTAPDIAGKNLANPTAILLSAVMMLQHLKLDESAELIHKSVLKTIAEEKCLTGDLGGSATCSDYTKAIIDNLGG

SEQ ID NO: 81266 - protein, 226 aa, Zea mays
  misc_feature (126)..(126): Xaa can be any naturally occurring amino acid
MASFSSLSASSSTSTPSFNLPAKTSAGTGSLSFHRARESQKSRARMVTVRAEAVDTTISPRVNALRPSKTMAITDQATALRQAGVPVIGLAAGEPDFDTPAVIAEAGINAIRDGATRYTPNAGTQXLELRKAICKKLEEENGLSYSADQVLVSNGAKQCITQAVLAVCSPGDEVLIPAPYWVSYPEMARLAGATPVILPTSISDNYLLRPESLASVINENSRILIL

SEQ ID NO: 81267 - protein, 308 aa, Zea mays
  misc_feature (66)..(66): Xaa can be any naturally occurring amino acid
  misc_feature (97)..(97): Xaa can be any naturally occurring amino acid
  misc_feature (146)..(146): Xaa can be any naturally occurring amino acid
SKRFAKGILYRIRMPGIATMKLATAPGSHVAGFVPEAKGVPASVQIFSCNKDAQNQVVARRSFFRXSTVQLQWNKGSTGLLILAQADVDKTNQSYYXETKLNYLTTDRAFEGIVPLKKDGPVHDVQWSSSGSEFAVVYGVMPPKAXYSTRSATLLLSLAFWDYSEKKLVAKTKAECSVTSEWSPDGRHFMTATTAPRLQIDNCIKIFDHNGSLQFKKMFERLYQADWKPEAAERFTDIADLTTSLSTLKIEETKKQVSAQGSKSAQTSSKAPAITAPKPTAYRPPHAKGSAELQDKLFGGLAPAGRQQ

SEQ ID NO: 81268 - protein, 534 aa, Zea mays
MYMPPPPPTGGAGEQPRLYQVWRGSNYNHPLLLLFLTKTGGDEDSPTFYTFSLIIHLALSETDPCVYWGMNSFLAIDSIFMNGGSMEFFLQGRFIFGPDVRSVFLTMILIIAPVVVFCLFVARHLINDFPDSWGISVMVVVVVFTIYDLTLLLCTSGRDPGIIPRNSHPPEPESIDGINDTGVQTPQQFRLPRTKEVLVNGISVRVKYCDTCMLYRPPRCSHCSICNNCVERFDHHCPWVGQCIGLRNYRFFYMFVFSTTLLCLYVFAFCWVYVIKIRAAEQSSVWKALLKTPASVALIIYCFLCVWFVGGLSVFHLYLMSTNQTTYENFRYRYDRRDNPYNKGVLNNFLEIFCTAIPPSKNNFRARVTAGQGLQQTRSQSRGFMSPSMGKPIGDLEMDRKPVAPWDEPRTAADIRDLEAGLGVMFDEKEGRVAHASPDLSRDLPAEFVEGRSGMHSRQSSWVQRGDAIEASAVQMANARTTEASNNVAWSGSNGCCAWFATPALRALGTRKWHLGTPLPCKLVLGMWTWYLLV

SEQ ID NO: 81269 - protein, 283 aa, Zea mays
TIEQVCTKKQAGTGPEFPGSTVHWAAAQELDEEDFSYRRNAGNGPARWGLIRREWATCNVGLLQSPIGLSDTLAGLADRSGRLGRSYRPAAASLVNRGHSIMVRFNSTPGGVVIDGVAYRLRQMQRHAPSEHAINGRRYALELQMVHQSDTNRYAVVSQLYRISRRRPDRTIHRLERYIRRIIARRKNHEELIDEEVDPRRPVSRSTAYYKYTGSFTTPPCTEGVTWVVAHQTRRVTRRQVRLLRNAVHDGTRSNRRPLQEANGRAITFYYTSPAHGRGANGD

SEQ ID NO: 81270 - protein, 744 aa, Shewanella sp. MR-7
MLNTLRDITQAVASAHSLETALEVLVSSTKAAMETQCCSVYILDQQELVLSATDGLEKSAVGRVRMPLTQGLVGLAAEREEAVNLADARLHPRFKLFPEVAEEEYRAFLAVPIIYQKAVVGVIVVQQASARQFSEGEEAFLMTLAAQLAMAIRGLKQKAQVSSLHQQILFQGTSASSGIAIAHALVLGGEISLEQPDVRCEDIALESSRLVAAMGRCKEAIGALSQRFDREQDEEVASIFNALQLLLDDASLGGEYAREVQQGWEAESAVSRVSLRYIQQFLAMEDPYLKERASDIRDLGQKVLRQLIEPERLELEPDKPVILVTREADATLLAEFPRQKLAGIVTELGGVNSHAAILARALGVPAITGVEQLLSADIDQKLLVVNASRGQLMVSPSPAIVSEYRSLISAQKALQRQYAQELALPSVMLDGARIRLYLNAGLLSGVASEIAEGADGIGLYRTEIPFMLQQRFPSESEQVKVYQQVLSAASGRPVVMRTLDVGGDKPLPYFPIKEDNPFLGWRGIRLSLDHPELFLVQLRAMLQAGGEGKQLSILLPMVSNLDEIDQSLAYLEQAYVELKNDVNSQIEMPRIGIMLEVPALLYQLDEVAKRVDFVSVGSNDLTQYLLAVDRNNPRVSSLFDSYHPGILRALHQARLDCDYHQLDISICGELAGEPMGAILLVAMGYQHLSMNQGSLARINYLLRRVSRADLTQLLAQALSLSNGFQVRELVKEYLTQQGLATILN

SEQ ID NO: 81271 - protein, 89 aa, Triticum turgidum subsp. durum
SRPHSVNEAEAADNTRSADIDRRILQETKADQHVHKLLLLGAGESGKSTIFKQIKLLFRTGFDEAELKGYMPVIHANVFQTIKILYDGA

SEQ ID NO: 81272 - protein, 92 aa, Triticum turgidum subsp. durum
IRPHSVNEAEAADNTRSADIDRRILQETKADQHVHKLLLLGAGESGKSTIFKQIKLLFRTGFDEAELKGYMPVIHANVFQTIKVCQYWERIL

SEQ ID NO: 81273 - protein, 325 aa, Pseudomonas aeruginosa UCBPP-PA14
MAKRIQFAAYGGPEVLEYRDYQPAEPGPREVRVRNRAIGLNFIDTYYRSGLYPAPGFPSGLGSEGAGEVEAVGSEVTRFKVGDRVAYATGPLGAYSELHVLAEEKLVHLPDGIDFEQAAAVMLKGLTTQYLLRQTYELRGGETILFHAAAGGVGLFACQWAKALGVQLIGTVSSPEKARLARQHGAWETIDYSHENVARRVLELTDGKKCPVVYDSVGKDTWETSLDCVAPRGLLVSFGNASGPVTGVNLGILSQKGSLYVTRPTLGSYADTPEKLQAMADELFGLIERGDIRIEINQRFALAEAARAHTELAARRTTGSTVLLP

SEQ ID NO: 81274 - protein, 178 aa, Legionella pneumophila str. Paris
MNYSTRKFEDKYPELGERVYIDPQSTVIGNVTLGDDVSVWPMAVIRGDVNYIQIGHSCSIQDGAVLHVTHDGPYTPGGRPLILGQGITVGHKALLHACTIDDYCLIGMGSIILDSAHIQKHAMIAAGSIVPPGKILKSGHLYLGSPAQAVRKLTTKEIEQIEYSAGHYIRLKNKYLTY

SEQ ID NO: 81275 - protein, 452 aa, Legionella pneumophila str. Paris
MKTKHFDLIVLGGGSGGIASAVRAAQYGAKVAVIEQNHLGGTCVNLGCVPKKIMYNASSIAETLHKSPDYGFFLENNAKLDWKRLVNKRNAYIERLRENYAKRFSQHKITLIQGKGIFHDQSSITIDHTIYQAEHIIIATGGEPALPAINGIKHAIDSDGFFSLTKLPAKVAVIGSGYIGVELAGILNSLGSETHLLMRGTRPLSRFDHMIGDTLMEIMQKQGICIHQNHKAQAIHLHSDGRKSILCQSGSIIENIDVIISAVGRKPRTGNLNLDKINVNMDDKGLILVDAFQNTSVKGIYAIGDVTNTPALTPVAIAAGRRLADRIFGNQPDACLNYDNICSVVFSHPPSGSVGLTEHEAIEKYGKSKIKIYQTRFIPMYDALSVDKTPTAMKLVTLGKKEKIIGLHVVGYSADEMLQGFGVAIKMGACKKDFDNTIAIHPTSAEEFVTMV

SEQ ID NO: 81276 - protein, 434 aa, Bacillus cereus E33L
MVKFIFFRWIRSSIHLADCIRVILEERKCNRSACLHFSWSKLIYVHSSFLSKSVRYTYSCLPDFFCVYRLYLRKHGCCEEKQYRLDEKRSPYRTAFFRINLFFLFCNPVNIHKLITIEGMELRAMKKVLFLGDPGIDDSLAIMYGLLHPDIDIVGVVTGYGNVTQEKATSNAAYLLQLAGREDIPIINGAKIPLSGDITTYYPEIHGAEGLGPIRPPKNLSPNIRPFCEFFDILEKYKGELIIVDAGRSTTLATAFILEKPLMKYVKEYYIMGGAFLMPGNVTPVAEANFHGDPIASQLVMQNAKNVTLVPLNVTSEAIITPEMVKYITKHSKTSFNKLIEPIFTYYYKAYRKLNPKITGSPVHDVVTMMVAANPSILDYVYRRVDVDTVGIAKGESIADFRPQPDAKALKNWVRIGWSLHYKKFLEDFVKIMT

SEQ ID NO: 81277 - protein, 517 aa, Pseudomonas aeruginosa UCBPP-PA14
MWTRLLPFLAWLPGLRRGTLRREAWVGLNGAILALPQSMAYALIAGLPAEYGLYAAMLPVAIACLWGSSRYLVSGPTAAISVLLFSSVAPLAPLGSPQYVQAVLLLTFLAGAFQWLLGVLRVGSLVNFVSHSVMLGFTLGAALLIVLGQLPYLLGLAASGEGAAPGNGWRLLARFAEFDGPSLLVGGFSFALSLLVRRLRPRWPALLLGLLGGATLVWALPGTFASVAHVQALSSALPGWNPLVFDSRSILDLLPAAVACGMLGLVTSLSIARALAARQGDAFDANQEVRAQGLSNLLGPWLSASLSAGSFTRSGLNLEAGARSPLAGAFSALWVALLAVLGARLIEHVPLPAMAAGILLIAWGLIDRPALRALYRSGRAECLVAGLTALATLLLPLQNAIYAGVLASLFFYLRRTSTPRVLRQRNDEEEVLRIEGSIFFGACDYLQRLMRQCDRPRLVLDARQVNFIDFAGAVLLQQEARRLHAEGRRLVLRHARPQVREALGRQADEGCRLHYEG

SEQ ID NO: 81278 - protein, 331 aa, Triticum aestivum
  misc_feature (102)..(102): Xaa can be any naturally occurring amino acid
  misc_feature (113)..(113): Xaa can be any naturally occurring amino acid
DGNCFSADPEHQHEANYCQQPYEGRRSGKDFGLVVTIVGIVLIVLVLSLLLVASNKRNCQRVTAEQQLLQKQMQDNSTPGMSSELLESARYISQAVKFGSQXMPTHRVFSLEXLKEATKCFERSAFLGEGSIGKLYKGKLENGTVIAIRCLALHQRYSIRNLKLRLHLLAKLRHPNLVCLLGHCIDNAVDESSVKRVFLVYEYVPNGTLSSYLSGSTPEKTLKWCDRLHVLIGIARAVHFLHTGIIPGSLYNRMKTSNILLDEHHIAKLSDYGLSMITEEIYKHEAIGEGQTYIQNNAEELQTLHDDVCSFRCIILEALMGSTLHRKGDPF

SEQ ID NO: 81279 - protein, 1381 aa, Oryza sativa Indica Group
MPSLYIFLGLLLFSLQAPPCPAATDTLKTGQVLSAGDKLVSRNGKFTLGFFNPSANISKSSDNISSSWYIGIWFNKIPVFTVVWVANRERSIAEPDLKLTQLKISQDGNLAIVNHANESIIWSTRIVNRTEASMNTSVLLHDSGNLVIQSTSNAVLWQSFDYPTDVALPNAKIGWNKVTGLNRVGVSKKSLIDMGTGSYSVQLYTNGTRRVTLEHRNPSIEYWYWSPDESGMKIPALKQLLYMNPQTRGLVTPAYVNSSEEEYYSYNSSDESSSTFLLLDINGQIKFNVWSQDKHSWQSLYTQPVDPCRSYDTCGPFTICNGNSQPFCDCMENFTRKSPRDWDLGDRTGGCSRNSPLDCTRNTSSTDIFHPLIHVTLPRNPQTIQEATTQSECAQACLSSCSCTAYSYQNTSTCSIWHDELFSVNQDDGIEIHSQDVLYLRLAAKDLQSLRNNKRKPNVAVVIAASVIGFVLLMVGVFLLIWRNRFEWCGAPLHDGEDSSGIKAFRYNDLVHATKNFSEKLGAGGFGSVFKGMLIDLTTIAVKRLDGDRQGEKQFRAEVSSIGLIQHINLVKLIGFCCEGRKRLLVYEHMLNGSLDAHLFQSNAGTLNWSIRYHIALGVARGLAYLHQSCHECIIHCDIKPQNILLDASFAPKIADFGMAAFVGRDFSRILTTFRGTVGYLAPEWISGVAVTPKVDVYSFGMVLLEIISGRRNSPNEYTSDNYHVSYFPVQAINKLHEGDVRNLVDPQLCDDFSLEEAERVCKVACWCIQDDEHDRPTMSEVVRVLEDTFGKYASTRNMCIFSTVLEKKKYVYVYLMEALKCILKLKEVHCNSVRILGDLDARIYIPVLMRLSTYTPTINREARHTIEDTIEESNLAWYKRYSPSDHSLSSYSLSQLQLQRKLPAILVSMRPQSYAFLGLVLLLFSLLPLAPCSAANLNNDTLLAGQALAVGDKLISNNGKFTLGFFQPDAGTNVVLPGAKFGWNKITGLNRQCISKKSLIDPGLGSYSVELDTNGTKGVILMLRNPPKVYWYGLTSPTLIPELRSLLAMDPRTRGLIIPTYVDNSQEEYYMYTLSNESSSSFLSLDMSGQIMLNVWSEANQSWQIIYAQPADPCNPFATCGPFTICNGNSNPVCECMESFTRKSSQDWDLGDRTGGCSRNTPLDCTISGNRTSSADMFHPIAHVKLPYDSESIQDATTQSKCAQACLSSCSCTAYSYQNNICSVWHGDLFSVNQNDGIENHFDDVLYLRLAAKDLQSLSKNKRKPIVGVVTTISIISLVLLIMLMVLVMVWRNRFKWCAISKLHEGDVQSLVDPRLSGDFNLEEAERVCKVACWCIQDNEFDRPTMGEVVLVLEGLQEFDMPPMPRLLAAITRSSNVAEM

SEQ ID NO: 81280 - protein, 361 aa, Oryza sativa Indica Group
MTPAADGDDDETTCIRALELIFTFVVPMTLKATIKLGLLDALTGGGHALTADELAAAAQLPAEAASSVDRMLRLLASLDVVKCAPTDTGGEAAVRRYTPAPVCRWFAGERSLAPLAMFLLDDDYLSTWNQLPAAVAGGDGQVAFEKARGMPMFEYMGTNRRLNTLFNQAMVQQSTVVIGKLLERFQGFDGVSVLVDVGGGTGATLEMITSRYKNITGVNFDLPHVIAQAPSLPGVKHIAGNMFESVPNGDAIFLKSMLHLHNDEDCIKILKKCHQALTHNGKVIAVEILLPAIPEPVPTAQNPFRMDMIMLNNHWGGKERTEPEFAKLAVECGYTGVFQATYIFANYWALEFSQVVLSKSC

SEQ ID NO: 81281 - protein, 158 aa, Arabidopsis thaliana
MAEQQDHHKELQLLPSPPSTESPVRKHRPTVITTDHHNNHHRSSSMIHHDLDLKLSISLSSISTAEELPNGGVEALKWQAAEQIRLAAIEKAYAERVRELTRREMEMAQSEFARARVMWQKAREEVERAERLKERSMTKIDTACLEITCHSCRQRFRP

SEQ ID NO: 81282 - protein, 580 aa, Pseudomonas aeruginosa UCBPP-PA14
MDAVTVNNFFLIGAVLVGMSILVSSLSSRLGIPILVIFLAVGMIAGNDGVGGIVFDNYPVAYLVGNLALAVILLDGGLRTRVSSFRVALWPALSLATLGVLVTTGLTGIAAAWLFDLHWMEGLLIGAIVGSTDAAAVFSLLGGKGLNERVTATLEIESGSNDPMAVFLTVTLIEMLASGQTGLSWGFVLHLVQQFGLGALLGLGGGWLLLQLINRMHLAGGLYPLLVISGGLLVFALANAVGGSGILAIYLCGLLLGNRPIRSRHGILHMLDGMAWLAQIGMFLVLGLLVTPHDLWPIALPALALALWMILVARPLSVLIGLIPFRAFHDREKAFIAWVGLRGAVPIILAVFPLMAGLPNAQLFFNVAFFIVLVSLLVQGTSLPWAARLLRVVVPPDPAPISRAGLEIHPTSEWELFVYHLNKEKWCIGAALRELKMPGGTRIAALFRGTELLHPSGSTILEADDILCVIGHEHDLPALGKLFSQAPDRGLGARFFGDFVLEGDAQLSAVASLYGLKLDGIDGEQALGRFIAHEIGGEAVIGDQVEWNGLTWTVAALEGNRIRKVGVKFPEGRPGPGLFL

SEQ ID NO: 81283 - protein, 467 aa, Deinococcus radiodurans R1
MTNNFDYDVLVIGAGPGGYHAAIRASQLGLKTACVERGAVGGVCLNIGCIPTKALLHAAETMQASKHAAEFGLTFSGQALDIARLNGWKDSIVKKLTGGVSGLFKANKVTLLTGQASFVDDHTVQVGDKTYTAANIIIATGSDPAKLPGLEVDQQQIVDSTGALVMPDPVPARMLCVGGGVIGFEFAQVYNNLGSQVKIIEFLPSVIPGADADAVKEFSKIMSRQGIEIVTQMKANRAEKKSDGVHVELENVKTGEKTTEVFDRVLVAVGRRPRTDGLNPEQAGVTVTERGFIPADKQQRTNVPHIFSIGDVAGNPMLAHKAMKEGLVAAEVIAGKPAEQDAVAIPGVVYTNPELAWVGLTEAEAQEKGYEVKTGVFPMSASGRAMTLQATEGFVKMVVEKDTDLLLGVHIVAPHASDMLAEAGLALEMAATATDISLTIHAHPTLGESILEAAEASHKQAIHIVNR

SEQ ID NO: 81284 - protein, 224 aa, Triticum aestivum
MAPSQQVAATKEPSANGTAAPAPKTKTPALNERILSSITRRSVAAHPWHDLEIGPDAPTIFNCVIEIPKGSKVKYELDKKTGLIKVDRVLYSSVVYPHNYGFIPRTLCDDSDPIDVLVIMQEPVVPGCFLRAKAIGLMPMIDQGEADDKIIAVCADDPEYRHFNDIKDLPPHRLAEIRRFFEDYKKNENKEVAVNDFLPSEDAYEAIQHSMDLYATYICEGLRR

SEQ ID NO: 81285 - protein, 473 aa, Sinorhizobium meliloti 1021
MWTTLPPGASISPEVVMNKHFDAVIIGAGQAGPSLAGRLSGVGKTVALIERKLFGGTCVNTGCMPTKAMVASAYAIHTARRGAEYGMTTGPVSVDFGRVMARKEKVRLDARSGVEKWLKGMKNCTVFEGHARFEGPREVRIGDELISGERIFVNVGGRAAVADLPGVNDVPYLTNSSIMDLAELPEHLVVVGGSYIGLEFAQMFRRFGSDVTVIEKGARLIGREDPEVSDAIREILENEGVRIRTNAECIRFSNHADSVAVGVDCTSGEPEVSGSHVLLATGRHPNTDDLGLDKAGVKTDERGYIEVDDSLRTNVPHIFAMGDCNGRGAFTHTSYNDFEIVAANLIDNDPRRVSDRIQTYALYIDPPLGRAGMTETEARKKGHKLLVGTRPMTRVGRAVEKGETQGFMKVIVDAETDEILGASILGTGGDEAVQSILDVMYAKKPYTMIARAVHIHPTVSELIPTVFGDLSSA

SEQ ID NO: 81286 - protein, 253 aa, Geobacillus stearothermophilus
MRKPIIAGNWKMHKTLAEAVQFVEDVKGHVPPADEVISVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQQQIDGPLVGGASLEPASFLQLVEAGRHE

SEQ ID NO: 81287 - protein, 309 aa, Arabidopsis thaliana
MADLLPPLTAAQVDAKTKVDEKVDYSNLPSPVPYEELHREALMSLKSDNFEGLRFDFTRALNQKFSLSHSVMMGPTEVPAQSPETTIKIPTAHYEFGANYYDPKLLLIGRVMTDGRLNARLKADLTDKLVVKANALITNEEHMSQAMFNFDYMGSDYRAQLQLGQSALIGATYIQSVTNHLSLGGEIFWAGVPRKSGIGYAARYETDKMVASGQVASTGAVVMNYVQKISDKVSLATDFMYNYFSRDVTASVGYDYMLRQARVRGKIDSNGVASALLEERLSMGLNFLLSAELDHKKKDYKFGFGLTVG

SEQ ID NO: 81288 - protein, 253 aa, Coptis japonica
MGRKFFVGGNWKCNGTSEEVKKIVTLLNEAEVPSEDVVEVVVSPPYVFLPFVKNLLRADFHVAAQNCWVKKGGAFTGEVSAEMLVNLGIPWVILGHSERRALLNESNEFVGDKTAYALSQGLKVIACVGETLEQREAGSTISVVAAQTKAIAEKVSDWTNIVVAYEPVWAIGTGKVASPAQAQEVHFELRKWIKENVGADVAGSVRIIYGGSVNGANSKELAGQPDIDGFLVGGASLKPEFVDIIKSATVKSS

SEQ ID NO: 81289 - protein, 331 aa, Arabidopsis thaliana
MPKPLVDFGNKPMILHQIEALKGAGVTEVVLAINHQQPEVMLNFVKEYEKKLEIKITFSQETEPLGTAGPLALARDKLVDESGQPFFVLNSDVICEYPLLEMIEFHKTNRAEASIMVTEVDDPSKYGVVVTEEGTARVESFVEKPKHFVGNKINAGIYLLSPSVLDRIELRRTSIEKEIFPKIASEKKLYAMVLPGFWMDIGQPKDYITGQRMYLNSLREKTPQELATGDNIIGNVLVHESAVIGEGCLIGPDVVIGPGCVIDSGVRLFGCTVMRGVWIKEHACISNSIVGWDSTVGRWARVFNITVLGKDVNVADAEVYNSGVVIEEQGL

SEQ ID NO: 81290 - protein, 468 aa, Shewanella sp. MR-7
MSNDFQFIEVGRKDPTKHPAAKRSTQFIEIYQPFAQAQVTEQADRCLDCGNPYCEWKCPLHNYIPNWLKLAQQGRIMEAADLVHETNTLPEICGRVCPQDRLCEGACTLNADFGAVTIGNVEKYITDTAIAQGWRPDMSKVTPRKEKVAIVGAGPAGLGCADILARNGVKAVVFDKYPQIGGLLTYGIPAFKLDKAVMATRRTVLEGMGIEFKLGVTVGKDVAFNQLLEEYDAVFLGMGTYTAMKAGLEGEDAQGVYQALPYLIGNTHHLMGSSNPDTPYLNLAGKRVVVLGGGDTAMDCVRTAVRQGASSVICAYRRDEANIPGSRREVQNAREEGVNFLFNRQPVAIKTQDGKVVGVECVETQMGKADASGRQRAEAIEGSEQLLDADAVIIAFGFQPSPAPWFADYGIELDQWGRVKASKQADNPFQTTNPKVFAGGDMVRGSDLVVTAIAEGRDAAQGILNYLD

SEQ ID NO: 81291 - protein, 572 aa, Nocardia farcinica IFM 10152
MTSSTDAGPTVQSKPTRARTGKPVRRKSEGQWALGYREPLNPNEQNKKDDNPLNVRARIENIYAVNGFDSIDKSDLRGRFRWWGLYTQREQGYDGTFTGDENIDLLEAKYFMMRVRCDGGALNVAQLRTLGGISTEFARDTADLSDRENLQYHWIEIENVPEIWRRLEEVGLQTTEACGDCPRVVLGSPLAGESLDEVIDPTPAIQEIVRRYIGDKRYSNLPRKFKTAISGQQDVVHEINDVAFVGVVHPEHGPGLDLWVGGGLSTNPMLAQRVGAWVPLDEVPDVWEAVVALYRDYGYRRLRTKARLKFLIKDWGVEKFREVLEEKYLKRKLIDGPAPEKPVRPIDHVGVQRLRNGLNAVGFSPIAGRVSGTVLTQVADAVERIGSDRIRFTPYQKLIVLDVADDKVEQLIAELEPLGLQARPSAWRRNLLACSGIEFCKLSFVETRKRSQVLAPELEQRLADINAELDVPITVNINGCPNSCGRSQIADIGFKGQLVDDGNGNQVEGFQVHLGGSLGLDSGFGRKLRQHKVTSAELGDYIERVVRNFVKNRDGGERFAQWAVRADEADLR

SEQ ID NO: 81292 - protein, 76 aa, Triticum aestivum
MKFFSAFDPWPVFFRREWGRTWPFLAGFAVTGTLITKMTAGFTEEDLKELQSSSKAHKNKVPRRPGRPAPGQKGAS

SEQ ID NO: 81293 - protein, 155 aa, Xylella fastidiosa 9a5c
MNVAFDLTPPSPSQREALIATLNAEEHRILLQHGTEAPFCNRLLDNNQLGTYTCRFCGLPLFHSNAKFKSGTGWPSFFEPYTHAHIRKQHDTSHGMIRTEILCARCNSHLGHLFPDGPPPTYERYCLNSVSLTFIPTGTLLPDQLHRGDNTAYRT

SEQ ID NO: 81294 - protein, 210 aa, Glycine max
  misc_feature (91)..(91): Xaa can be any naturally occurring amino acid
  misc_feature (190)..(190): Xaa can be any naturally occurring amino acid
  misc_feature (196)..(196): Xaa can be any naturally occurring amino acid
MDYFNAPGRNHLFVPGPVNIPDQIIRAMNRNNEDYRSPAIPAMTKTLLEDVKKIFKTITGIPFLIPTTGTGAWESALTNTLSPGDRIVSFXIGQFSLLWIDQQQRLKFNVDVVESEWGQGAKLDVLESKIASDTSHTIKAICIVHNETATGVTNDLAKVRQILDSYRHPALLIVDGVSSICALDFRMDEXWGVDVXAITGSQKALSLPTG

SEQ ID NO: 81295 - protein, 548 aa, Mycobacterium bovis AF2122/97
MTSVTDRSAHSAERSTEHTIDIHTTAGKLAELHKRREESLHPVGEDAVEKVHAKGKLTARERIYALLDEDSFVELDALAKHRSTNFNLGEKRPLGDGVVTGYGTIDGRDVCIFSQDATVFGGSLGEVYGEKIVKVQELAIKTGRPLIGINDGAGARIQEGVVSLGLYSRIFRNNILASGVIPQISLIMGAAAGGHVYSPALTDFVIMVDQTSQMFITGPDVIKTVTGEEVTMEELGGAHTHMAKSGTAHYAASGEQDAFDYVRELLSYLPPNNSTDAPRYQAAAPTGPIEENLTDEDLELDTLIPDSPNQPYDMHEVITRLLDDEFLEIQAGYAQNIVVGFGRIDGRPVGIVANQPTHFAGCLDINASEKAARFVRTCDCFNIPIVMLVDVPGFLPGTDQEYNGIIRRGAKLLYAYGEATVPKITVITRKAYGGAYCVMGSKDMGCDANLAWPTAQIAVMGASGAVGFVYRQQLAEAAANGEDIDKLRLRLQQEYEDTLVNPYVAAERGYVDAVIPPSHTRGYIGTALRLLERKIAQLPPKKHGNVPL

SEQ ID NO: 81296 - protein, 336 aa, Sulfolobus solfataricus P2
MTFRVAVIPGDGIGPELYEGSKRIIAKLIEKYNLDIDLIEVEAGDVALNKYGEALPRHTLDVIEKADMILKGPVGETAMDVVVKLRQMYDMYANIRPAKSLPNVQSKYPNVDLVIVRENTEDLYKGFEFVTSTGVTIAIKVTTEFASKRIVNVALNYALMRRRKVTCVHKANVMRVTDGLFASVCREILKGKVNFEEMYVDAAAANLVRDPTRFDVIVTSNVYGDILSDEASQIAGSLGLAPSANIGDRKSMFEPVHGAAFDIAGKGIANPTAFLLSVSMMLSRMYELSKENKYILASKSLENAIIETYKSGNKLTEDVGGSAKLKDMVDEIYKYM

SEQ ID NO: 81297 - protein, 456 aa, Zea mays
  misc_feature (79)..(79): Xaa can be any naturally occurring amino acid
VSFCSSKLKGEARVSLRQTSEAATVLSPQHSRRPPRRRREWRPALRSLAALRITSLDDDDEETEIPHQPPQAGLSPRWXADYEDDDDEEEEAEVTLGVLSKPKHPGFLLRHLFPSKAGGIPAWLDPVNLPSGKSSYCGFCGEPLQFVLQIYAPIEDNVAAFHRTLFMFMCPSMACLLRDQHEQWKHKYGNPCRSVKIFRCQLPRNNAFYSAQPPKHDGSDKPLCPGAPVCHWCGTWKGDKICSSCKKARYCSEKHQALHWRTGHKNDCLQIISSAASNSVLPAVGIVPASISWPEFEIKIDYEGTFDSDSGDENNSKSLVMQRHGKPDAMMQSWMDHFEADADNKCWASFQERVSRAPNQVLRYCREPNAKPLWALSFGCPSDADIPSCSYCRGPLCYEFQVMPQLLYFFGVGNQPDSLDWATIVVYTCQGSCDQTVSYKEEFAWVQLYPTTTTRQ

SEQ ID NO: 81298 - protein, 313 aa, Brassica napus
MAALQMSREWIGIQQFPPATQSKLLEILGKFKEEDVSSLTVLVMGKGGVGKSSTVNSVIGEKAAAVSTFQSEGLRPSLVSRSRSGFTLNIIDTPGLIEGGYVNDQAVNLIKRFLLNMTIDVLLYVDRLDVYRVDDLDKQVVTAITDAFGKEIWKKSALVLSHAQFSPPDGLNYDLFVSRRSDALLKLIRASAQLKKQDIQDSSIPVILVENSGRCHKNESDEKILPDGSSWIPNLYKTITDISFNGNKSIHVDKKLVEGPNPNARGKRLIPLIFAFQYLLVMKPLVRAIKSDVSRESKPAWEMRESGSASRRS

SEQ ID NO: 81299 - protein, 354 aa, Pisolithus sp. 441
MGCVQSTGVDGDAKARNDEIENQLRRDKMLAKNEIKMLLLGAGESGKSTVLKQMKLIHHGGYNDSERDSYKEIIFSNTIQSMRAILEAMPQLDISLSPQNDARRAVILALPIQIEGDVLPRDVADAIRGLWKDPGVKEAVRRSREFQLNDSAVYYFNAIDRMAAPGYLPTDQDILRSRVKTTGITETTFKVGELTYRLFDVGGQRSERKKWIHCFENVTALVFLVSLSEYDQMLYEDESVNRMQEALTLFDSICNSRWFVKTSIILFLNKIDLFAEKLPTSPLSDYFPDYTGGENYDAACDYLLHRFVALNQNAATKQIYAHYTCATDTQQIKFVLSAIQDILLQIHLRECGLL

SEQ ID NO: 81300 - protein, 360 aa, Gibberella zeae PH-1
MSKTLKIAVIAGDGIGKEVMPYGVRCLQAASKKYNLSLEFTEFDFASCDYYEKHGKMMPDDWKDTLTAFDAIYFGAVGMPDQVPDNVSLWGSLLKFRREFDQYINLRPCRLMPGIPCPLAGRKPGEIDFWIVRENTEGEYSSVGGIMFEGTERETVIQDTVMTRVGVDRVLRYAFDLAQSRPRKKLTSATKSNGIGITMPWWDKRVVEMSKNYSDVAVEKYHIDILTAHFVQRPQIFDVVVGSNLFGDILSDLGPACTGTIGIAPSANINPTASFPSLFEPVHGSAPDIYGKGIANPVGMIWAGQMMLSHFGYTDAADGMMAAIENVLARSDPAVMTADVGGKGTTQSLGEAIEKEILSS

SEQ ID NO: 81301 - protein, 318 aa, Shigella dysenteriae
VVDAAVEKAYKGERKISWMEIYTGEKSTQVYGQDVWLPAETLDLIREYRVTIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLR

SEQ ID NO: 81302 - protein, 838 aa, Aspergillus nidulans FGSC A4
MSERRWSTRIKEKGFRLLRRSSTSSRHSKNLPLVTASTSNSTHDLHPPRSRHSQYSQPVDGAYQGQKAAEAPAGPDSEPNSASSATTTPPISTPNALANPPPLSSASRPSISSFTESQYTPDELASAGTPGGQYFFVPDYRQPTSPALPEEQSVDQTSPAKPVAREQPQSQLQESQATPRRSDHDRERAKSGASRKSVPFELLDFPLQPPGNTEPSAPVSPVRTDRSSAPPTASPNRRERPVSGPAEQQSTPLPSVAEKSAVNTYQSLPLPPAFPSRLSVFRRQSLLPASHQHLVTSILDTDSFTEPEGINKHLPTMGSGMGLRKIWVKRPGGSATLLPTSEDALVDELRDQVVIKYANSLGKTFDAPDIIIRIATREGTRPPTPDRILSPEEPLWAVVDSYYPGGQTVGEALLIEIPQRRTPKPSPHRNVYFAQSEPGEHGDYFPLMPTNINLSTPPVHQPAANNSAGAHSAPSISILTTGHAPQVPSPGGRTRTRRPPLARNITHSPTIRGMSQSKESVSSQTAAPSQPTPPVPTPPGPPAESPKTKAHTPPARVSSPRPGPVKPKKSNRASLLNGAFGGLIEGTVPPINVLIVEDNVINQRLLEAFMKRLSVRWKCAANGQEAVTKWREGGFHLVLMDIQLPVMNGLDATKEIRRLERLNGIGVFPKKSSGVSTAAAATSPDPVTEEDTLHDLSLFKSPVIIVALTASSLQSDRHEALAAGCNDFLTKPVRFEWLEQKVTEWGCMQALIDFEGWRKWRGFATSESNSNTGSGRSTPETRNGTRKPSHPSPSPSAKKLSHLKKNDLVDDSPDSGDGSDSPASLHADGPSPVQDGAL

SEQ ID NO: 81303 - protein, 344 aa, Synechococcus sp. WH 8102
MTCRILITGGAGFIGSHTCLVLLEQGHSLVVVDNFDNSSPEALRRVQELAASDALQLVEGDLRNPDVLDRAFRSGRPVDGVIHFAGLKAVGESVADPLRYWDVNLNGSRVLAAVMERHGCRTLVFSSTSTVYGEPEQFPLHEGMATAPVHPYAQTKLAVEQMLGALCRSGSWRVACLRYFNPVGAHPSGRIGEDPLGIPNNLFPFITQVAAGRRDKLRVFGQDYPTPDGTGIRDYLHVMDLAEAHGVTLTHLLNQEPPTQLTVNIGTGTGLSVLDVIKGFEQATGITIPYEVVARRPGDVPRLQACPRQAEAVLGWTARRGLVEMCRDGWAWQQANPMGYRSAP

SEQ ID NO: 81304 - protein, 555 aa, Yarrowia lipolytica CLIB122
MAQSFTTFKQASDLPAWQKLQTLYDSKGKSLPVKQLFKEDPERFNKLSHTFTNFDDSKILFDFSKNIVDDEILAQLVELAKEANVYGLRDELFEGDKINFTENRAVFHPALRNRANVAMDVDDKNVAPEVDDVLAHMKEFSEQVRSGEWKGYTGKEITDIVNIGIGGSDLGPVMVSEALKPYAKKGLRAHFVSNIDGTSIAEEVIKQLNPETTLFLIASKTFTTAETITNATSAKTWFLETAKDTKHVAKHFVALSTNKEKVVEFGIDEANMFPFASWVGGRYSVWSSIGLSVAIYVGFDHFNDFLKGAEAVDKHFKEAPPEKNIPLLGGLLSVWYNNFFNAQTHLIAPFDQYLHRFPAYLQQLSMESNGKGVTRSNEYVKYSTGPVLFGEPATNAQHSFFQLVHQGTKLIPADFILAAQSHNPIDHNLHQRMLASNFFAQSEALMVGKTQEQVEAEGTPADLVPHKIFLGNRPTTSILTQLITPATLGALIAYYEWVTFTEGAVWNINSFDQWGVELGKALAKKIQPELENKSEIDAHDGSTNGLINQYKAWAA

SEQ ID NO: 81305 - protein, 318 aa, Shigella dysenteriae
VVDAAVEIAYKGERKISWMEIYTGEKSTQVYGQDVWLPAETLDLIREYRVTIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLR

SEQ ID NO: 81306 - protein, 318 aa, Shigella dysenteriae
VVDAAVEKAYKGERKISWMEIYTGEKSTQVYGQDVWLPAETLDLIREYRVTIKGPLTTPVGGGIRSLNVALRQELDLYICLRPVRYYQGTPSPDKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQAKVNPGSIILSAEMMLR

SEQ ID NO: 81307 - protein, 318 aa, Shigella dysenteriae
VVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLR

SEQ ID NO: 81308 - protein, 409 aa, Kluyveromyces lactis NRRL Y-1140
MPNFKSTAPKAKFAIYNNSNPDSESGFVEFQGYSFGAPVSCSGEAVFTTSLVGYPESMTDPSYKGQILVFTQPLIGNYGVPSGEERDDFNLLKYLESPHIHVRGIVVAEYAWRYSHWTAVESLATWCQRENVTAIGGIDTRAVVQILREQGSSPSTITVQGSFIPKPIKPETDLVKIVSTKKPFFVKALSSVKTPFNVALIDCGVKENIIRCLVERGANVTVFPYDYPITSVANQFDGIFISNGPGDPVQCMESTVPELKKLLETNTLQDLPIFGICLGHQLLALASGGKTIKLGYGNRAHNIPALDLTTGQCHITSQNHGYAVDVDTLPESGFKPFFQNLNDKSNEGMIHVSRPIFSTQFHPEAKGGPRDSAVLFDRYFDNMSQYRALKGPKVKLTLNTSSLATERVF

SEQ ID NO: 81309 - protein, 340 aa, Campylobacter lari RM2100
MGYVSVEQAIKELQDGKMLIMVDAEDRENEGDLIFPAQFSSKEKVNFTITHARGVVCVALSENLAKKFELPLMVPKNTSNHETAFTITVDAKNATTGVSAYERDMTIQIFADDNAKASDFVRPGHINPLIAKKGGVLERTGHTEGTVDLCRLAGLKEACVICEIVKDNGDMARRDDLLEFCKKHDINMITISDLIEYRLKNESLISLIKEEDSILAGFKAKKMIFKDHNANEHIAFSFGALKECENVKFYLSGSDFELLTSNKFNELLKQIEFLSQKGGVIIFMKNEKQENTQFKNYGIGAQILRYLKISKIKLLSQNTDKEFIGLKGFGLDITSSDFKA

SEQ ID NO: 81310 - protein, 376 aa, Coccidioides immitis RS
MNIRPEESPIEETVHAIPPQKDVFTWRNVVYDISIKGEPRRLLDNVSGWVRPGTLTALMGVSGAGKTTLLDALAQRTTMGVITGDMLVNGKSLDMSFQRKTGYVQQQDLHLETTTVREALRFSAMLRQPKSVSKTEKYAYVEDVIDMLNMRDFSEAVVGNPGEGLNVEQRKLLTIGVELAAKPALLLFLDEPTSGLDSQSSWSIITFLRKLADNGQAVLSTIHQPSAILFQQFDRLLFLAKGGKTVYFGDIGENSRTLLDYFERNGAEPCGSNDNPAEYMLDVVGAGPSGKSEQDWPTIWNESEEARRVQEEIDRINAEKEKDESLQEPTETPREFAMPFTSQVYYVTIRVFQQYWRTPTYIWGKLLLGIMAAVFM

SEQ ID NO: 81311 - protein, 713 aa, Artemisia annua
MALSAFAFPTQINHRSVTSNQPLIQHCLFGTDLNSSQKPFNQIVKRSNGIRSTLSERGEYHSQRPPTPLLDTINYPIHMKNLSVKELKQLADELRSDVIFNVSKTGGHLGSSLGVVELTVALHYVFNTPQDKILWDVGHQSYPHKILTGRRDQMHTIRQTNGLAGFTKRSESEHDCFGTGHSSTTISAGLGMAVGRDLKGGTNDVVAIIGDGAMTAGQAYEAMNNAGYLDSDMIVILNDNKQVSLPTANLDGPIPPVGALSSALSRLQSNRPLRELREVAKEVTKQIGGPMHELAAKVDEYARGMISGSGSTLFEELGLYYIGPVDGHSIDDLVAILKEVKSTKTTGPVLIHVITEKGRGYPYAEKAADKYHGVGKFDPATGKQFKSSAPTQSYTTYFAEALIAEAEADKKIVGIHAAMGGGTGMNLFLRRFPTRCFDVGIAEQHAVTFAAGLACEGLKPFCAIYSSFLQRGYDQVVHDVDLQKLPVRFAMDRAGLVGADGPTHSGSFDVTFMACLPNMVVMAPSDEAELFNMVATAAAIDDRPSCFRYPRGNGIGVPLPPGNKGVPLEVGKGRIMLEGQRVALLGYGTAVQSCMAAATIVQERGLNITVADARFCKPLDHSLIRALAKTHEVLITVEEGSIGGFGSHVAHFLALDGLLDGNLKWRPLVLPDRYIDHGAPADQLAEAGLTPSHIAATVFNVLGQTREALEVMS

SEQ ID NO: 81312 - protein, 384 aa, Nocardia farcinica IFM 10152
MARDYYGLLGVARNATDQEIKRAYRKLARELHPDVNPDEAAQARFKEVSTAYEVLSDPEKRRIVDMGGDPLESGGGAGGFSGAGFGGLGDVFEAFFGGMSGAGGGQRKPRGRVQPGADSLLRTRLSLAECAVGVTKHLTVDTAVLCDACHGSGTHGNSKPVRCETCGGAGEVQSVQRSFLGQVLTSRPCPTCRGAGETIPDPCHKCGGDGRVRARREIAAPIPAGVANGMRVRLAAQGEVGPGGGPPGDLYVEIVEQPHDVFVRDGDDLHCTIRVPMVDAALGTTVVIDTILDGPTELTIPPGTQPGEVSVLRGHGMPKLRSGVRGDLLAHLDIVIPTKLDGKQTELLRKYKALRDRDRAEVMSAQSEHNSGLFARLRASFSGR

SEQ ID NO: 81313 - protein, 275 aa, Sulfolobus solfataricus P2
MSSTPSNQNIIPIIKKESIVSLFEKGIRQDGRKLTDYRPLSITLDYAKKADGSALVKLGTTMVLAGTKLEIDKPYEDTPNQGNLIVNVELLPLAYETFEPGPPDENAIELARVVDRSLRDSKALDLTKLVIEPGKSVWTVWLDVYVLDYGGNVLDACTLASVAALYNTKVYKVEQHSNGISVNKNEVVGKLPLNYPVVTISVAKVDKYLVVDPDLDEESIMDAKISFSYTPDLKIVGIQKSGKGSMSLQDIDQAENTARSTAVKLLEELKKHLGI

SEQ ID NO: 81314 - protein, 625 aa, Streptococcus pyogenes MGAS10394
MSHFLVEKLTKTVGDKTVFQDISFIIHDFDRIGIIGVNGTGKTTLLDVLSGRLGFDGDHSPFSKANDYKIAYLTQDPEFNDAASVLDTVLSSDVKAIQLIRQYELLMANYTEDKQETLESLMSEMDRLDAWSIESDVKTVLSKLGITDLEQKVGDLSGGMRRRVQLAQVLLGAADLLLLDEPTNHLDIDTIAWLTTYLKTAKKTVLFITHDRYFLDHVATRIFELDKAGLTEYQGNYQDYVRLKAEQDERDAANLHKKKQLYKQELAWMRTQPQARATKQQARINRFTDLKKEVHQDSSADKLEMAFETSRIGKKVIHFEDLSFAYGDRQLIKDFNLIIQNKDRIGIVGDNGVGKSTLLNIINGDLKPTSGKLDIGDTIRVGYFSQQLKDMDETKRVINYLQEVADEVKTSVGTTSISELLEQFLFPRSSHGTLIAKLSGGEKKRLYLLKLLIEKPNVLLLDEPTNDLDIATLTVLENFLANFAGPVITVSHDRYFLDKVATKILAFEEGDIRVFYGNYSDYLDEKAFEKETVEADLAKAIVTEEVPLPPKEEKKRMSYLEKQEWAQIEDKIATIEANIEEIENQMLTVVSDYGQLAQLQKELDQRNNDLLLAYERFEYLSGLDI

SEQ ID NO: 81315 - protein, 248 aa, Sulfolobus solfataricus P2
MREMLQVERPKLILDDGKRTDGRKPDELRSIKIELGVLKNADGSAIFEMGNTKAIAAVYGPKEMHPRHLSLPDRAVLRVRYHMTPFSTDERKNPAPSRREIELSKVIREALESAVLVELFPRTAIDVFTEILQADAGSRLVSLMAASLALADAGIPMRDLIAGVAVGKADGVIILDLNETEDMWGEADMPIAMMPSLNQVTLFQLNGSMTPDEFRQAFDLAVKGINIIYNLEREALKSKYVEFKEEGV

SEQ ID NO: 81316 - protein, 558 aa, Rhodococcus sp. RHA1
MNTGISDVDHTYDWVAEPVGARIDVRPTRSCRARVPAAPSGGNVDSTVPGHTDSSGLGKGLKRRHMNLIALGGVIGAGLFVGSGVVIGGAGPGAIISFLIAGIITLLIMRMLAEMAVARPVVGSFYVYARQALGRRAGFATGWMYWYFFVIVVAVEAIAGGRILQLWLPMIPLWLLSLGLMLLLTATNMVSARSYGEFEYWFSSIKVVAIVLFLGMGALWITGLWPDSTPGLGNLVNHGGFTPLGWGAVLAAVVPCVAFYTGAEIVTIAAAESEEPKRAVAHAMRSIVVRIVTFYVGSILVVVTIQPWNTESVGVSPYAAVLEVLGIPGVATIMNFIVLTAVLSCLNSALYTTSRMLFALTRNGDAPKFFTTLSRNGVPRRAILLGTTVGYVSVACTYVWGDVVFGFLVNSYGAVALFVYLLIAISQVVLRRRLEREDPAALQLRMWLFPWLSYATIALMATVILAMAFLPTTRSQFLMSGLTLIVILISYEVRKLLGKGGRDDESLSGAPPIGSADESVAEAEKRIESVETLGGSDIELLAAAQQEPHTHRHQRRQS

SEQ ID NO: 81317 - protein, 208 aa, Vitis vinifera
MTKQQANWSLYNNNGGSCVAIAGADYCVITSGTRMSIGYNILTCDYSKICKLADKCVMASSGFQADVRALQKHLAARQLIYQHQHNKQMSCPAMAQLLSNTLYYKRFFPYYSFNVLGGLDNEGKGQSKRDQATLQNGVVWTITAPFALYLADQTLRRSSAQVRSEEAKMLGIVSRKVLGQSLGRIRPAVWALRNYSSAEKQMITWKLE

SEQ ID NO: 81318 - protein, 490 aa, Rhodococcus sp. RHA1
MTSTPPPVQSQDSGLGKGLKKRHMNLIALGGVIGAGLFVGSGVVIESAGPAAIVSFLIAGIITLLIMRMLAEMAVARPVVGSFYVYAREALGNRAGFSVGWMYWYFFVIVVAVEAIAGGRILQLYLPSAPLWILSLGLLVILTCTNLVSARSFGEFEYWFSSIKVIAIVLFLGLGALWITGLWPDATPGVANLVSHGGFAPLGWGAVLAAVVPCVAFFTGAEIVTIAAAESAEPKKAVARAMRSIVVRIITFYVGSIFVVVAVVPWSTEAVGVSPYAAALSALHIPGVATIMNVVILTAVLSCLNSALYTSSRMLFALTRNGDAPHMFTRLSGGGVPRRAILAGTVIGYASVIAAFVSPDLVFSFLVNSYGAVALFVYLMIAISQVALRKKLEARDPEALSLKMWLFPWLSYATIVLMGAVIAAMAVLPTTRSQFWLSVVTLAFILIGYEFRRRSRTSAERLDTVTPPAASPGDGSDAEQLVGVVTREQP

SEQ ID NO: 81319 - protein, 323 aa, Xanthomonas campestris pv. campestris str. ATCC 33913
MGLLVDGKWQDRWYDTDKSDGRFERSQSHFRHWVTADGRAGPHGEGGFQAAPGRYHLYVSLACPWAHRTLIFRQLKGLASLIDVSVVHWLMGTQGWTFEHGPGVVGDSIHHAKYLYEVYLKADPQYSGRVTVPVLWDRERDTVVSNESADIIRMFNSAFDAVGAAEGDYYPEALRAQIDTINQRVYDTVNNGVYKAGFATTQAAYEEAVVPLFDTLDWLDTCLSTQRYLCGDYLTEADWRLFTTLIRFDAVYVGHFKCNLRRIADYPQLSGFLRELYQMPGIAETVNFQHIKSHYYQSHAMINPTGIVPMGPVLDLDAPHGRG

SEQ ID NO: 81320 - protein, 392 aa, Erythrobacter sp. NAP1
MASAPSRPAQPKGATGCLVLADGTVVWGKGFGAVGDAVGEVCFNTAMTGYQEVMTDPSYDSQIVTFTFPHIGNVGANEEDVESRGLGAVGCIVREEVTPHSSFRARDEFVQWMAGHGKIGLSGVDTRALTRRIRLNGAPNAVIAHSPSGEFDIDALLTKAQDWSGLEGLDLVPNVSREAAEDWKGGHWQLGFGYVEGTSDRPHVVAIDYGAKDNIFRNLVKAGAKVTVVPARTSFDDIMALKPDGVFLSNGPGDPAATGEYAVPVIKALLDADMPIFGICLGHQMLALAAGAKTTKMHQGHRGANHPVQRVGESWGETSGLVEITSMNHGFAVDADTLPDTLEQTHVSLFDGSNCGIAVKGKNAFGVQYHPEASPGPQDSFYLFEKFVGGLG

SEQ ID NO: 81321 - protein, 395 aa, Triticum aestivum
LALLMTLEQGKPMKEALGEVNYGASFIEFFAEEAKRVYGDIIPPTLADRRLLVLKQPIGVVGAITPWNFPLAMITRKVGPALACGCTVVVKPSEFTPLTALAAADLALQAGIPAGALNVVMGNAPEIGDELMQSTQVRKITFTGSTAVGKKLMAGSANTVKKVSLELGGNAPCIVFDDADIDVAVKGSLAAKFRNSGQTCVCANRILVQEGIYEKFASAFVKAVQSLQVGNGLEESTSQGPLINEAAVEKVEKFVGDATSKGANIMLGGKRHSLGMSFYEPTVVGNVSNDMLLFREEVFGPVAPLIPFKTEEEAIHLANDTNAGLAAYMFTKSIARSWRVSEALEYGLVGVNEGLISTEVAPFGGVKQSGLGREGSKYGMDDYLEIKYVCMGNLG

SEQ ID NO: 81322 - protein, 518 aa, Glycine max
METSEWHIERRSSFGSESPLAREAGNVPETGSLSIVVLGASGDLAKKKTFPALFHLYLQGFLPPDEVHIFGYARTKISDDELRNRLRGYLVPKKGASPQQLEDVEKFLQLIKYVSGSYDSEDGFRLLDKEISEHEYLKNSVEGLSRRLFYLALPPSVYPSVCKMIKTCCMNKSDLGGWTRVVVEKPFGKDLESAEELSTEIGKLFEEPQIYRIDHYLGKELVQNLLVLRFANRFFLPLWNRDNIDNVQIVFREDFGTDGRGGYFDQYGIIRDIIQNHLLQVLCLVAMEKPVSLRPEHIRDEKVKVLESVLPINDDEVVLGQYEGYKDDPTVPDESNTPTFATVVLRIHNERWEGVPFILKAGKALNSRKAEIRVQFKDVPGDIFKCKKQGRNECVIRLQPSEAIYMKLTVKQPGLEMSTVQSELDLSYGQRYQGVTIPEAYERLILDTIRGDQQHFVRRDELKASWQIFTPLLHRIDEGEFKPLPYKPGSRGPAEADQLLEKAGYVQTHGYIWIPPTL

SEQ ID NO: 81323 - protein, 187 aa, Burkholderia thailandensis E264
MPIINSQIKPFKATAYHNGDFVQVSDETLKGKWSVVVFYPADFTFVCPTELGDLAERYAEFQKLGVEIYAVSTDTHFTHKAWHDTSDTISKIKYPMIGDPTLAISRNFDVLIEEEGLALRGTFVINPQGEIKLCEIHDNGIGRDAGELLRKVQAAQYIAAHPGEVCPAKWTPGADTLTPSLDLIGKI

SEQ ID NO: 81324 - protein, 467 aa, Synechococcus sp. WH 8102
MTIQRICCIGAGYVGGPTMAVIADRCPEIEVTVVDINQARIDAWNDADLSRLPVYEPGLDAVVGRARGRNLTFSTAVEATVASADMVFISVNTPTKTKGLGAGQASDLRWVEACARTVAKAATGHTIVVEKSTLPVRTAAAIKTILEAAQEDDQQRCFSVLSNPEFLAEGTAIRDLEAPDRVLIGGEDAASIEALAAVYSHWVDEAKILRTNLWSSELSKLTANAFLAQRISSINSVAALCEATGADVREVARAIGTDSRIGPKFLNAGPGFGGSCFQKDILNLVYLCRHFGLPEVADYWESVVALNTWQQHRIAQLVVQKLFGTVTGKRLAIFGFAFKADTNDTREAPAIRICGDLLEEGAQLAIHDPKVEPAQMARDLKQEAAAAADVLSGTGSWALAESVEEAVSGADAVLILTEWNVYRNLNWAELAGRMRKPAWLFDARAVADPAVVRAAGLTLWRVGDGED

SEQ ID NO: 81325 - protein, 291 aa, Zea mays
RKKNPPSPPSRRPGSASPLPSPAIYLSLSAIDSAWQLLIANFTEFQLATVVTFLLHETVFFLSGLPSLLFERFGLFAKYKIQKKSNTSAYQNRCVLRLILYHVCVNLPVMIFSYPAFKFMGLRSSLPLPHWSVVVSQVLFYFVLEDFIFYWGHRALHTKWLYKHVHSVHHEYATPFGLTSEYAHPAEILFLGFATVVGPALTGPHLFTLWLWMVLRVLETVEAHSGYHFPWSPSNFLPLYGGSDFHDYHHRVLYTKSGNYASTFVYMDWLFGTDKDYRKAKTIEEKEGKNL

SEQ ID NO: 81326 - protein, 340 aa, Synechococcus sp. WH 8102
MSRTVLVTGAAGFIGAALSQRLLARGERVVGLDNLNSYYDPALKQARLRQVEATASKGAWRFEPISLEDGDALTALFAEERPDVVVNLAAQAGVRYSLENPAAYIQSNLVGFGHILEGCRHHDVGHLVYASSSSVYGGNRNLPFHERQPVNHPVSLYAASKKANELMAHTYSHLYGVPATGLRFFTVYGPWGRPDMAPMLFARAILAGEPIKVFNHGRMQRDFTYIDDIVEGVLRCCDKPATANPDFDPLQPDPATAAAPHRVFNIGNSQPTELLSFIEVMEQALGRDAIKDFQPMQPGDVVATAADTKALEDWVGFRPSTAIEAGVAQFAEWYRYFYGV

SEQ ID NO: 81327 - protein, 335 aa, Leptospira interrogans serovar Copenhageni str. Fiocruz L1-130
MKIGVIGSGSFGTALGSLLADKGYEVTLWCRNDSQVESINRNHINNKHLPNFTLPEKLTASKDLRNVVQGKDMIVSSPPSHALSEVLREIKEYLPEKVPIVSASKGIENGTLRLVSEIFESELPEKYHSYLSYLSGPSFAKEIIQKVPTIVSIASKNETTARKVQEIFSFLYFRTYWTPDVIGVEVGGSLKNVIALAAGVSDGLGFGQNTRAALITRGLNEITKIGLKLGADPMTFLGPSGMGDLILTCCGEQSRNRTVGFRLGKGETLEQILSSMNEVAEGVKTTQSAYELSQKLGIEMAITNEVYKMLYEGKNPREVVKDLMKRDLKREGVSV

SEQ ID NO: 81328 - protein, 318 aa, Shigella dysenteriae
VVDAAVEKAYKGERKISWMEIYTGEKSTQVYGQDVWLPAETLDLIREYRVAIKGPLTTPVGGGIRSLNVALRQELDLYICLRPVRYYQGTPSPDKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLR

SEQ ID NO: 81329 - protein, 320 aa, Chlamydomonas reinhardtii
MASSASAAPTGEVPDNANQHCPGTASDQAGKSAACAGCPNQSICATAPKGPDPDLAAIAARMSRVKHKLLVLSGKGGVGKSTVSAQLAFALARRGFEVGLLDIDICGPSVPKMLGLEGQEIHSSGAGWSPVYVEDNLAVMSIGFMLPNPDEAVIWRGPRKNGLIKQFLKDVDWGELDYLVVDAPPGTSDEHITITQCLQVGGLGGGAAAVIVTTPQDVAIIDVRKEVNFCRKVGLPVLGVVENMAGLRFPGAQLRLRAEVFREGGGAARMCADMGVPLLGRLPLDPGLGAAADAGRSVLPEAAGAAGADAVKGGLEGVAP

SEQ ID NO: 81330 - protein, 477 aa, Bradyrhizobium sp. BTAi1
MVGQTNCDVCVIGAGAAGLSVAAGTARFGLRTVLIERARMGGECLNTGCVPSKALLSAAKAAHQRETFRPPGSLELTSGPIDFAGVKDGVQAVIDAIAPHDSAERFEAMGVAVIADTAQFVDARTLKAGQRRITARWFVIATGSMAVIPAIPGLDASKVLTNDSIFQLRERPDHLVIIGAGPIGVEMAIAHRRLGCQVTVIDRASMLVNDEPELVAMLRDRMQQDGITLVEGADLIAVDHRKDGLAVSLDLGGARQTITCSHVFVAAGRSPVVDGLGLEAAGVSYDRKGIAVDRRLRTSQRHIFALGDVIDGPRFTHVAGHQAGVVVRNLAFRLPAKVNYDALPWVTFSDPELAHVGLTEARARREMDGDVAVQFVRLEKNDRAVAEHRTNGAIKVVTGRGGRILGASILAPAAGEMIGLWCLAVQRRMTMKAISDLMLPYPTMGEIAKAAAGQHFEPIVFGAKVRTFVRALRWLPI

SEQ ID NO: 81331 - protein, 318 aa, Shigella dysenteriae
VVDAAVEKAYKGERKISWMEIYTGEKSTQVYGQDVWLPAETLDLIREYRVTIKGPLTTPVGGGIRSLNVALRQELDLYICLRPVRYYQGTPSPDKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLR

SEQ ID NO: 81332 - protein, 132 aa, Kluyveromyces lactis NRRL Y-1140
MEDGDKDTLDTPRDVRLLHLLLASQSVLQYEDKVPLQLMDFAHRYTKGVLKDAIAYREYVGGSASDVSIEDIRLAIGARTQYQFKPTAPKELMLQLAAERNKKPLPNVVSSWGVRLPPEKYCLTAKEWSIDE

SEQ ID NO: 81333 - protein, 458 aa, Deinococcus radiodurans R1
MWTWVCFRLEAPRVTDMLTAFALLLSVTAVLAFLNERFFRLPTTVGVTLAGALSSMLLIALDALGLTGPRGWAAGLLETLDFTDFVLNGILSILLFAGALGLDARQLLRQRFSILTLAVFSTLLSTFLIGFAAYGIFGLVGLNVPLLWSLLFGALISPTDPVAVLDLLKRAAVPKRIETLIAGESLFNDGVGVVIFLVIAGMAGIGHSHGTGSVVGALELFGREALGGMAFGALLGAIGFLMLREIEQHAVEVLITLALVVGGYVAASALGVSGPLAMVVAGLVISAGRDVAFGEETREHIESFWETTDQVLNILLFAFIGLDVLLTETTGPQIVAGLLLVVASLLARWISVALPFPLIRRHEDYGPYTVRLLTWGGLRGGIAISLVLGLPQTPYRTHLVTATYIIVLFSIAVQGLTIMPLVHKAVAASPDSAGPDSAGPGGGQEDGENAGRQLSSET

SEQ ID NO: 81334 - protein, 129 aa, Glycine max
  misc_feature (116)..(116): Xaa can be any naturally occurring amino acid
QRHPTSALDKVDSLIVCGGMAFTFKKTIEGVSIGNSLFDEPGSQKVQGIMGKAKKNGVKLVFPVDYVTADKFDKDATVGAATDAEGIKDGLMGLDAGPESCKLFAETIKASQTILXWNGPAGVIEFENF

SEQ ID NO: 81335 - protein, 605 aa, Nicotiana attenuata
MEERSSTRLPTGSYTNDNTVWECVIPYITESRDRDAVSLVCKRWWQIDAITRKHITMALCYTAKPEQLSRRFPHLESLKLKGKPRAAMFNLIPEDWGGYVTPWVVEITKSFSKLKALHFRRMIVRDSDLELVAMNRGKVLQVLKLDKCSGFSTDGLLHICRSCRNLRTLFLEESSIVENDGEWVHDLAVNNTVLENLNFYMTDLVQVRAEDLELIARNCKSLVSMKISECELANLLGFFRAAVALEEFGGGSFNDQPEPVPENGYNEQLEKYAAVVSPPRLCQLGLTYLGKYEMPILFPIASRLTKLDLLYALLDTAAHCFLLQRCPNLEILETRNVVGDRGLEVLGQYCKRLKHLRIERGADDQEMEDEQGAVTHRGLTDLAKGCLELEYMAVYVSDITNEAFENIGTYLKNLCDFRLVLLDREERITDLPLDNGVRALLRGCYKLRRFALYVRPGGLTDVGLSYVGRYSPNVRWMLWGYVGESDEGLLKFLKDVLTCKARSERLLFSERALALAAMQLKSLRYLWVQGYRASSAGRDLLAMARPFWNIELIPARRVVSSEGNNGETIVAEHPAHILAYYSLAGQRTDFPDTVRPLDPNSLLAE

SEQ ID NO: 81336 - protein, 190 aa, Zea mays
VEWDNNGSPIVPCGWIAWSLFNDTYGFTRGSKEIKVNRKNISWKSDREHKFGKHVFPSNFQNGTLIGGGKLDPTVPLSEQEDLIVWMRTSALPKFRKLYGVIEDDLHADETIAIFVGNNYNTSTFGGKKSIVLSTASWLGGKNDFLGHAYIVTGSLSIIISIFFVLIHVKYPRPQGDPNCLSWNRKNSNS

SEQ ID NO: 81337 - protein, 524 aa, Coccidioides immitis RS
MADAFKARTLKRKNVKGLALNAAASKLGSKPSDGDAQIPGAIGNTDSNRTDTLEIGLEFQLDLRSEDLMVLKELGAGNGGTVSKVMHASTKVIMARKIIRVDAKEKVRKQILRELQVGRHCDSPYIVTFYGAFTNEARDIVLCMEYMDGGSLDRISKDFGPVRVDVLGKIAESIFAGLVYLYEAHRIMHRDIKPSNVLVNSRGHIKLCDFGVATETVNSVADTFVGTSTYMAPERIQGEAYSVRSDVWSAGLTIMELAVGRFPFDSSDTAAGDRASAGPMGILDLLQQIVHEPAPKLPKSDAFPAILDEFVAKCLLKKPGERPTPRELFDHDAFIQAAKRTPVNLREWAISMMDRHNRKSYLAPPAPRAINRDGSRDSISESRSQQQPDPHSHPTPTSGEIPLNYSHEPYIQRDEQTPRASNPSPTLGLEHLNINNHSQPQVNGQAGWPRRSPYTPGHHSNTNSPQAFTSPRAAPSPRHPSPRNPPQSAGLPLRTGPPSNGQMPPPPPASSGLGSWSRSQGNRA

SEQ ID NO: 81338 - protein, 344 aa, Glycine max
  misc_feature (100)..(100): Xaa can be any naturally occurring amino acid
MMMAGAAKTLTNLCPSFPFPTKPQNQLTTSHAFPSTRLRHRAISAVANAAQPPLAAATATEGQYRVDVLSESLPFIQKFRGKTIVVKYGGAAMKSPELQXASVINDLVLLSCVGLRPVLVHGGGPEINSWLGRLNIPAVFRDGLRVTDADTMEIVSMVLVGKVNKTLVSLINKAGATAVGLSGMDGRLLTARPAPKAADLGYVGEVARVDPAVLRSLIDTSHIPVVTSVAADESGQPYNINADTVAGELAASLGAEKLILLTDVAGILEDRNDPDSLVKKIDIKGVKKMMEDGKVGGGMIPKVNCCVRSLAQGVITASIIDGRVPHSLLLEILTDEGAGTMITG

SEQ ID NO: 81339 - protein, 603 aa, Xylella fastidiosa 9a5c
MTVIEIKVPDIGDYSKVPVIEVLVTVGDHVVKNQGILTLESDKATLEVPSMNNGVVKELKVNVGDLLSQGDVILLLETEDTTAPPSPSNTATSDTTSPPPPSPQPAASKPTAPDQQHADITCRMVVLGAGPGGYTAAFRAADLGLDTVLVERYPNLGGVCLNVGCIPSKALLHAAAVIDEAAHASTFGIDFGKPKITLDTLREYKQNVVNKLTAGLAGMAKQRKVRTVTGIAHFVSPNTLDITTADGSTQRLHFQQCIIATGSHPVKLPNFPWDDPRIMDSTDALELAEVPKKLLVVGGGIIGLEMATVYNALGSHVTIVEFMDQIIPGTDKDLVKPLADRMKKQGIEIHLNTKASHVKADKKGITVSFEAPTQGTQPALKTSTYDRVLVAVGRTPTGNNIGAEKAGVNVTERGFIPVDRQMRSNVPHIFAIGDIVGNPMLAHKATHEGKLAAEVAAAETESGKHREWVARVIPSVAYTNPEIAWIGMTETEAKAKSLNIGVAKFPWAASGRAIGIGRTEGFTKLIFDEDTHRIIGGAIVGVHAGDLLAEIGLAIEMGAEAEDISHTIHAHPTLSESIAMSAEVYDGTITDLYLPKKPATSAK

SEQ ID NO: 81340 - protein, 326 aa, Arabidopsis thaliana
MNNDTSKKLGTLVSDDGPVNVYVWDMDETLILLRSLLNGTYAESFNGSKDVKRGVEIGRMWEKHILKICDDFFFYEQVEECNEPFLDSLRQYDDGKDLSRYEFKQDDFSTPTDDLNKRKLAYRHRAVAERYEKGLCPFIDSESMSGLDELYNVTDEYTDRWLSSARAFLEQCSCVEESSDGTSAIEQSSQDIHILVTSGALIPSLVKCLLFRLDTFLRHENVYSSIDVGKLQCFKWIKERFNHPKFRFCAIGDGWEECAAAQALQWPFVKIDLQPDSSHRFPGLTPKTKKRDQKRKFGPRNLIYNTDLNLLMMNSCNTSASVEKAK

SEQ ID NO: 81341 - protein, 551 aa, Xylella fastidiosa 9a5c
MTEIKEAFVPDIGDYSNVPVIEVLVAVGDTVSKGQSLITLESDKATMEVPSSTAGIIKEIKVKVGDTLSQGHVVALIEVSEETAGVTTPMTVNTPATRAHNAAPPEDGGSLIEVRVPDIGDYSNVPVIEVLVTVGDTVSKDQSLITLESDKATLEVPSSATGVIKQLKVNVGDTLSQGDIVVVLQSAESTPLTPATNKPALPPNSSPARDAISAPASPAGTPSTPPITFDANTVLPSKIPYASPAVRLLARQLGVDLSRIKGSEKNGRITREDVQKFVNATVGTGIPEGRTPSASITTNGGLNLLPWPNVDFSKFGEIETQPLSRIKKISGANLARNWAMIPHVTQFDQADITELEALRVQINKENAAPNKNGTGIKLTVLAFLIKASAAALKKFPTFNASLDATGETLTLKKYFHIGFAADTPNGLVVPVIRNVDQKGIVEIAQETSDLAKKARDGKLTPADMSGGCFSISSLGGIGGTAFTPIINAPEVAILGVSKSLIQPIWDGTQFAPKMLLPLSLSYDHRVIDGALAAHFTTYLSQILADMRRVLL

SEQ ID NO: 81342 - protein, 314 aa, Streptococcus pyogenes MGAS10394
MDPNVITVTSYANIAIIKYWGKENQAKMIPSTSSISLTLENMFTTTSVSFLPDTATSDQFYINGVLQNDEEHTKISAIIDQFRQPGQAFVKMETQNNMPTAAGLSSSSSGLSALVKACDQLFNTQLDQKALAQKAKFASGSSSRSFFGPVAAWDKDSGAIYKVETDLKMAMIMLVLNAAKKPISSREGMKLCRDTSTTFDEWVEQSAIDYQHMLTYLKTNNFEKVGQLTEANALAMHATTKTANPPFSYLTKESYQAMEAVKELRQEGFACYFTMDAGPNVKVLCLEKDLAQLAERLGKNYRIIVSKTKDLPDV

SEQ ID NO: 81343 - protein, 426 aa, Vitis vinifera
MDLMIVLAVFVSLLAHPLPLGAHPTKPISRIAIVGAVFCDICSNNTLSRHSYFLPGVEVQIQCKLRVNSARTNEEINFSVNRTTGKHGVYKLEIPSVDGIDCIGGHTMQTLCQAKLIGSSSSACNVPGLKTTTNAISVKSKQDNLCIFNLNALSYRPSKRNTTIYIGCPSWQECPLSGFIILGMLPLLCLNLAEVVWNHGLLKRVGVCHGISGNAYVFLSLYRLTCKMEFVLVPCWMSLLLMMRVAEDLIRWLHQPTYRNQRFKLWLNYFEMYGGKFLDLLSDRKKLCMREDRRQQACIVGLQEFEVLDAQIVKEILERNDKRVKKGRVAPEGCFSVYVGPEKQRFVIKTEYANHPLFKILLEEAELEYGYNSEGPLALPCNVEIFHKVLLEMDSSDKIHQGCTFPRSHSSYRLLSPSPMIAMNHF

SEQ ID NO: 81344 - protein, 652 aa, Dechloromonas aromatica RCB
MSALSLVLLLLGASVLAVVICRRINLPPVLGYLFVGSVIGPHALNLMHDMHQAEYLAEFGVVFLMFSIGLEFSLPKLYAMKRIVFGLGLLQVVLSMALVAGLVMLFGVSWQLGIALGGVFAMSSTAVLTKLLAERMQLDSPHGREIMGVLLFQDLAVVPLLVIIPSLTEPPEKLAMLLGVALIKAIVVLAVILVFGQRLMRKWFHFVARAKSSEVFVLNVLLITLSLATITELAGLSLALGAFVAGMLISETEYKFQVEEDIKPFRDVLMGLFFVTIGVKLDLHILLGLWWQVLLALVALLVIKSLVVGVLSWRLGASPGNAIRSALWLCAGGEFGFVLLGEILHLPREIQQIALTVLVLSMLIAPFIVQYSERVVMRFVASEWLMRSMQLTKIAAQSMGSEKHAILCGFGRNGQYLARFLAQEDINYVALDQDPDRVREAAAGGENVVYGDAGRKEALMAAGLMRASVVIVTVSDTPLSEKILHHVQELRPDVPVIVRTADERDMERLTRAGAAEVVPEALEASLMLASHALVLVGIPINRVLKRVRQTRSKRYSLLRGYYRGMSDRDHDEEDEYQPRLHSVLLVSGSAAIGRTLDALNLDALGCEVSAIRRRGIRALEPAPETRLEEGDVVVLLGLPEVVMAAEERLLQN

SEQ ID NO: 81345 - protein, 349 aa, Rhodospirillum rubrum ATCC 11170
MNQIIDHIAVIGGGAWGTALAQTSRRAGRRVTLWAREPEVARAINATHENPDFLPGVSLDPGLHATADLAEALRGAEAVLVVCPAQALRPVLTTARPLWPGRAPMVICAKGVEQGSGARMSEVATAVLPEAPLAVLSGPTFAREVAEGRPTAVTLACADGALAEALVLALGTRTFRPYASTDVVGAEIGGAVKNVLAIACGVVEGLGLGDNARAALLTRGLAEITRLGRALGARSETLSGLSGLGDLILTATSMQSRNFSLGFALGQGRTLDQVLGERRSVAEGVHTASAVVALAARWAIEMPICAAIHGVLSGDYDVTSAIESLLSRPLRVEGGSESQIHPTAKTATP

SEQ ID NO: 81346 - protein, 429 aa, Erythrobacter sp. NAP1
MTAIIDIHGREILDSRGNPTVEVDVLLDDGSFGRAAVPSGASTGAHEAVELRDGDKDRYKGKGVLKAVEAVNTEIRDLLIGAFDAEDQRDIDLSLIALDGTANKGRLGANAILGTSLAVSKAAANARGLPLYSYLGGVAAHVLPVPMMNIINGGEHADNPIDIQEFMVMPVGAESIAEAVRWGSEVFHTLKKGLSDKGLATSVGDEGGFAPDLASTRAALDFIMASIEQAGFKPGEDIVLALDCAATEFFRDGKYEISGEGLSLDGQGMADYLAKLCDDYPIRSIEDGMSEDDFEGWAAVTKAIGDRVQLVGDDLFVTNPERLSDGIAKGLANSLLVKVNQIGTLTETLAAVDMATRARYTSVMSHRSGETEDATIADLAVATNCGQIKTGSLARSDRLAKYNQLIRIEEELGDSAEYAGRGCFGSLSA

SEQ ID NO: 81347 - protein, 139 aa, Erythrobacter sp. NAP1
MAKFLIVEARFYAHLNDMLISGARSALEAAGHDVEVITVPGALEIPGAIAMAAESGEFDGFVAIGVVIRGETYHFEIVAGESARAIMALTMDGIAIGNGILTVENDDQALVRADPDQKDKGGEAAKAAIALLDLAARFG

SEQ ID NO: 81348 - protein, 738 aa, Erythrobacter sp. NAP1
MGRWLAIWNILFVMLFLGGAAPSHAQSVPTSYSAANTPHFAPFAADLRSPIGRDLQTRNKVRSAIWAASQHTGVDYRYLLAKAQIESGLNPDAKARGSTATGLYQFIETTWLVSLDRYEAQLFTSLPIRGTNGQAGLSRRAKLALRDDPRMSAMMAAAYTLENGRALRSVLGREAVSRELYLAHFLGTGGAKRFLSAWLRNPHASAASLFPRAARSNRPIFSDRRGQMRSLDQVLRYIDVKLMEASKLTMGKIEAGLAKLSDCQIIILVEGFKRVTEETAETCDGETPASYTAPRSIGRGTLAVSGDHIALPCHHIEMCYLSRMSTSTITQVRELVETGAYTKAGIARAAGLHANTLRDASEPDWNPTAETLAKLQRFLDANDDSPVLVGIEEIIDEARNGRMYILVDDEDRENEGDLIIPAQMATPAAINFMATHGRGLICLALDKGRVDQLGLDPMSRNNKESMQTAFTVSIEAKKGVTTGISAADRARTVSVAIDATKGADDIVTPGHVFPLMARDGGTLVRAGHTEAAVDISRLAGLNPSGVICEIMNEDGSMARLDDLVDFARKHSLKIGTIRDLIAYRMRNDHLVERIDERSFESDYGGQWRLITYTNKVSGGEAYVLQKGHVVPGEPTLARVHPISVFDDVLGQPGPRKRTLQRAMGAIGEHGSGVIVILTNRIGGDEWTRDEQDRNIGIGSQILADLGVHDMVLLSNTRPELVALDGYGLTITDHMPIPE

SEQ ID NO: 81349 - protein, 256 aa, Brassica napus
MLTSLLIFFTLLCIYIPVNALNDEGFALLTFKQSVNEDPTGSLTNWNSSDEDACSWNGVTCKELKVVSLSIPRKNLYGSLPSSLGFLSGLRHLNLRSNRFHGSLPTQLFELQGLQSLVLYGNSFDGSVSDEIGRLKLLQTLDLSQNLFTGSLPSSLLQCNRLRTLDVSRNNFSGSLPDGFGSAFVSLEKLDLAFNHFNGSIPSDVGNLSSLQGTADFSHNHFSGLIPPALGDLPEKVYIDLTFNNLSGRSSDRCSD

SEQ ID NO: 81350 - protein, 335 aa, Rhodospirillum rubrum ATCC 11170
MTTLVTGTAGFIGSHVALRLLQEGEQVVGIDCYTPYYDVGLKEARVARLKAFPGFSEHRLDLADEAGVDAVFRAARPRRVIHLAAQAGVRYSVENPRAYLESNLMGTFSVLEGCRKTGVEHLVFASTSSVYGANKTQPFSEHQPADHPLTFYAATKRATEMMAHSYANIYQLPSTALRFFTVYGPWGRPDMALFLFTEAMLKGEPIRVFNHGKMVRDFTYIDDIVDGILRASAKIPVAMAGGAAQPDPAGSPVGPFRVYNIGNSQPVELMRYIEVLEGCLGVTAKKEMLPMQLGDVPGTWADVSALAADTGYAPKIGVEEGVRRFVDWYRGYYKP

SEQ ID NO: 81351 - protein, 457 aa, Glycine max
MNLLRHVFESPFFLIIASQQLISHVVLVPNKVALKTMASSPDTSKTIKLMRYNSYLRRLNSFKLLKTSFILLLLLYTLSTHHLLLSSAFHGPAWENQVRHSALPRRPHGMSVLVTGAAGFVGSHCSLSLKKRGDGVLGLDNFNSYYDPSLKRARQHLLAKHQILIIEADLNDAPLLAKIFDVVSFSHVLHLAAQAGVRYAMQNPHSYVASNIAGFVTLLEASKNANPQPAIVWASSSSVYGLNDESPFSELHRTDQPASLYAATKKAGEAIAHTYNHIYGLSLTGLRFFTVYGPWGRPDMAYFFFTKSILQRKPIDVYQTHDEREVARDFTYIDDVVKGCLGALDTAEKSTGGVVGKKRGPAQLRVYNLGNTSPVPVGKLVSVLETLLGVKAKKHVIKMPRNGDVPFTHANVSLAWRDLGYKPTTDLAAGLRKFVQWYVGYYGVRLGVEKEKHADLA

SEQ ID NO: 81352 - protein, 221 aa, Triticum aestivum
MAGKPAVVTRVVDSMTDNLRPTRAEATDVANAVLDGSDAILLGAETLRGLYPVETISTVGRICAEKVFNQDLYFKRTVKYVGEPMTHLESIASSAVRAAIKVKASVIICFTSSGRAARLIAKYRPTMPVLSVVIPRLKTNQLKWSFTGAFEARQSLIVRGLFPMLADPRHPAESTSTTNESVLKVALDHGKASGVIKSHDRVVVCQKVGDSSVVKIIELDD

SEQ ID NO: 81353 - protein, 220 aa, Zea mays
MASATGVSSSEMAVDHATGPGAVEKPRFDALKPNEMSGGRPQFRKVPVPQHRFAPLKRCWMEIYTPVYEHMKIDIRMNLKARRVELKTRQDTPDVSNLQKCADFVHAFMLGFDIADAVALLRLDDLYVDSFEIKDVKTLRGEHLSRAIGRLSGKGGKTKYAIENSTRTRIVIADTKIHILGSFVNIKVARDSLCSLILGSPAGKVYSKLRAVSARLAERY

SEQ ID NO: 81354 - protein, 241 aa, Deinococcus radiodurans R1
MTAENRPPVGDKQDKGQAVQEMFASIAPRYDLLNRVLSLGVDRGWRRAAAAEALAHSPRRVLDVATGTGDFAIELKERAPQVEIVGSDFVPQMLDLARQKAGAKQLSIRFEEGDALRLPYPDASFDAVTCAFGFRNFADYTQGLAEMWRVLTPGGRLVLLEFPPPASGLFGAVFRLYFQHVLPRIGALVSGNAGAYTYLPESVLAFPEPERLAQMMRATGFRTRYRALTFGIAGMWVGDKR

SEQ ID NO: 81355 - protein, 531 aa, Coccidioides immitis RS
MGAVDIPELRFTPVDEIPERVRRLRTTFFQQKTRPIDFRILQLRKLYWAIKDREHAIKEALHRDLRKAEYESYLTEITMLENDIIFCTKNLPKWAKDEKAPDIDLTYSLMKPTIRKDPLGCVLIIGAFNFPFLLTLGPVIGAIAAGNTVMIKPSETAANSAAVIQDIIEATFDPSFVCMTQGGVEETKTLLSQKWDKICFTGSSKVGRIVAQAAAPNLTPVLLELGGRNPAFITKNADLRLAARRLLWGKTLNAGQVCTSQNYILADKEVVPRLVDEFAKALKEYYPQGLKASPDYSRMINEAAFHRVKAMIDNSKGKILLGGTMDEAEKFIEPTVVQVDSVEDSLLTEESFGPIIPILPVENLDEAIKIANEIDSTPLGLYPFGTKQEVGKVLTAVRSGGASINDAFMHISVPTLPFGGVGESGTGCYHGRSSFEAFVHRRSITTTPGWVERVLAIRYPPYSGKLSKFLGAGAMRPNFDRNGREKRGMLGWLVWMVTLGGGATKSGAARSTAAALVAYGLQQYAKRASKL

SEQ ID NO: 81356 - protein, 128 aa, Glycine max
MGDTKERATKKPAAKWPLIKPKKNLQISRLRDFDLFTGSLGPTYGEAFRDNDRMLVDDPVLADTIWESGLSKLFSDIKIRGKVAVGLNPNIRFYRYKVGQRFGRHIDESVDLGDGKRTYYTLLVYWSG

SEQ ID NO: 81357 - protein, 397 aa, Aspergillus nidulans FGSC A4
MSHSRIISQLFVDALVLSTISFRPKSFKFFNIYILALPMASLRSVLKSQSLRHTVRSYSSQTMPPASPFAPRHFLSIADLSPSEFATLVRNASSHKRAIKSGSMPQNLQGSLLGKTVAMIFSKRSTRTRVSTEGAVVQMGGHPMFLGKDDIQLGVNESLYDTSVVISSMVSCIVARVGKHAEVADLAKHSSVPVINALCDSFHPLQAVADFQTIYEAFTPKAHHLSSLGLEGLKIAWVGDANNVLFDMAIAATKMGVDIAVATPKGYEIPPHMLELIKSAGEGVSKPGKLLQTNIPEEAVKDADILVTDTWVSMGQEEEKAQRLKEFDGFQITAELAKRGGAKEGWKFMHCLPRHPEEVSDEVFYSNRSLVFPEAENRLWAAISALEGFVVNKGKIE

SEQ ID NO: 81358 - protein, 612 aa, Oryza sativa Japonica Group
MGNVCIGPRRNFAKNGLLGILRPRHAAPSSPSQPTTTSRSIPVVLPSAPSSKPPPPTQTAPPVPVVISEPPPPQPQPEPQPAAPSQPPPPQEQPSPPPPASSNTTQQPPPPQQRQQSRAKKPAHIKRISSAGLQVESVLRRKTENLKDKYSLGRKLGQGQFGTTYLCVDKANGGEYACKSIAKRKLLTDEDVEDVRREIQIMHHLAGHPNIISIRGAYEDAVAVHVVMELCAGGELFDRIVRKGHYTERQAAGLARVIVAVVESCHSLGVMHRDLKPENFLFVGNEEDAPLKTIDFGLSMFFRPGEVFTDVVGSPYYVAPEVLKKSYGQEADVWSAGVIIYILLCGVPPFWAETEQGIFEQVLHGTLDFESDPWPNVSDGAKDLLRKVLVRDPKKRLTAHEVLCHPWLQMSGSAPDKPLDSAVLSRLRQFSAMNKLKKMALRVIAENLSEEEIAGLKEMFKMMDTDNSGQINYEELKAGLERVGANMKESEIYQLMQAADIDNSGTIDYGEFIAATLHLNKVEREDHLYAAFQYFDKDGSGYITSDELQQACDEFGIEDVRLEDMIGEVDQDNDGRIDYNEFVAMMQKTTTGFGKKGGHNFSGFRDALKSHS

SEQ ID NO: 81359 - protein, 199 aa, Streptococcus pyogenes MGAS10394
MAEEQVLNTHNASILLSAANKSHYPQDDLPEIALAGRSNVGKSSFINTILGRKNLARTSSKPGKTQLLNFFNIDNKLRFVDVPGYGYAKVSKSERAKWGKMIEEYLTSRDNLRAVVSLVDLRHAPSKEDIQMYDFLKYYDIPVIVVATKADKIPRGKWNKHESVVKKALNFDKSDTFIVFSSVERIGIDDSWDAILEQV

SEQ ID NO: 81360 - protein, 265 aa, Haemophilus somnus 129PT
MSIEVWSLIRAEAAKLAENEPMLASFFHATILKHNNLGSALSYILANKLANPIMPAIALREIIEEAHQNQPQIIESAACDIRAVRQRDPAVEQYSTPLLYLKGFHALQSYRITHYLWQQGRKALAIYLQNQISVAFDVDIHPAARIGCGIMFDHATGIVIGETSVIENDVSILQGVTLGGTGKESGDRHPKIREGVMIGSGAKVLGNIEIGRYAKIGANSVVLQSVSEYTTVAGVPSQIVGKNKGAKPAFDMDQYFIDDAINLNI

SEQ ID NO: 81361 - protein, 338 aa, Haemophilus somnus 129PT
MNDNSPSPTPITVIGAGAYGTALAIAFSRNGYPTYLWGHHPQHCQRLRNERKNQAFLPNIHFPDSLYVEDNLAQAIQHSRELLIVVPSHVFGDVIMQIKPHLRSDQRIAWATKGLERNTGRLLQEVVEEHVGYGYPLAVLSGPTFAKELAAGMPTAITLASNNEQFALEFQERIHCSKHFRVYINQDMIGVQLGGAVKNVIAIAAGISDGMGFGANARTALITRGIAEISRLGISLGANPNTFMGTSGLGDLVLTCTDNQSRNRRFGLMLGQGFDCTTAINELGPVIEGFYNTKETFLLAQQQGVEMPITEQVYQILFCGKKPEDAAITLLGRKRKRE

SEQ ID NO: 81362 - protein, 227 aa, Streptococcus pyogenes MGAS10394
MKALKKIAGVTAAQYVTDGMTIGLGTGSTAYYFVEEIGRRVKQEGLQVVGVTTSSVTSKQAEGLGIPLKSIDDIDSIDLTVDGADEVDKDFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPKAG

SEQ ID NO: 81363 - protein, 301 aa, marine gamma proteobacterium HTCC2080
MNPAENSYPTIESVVGETPLVRLQRLVQNSSNHVLCKLEGNNPAGSVKDRPALSMIVEAEARGDIQPGDTLIEATSGNTGIALAMAAAIRGYHMRLIMPAHMSSERKLAMAAYGAELIQVAREEGMEGARDLAEAMQARGEGTVLNQFGNFDNPLAHYRGTGPEIWRQTGGQVTHFISSMGTTGTIMGVSAFLKEQNPDIEIIGLQPQDGSQIPGIRRWSEAYRPTIFQSAKVDRTIDISQAESEVMMRRLASEEGIFAGVSSGGAISAALQVSQEVEGATIVAIVCDRGDRYLSTGVYEI

SEQ ID NO: 81364 - protein, 180 aa, Coprinopsis cinerea okayama7#130
MATQQQSQSFSVPSTSTASTGYIPDSTAASTLTTATTTQQQQQTATTSQNQSQQSRQALEEARKDRTLAEFMLMLDDYEPLIPNEVTDYYLQKVGFECEDVRLKRLLSLAAQKFVSDIAADAYQHARIRTNASGGRIRVNQPGSGPGSTKDKTRTTLTMEDLSAALAEYGINSRKPEYYL

SEQ ID NO: 81365 - protein, 187 aa, Glycine max
MKATKELSQHVEENEVTVLVDEEEDEEYESEDEVVDDGEDDEDDDDDDDDDDDNEDEEDDDEDDAPDGGDDDDDEDEEEESDVQRGGEPDDDDNDDDDEDEDEEDEEEQGEEADLGTEYLIRPLVTAEEEEASSDFEPEENGEEEEEDVDDEDGEKSEAPPKRKRSDKDDSDDDDGGEDDDERPSKR

SEQ ID NO: 81366 - protein, 175 aa, Triticum aestivum
  misc_feature (42)..(42): Xaa can be any naturally occurring amino acid
MPPPLMAWSATSFGPFQGLKSTAGLPSSRRSNGVGLGSVSNXGRIRCMQVWPIEGIKKFETLSYLPPLSTEALLKQVDYLIRSKWVPCLEFSKVGFIFREHNASPGYYDGRYWTMWKLPMFGSTDATQVINEVEEVKKEYPDAYVRIIGFDNMRQVQCVSFIAFKPPPPEDSGKA

SEQ ID NO: 81367 - protein, 332 aa, Zea mays
MMGGFLSRVLLLAFGYAYPAYECYKTVELNKPEIAQLIFWCQYWILVALLTVLERFGDFTISWLPFYSEAKLMFFVYLWYPKTKGTTYVYGTFFKPYISQHENEIDRNLLELRARATDTVVLYFQKAALAGQSTFFDVLKYVVAQSPSQKSRQRLHQESQQPPQQQQPQVQVQQAQPQKQAAPVMRRASSIAARQAAMAQQSQETKPVSSSPKIKRQTSARSGSVASTKPPVAASALKPGGSPKKGEVKPAADPVQTPTTGADSPKPEPSVPSLPGAEGVDKMAIDEASGDAPEGAEELDPALEEETPMEETIRVTRAKLRRRTTTEDPAGN

SEQ ID NO: 81368 - protein, 60 aa, Zea mays
RRTCNISCTPQWLLLSVTEKLPQSVVDLLKALVINIHHYLLLFSLMGFSVLFDGIQTPGF

SEQ ID NO: 81369 - protein, 271 aa, Parvularcula bermudensis HTCC2503
MAPHPHPPVPATLYTIDRNTVWSRMRLEAATAAAQEPAIASFLNASLLHHDTIEAALSYRLAEKLSDGEMKAMLWREVAMDAYQDKPQIVAAALSDLLAYFDRDPACRQYSHPFLYLKGFHALQSYRIANWLWGQGREALAHYLQSRISELYNIDIHPAARLGESLFFDHASGIVIGETAVIADEVSVLHNVTLGGTGKETGDRHPKIGRGVLISAGAKILGNIEVGEGAKIAAGSVVLHSVKPFCTVAGVPAVPVGACAKAAGGEMDQHI

SEQ ID NO: 81370 - protein, 685 aa, Dichelobacter nodosus VCS1703A
MTKSILLVATHRGAGLTSSVLGLSHAIEKLGVKVALHKPVLQCACEASCACNSAATCTDRALSISPERIQQALKNQKIDELMEEALQHFVAAKADADIVVMEGLLETPNAPYAHLINQKIARSLGADVIVVSSADVESIDRLERRLSFAGEYFAGRLLGAIINRVGGEGNLTQECLQKSSCFNDALPLLATISENAELAAPRVLDLQRHLDAEILFSGEINSRRIYDYVLFARSVQNAIPVLRDGVCVFSPADRDDTLMAVTTAVASGTHLACLVLTGEERSDDAVMRLCKPLLEKSKLPVLRIKRDSWESTRAMEGFNAHLAADDKERIEKIRTFFVEHLNKEWIKNYVARGDEQRLSPAAFRYNVVQKAIAAKKTIVLPEGDEPRTVVAASQCAARGMAKCVLLAKPERVHAVAAEQGVTLGDGISIIDPEQAREQYVARLVELRKHKGMDEATARSQLENNVMLGTLMLEAGEVDGLVSGAVHTTADTMRPPLQLIKTAKGASMVSSVFFMCLPEQVLVYGDCAIVPKPTVDDLAQIAIQSNDTAKAFGIEPKVAMISYSTGNSGQGEDVEKVKAATAKVRELRPDIIVDGPMQYDAASVASVGRAKAPNSPVAGQATVFVFPDLNTGNTTYKAVQRTAHAVSMGPVLQGMRKPVNDLSRGALIEDIVYTIALTAVQATLAE

SEQ ID NO: 81371 - protein, 429 aa, marine gamma proteobacterium HTCC2080
MSERLDDLRAFLGEATSPFHAVAALSRRLVDAGFKAVKQLDDLTFEAGQGYFVTANDSSIIAFRAGVGACEEGLRMIGAHTDSPNLSVKPNPLKKRLGTHQLAVDVYGGALLNPWFDRDLSLAGRVSFENSEGELESRLIDFQRPIAIIPSLAIHLDREANKNRSINPQTDILPLIAGLPTADGSSIDWAVLLADQVSAQYPEEGSVRILDFEMSLYDCQPAGLVGVDGAFLASARLDNLLSCHAGLLALLAADPAQWSLLVCNDHEEVGSTSAVGAQGPMLVDVLNSITGTAAASRRLRERSKMLSVDNAHAVHPNFSDRHDEAHGPLLNHGPVVKINRNQRYATSGEGSALLRLLAERAQVPLQHFVVRSDMGCGSTIGPITAAETGITTIDLGVPTLAMHSIRELAGTADVDYLGSLLTAFYNRVA

SEQ ID NO: 81372 - protein, 318 aa, Shigella flexneri
VVDAAVEKAYKGERKISWMEIYTGEKSTQVYGQDVWLPAETLDLIREYRVAIKGPLTTPVGGGIRSLNVALRQELDLYICLRPVRYYQGTPSPYKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWQKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLR

SEQ ID NO: 81373 - protein, 228 aa, Brassica napus
  misc_feature (214)..(214): Xaa can be any naturally occurring amino acid
MSGPLDRFTIPCFEGFSSTDERRERKSDFEVSEDEKKTRIGIFKKKASKASSKLRRSLSRKRRPSKGRSIDRTPSLTFEDIHDVEELRYVSEFRQSLISDDLLPPNLDDYHMMLRFLYARRFDLGKAKLMWANMIQWRKDFGTDTLLEDFEFPELDQVLKYYPQGYHGVDKEGRPVYIERLGRVDPCKLLQVTTLERYLRYHVKEFEKTVTIKXPACCIAAKRHVDSS

SEQ ID NO: 81374 - protein, 543 aa, Enterococcus faecalis V583
MITVNDVSLQFPDRKLFEEVNIKFTPGNCYGLIGANGAGKSTFLKILSGEIQPTTGVVSMGPNERLATLKQNHFDYEDYTVLETVIMGHKRLYEVMKEKDAIYMKEDFSDEDGIRAAELEGEFAELDGWEAEPEAAVLLQGLNIPEELHDQKMSELTAGQKVKVLLAQSLFGKPDVLLLDEPTNGLDTRSINWLEEFLINFENTVIVVSHDRHFLNKVCTHMADLDFSKIKLYVGNYDFWLESSQLATKLQAQSNAKKEEQIKELQDFIARFSANASKSKQATSRKKMLDKITLDDIQPSSRRYPFVGFTPEREIGNDLLQVENVSVTIDGKKILDNISFNLTKDDKVAFIADSDITTTTLFKVIMGEITPDTGSVRWGVTTSQAYLPKDNSKDFEEPLTILDWLRQFAGKEEDDNTFLRSFLGRMLFSGEEVLKPVNVLSGGEKVRVMLSKLMLSKANVLVLDDPTNHLDLESITALNDGLMAFTGSILFASHDHQFIQTLANRIIAVSDKGVIDRAETTYDEFLENPEIQKQMDVLFSSDY

SEQ ID NO: 81375 - protein, 404 aa, Aspergillus nidulans FGSC A4
MAAVSESPVYRATTTAPVNIAVIKYWGKRDATLNLPTNSSLSVTLSQRSLRTLTTASCSASYPAADELTLNGKPQDIQSSKRTLACLASLRAHRQELESADPSLPKLSTLPLRIVSENNFPTAAGLASSAAGFAALVRAVADLYKLPQSPTELSRIARQGSGSACRSLMGGYVAWRAGELADGSDSLAEEVAPQAHWPEMRALILVVSAEKKDVPSTTGMQTTVATSELFATRANAVVPARMAAIETAIQNRDFPAFAEITMRDSNGFHATCLDSWPPIFYMNDVSRAAVRLVHDINNAVGRTVCAYTFDAGPNAVIYYLEKDSNLVAGTFKSILGTELEGWSGPFYDAVKDVSSGVSLEQVDSRAVDVLKTGLSRVILTGVGEGPISVQDHLVGENGEILSDQ

SEQ ID NO: 81376 - protein, 581 aa, Vitis vinifera
QQQQQQQQLQNGGLLPVQATPLPPPLPGYSLGRKPPKMVKEKERFVHWICKFAGRKKVGMLLLCVVSAAVFVWVLYVGKGLIAPTWLFVGKLGANGSPAFVYTKSFSTRSLDLYRMNNSSFVRSEMFLGYNLPPGHPCENFALPPPPADKKRTGPRPCPVCYLPVEEAIALMPKYPSPSPLLNNLTFVYEENLTKGDSFGGSDFGGYPSLDQRANSYDIRESMTVHCGFVRGAKPGQRTGFNMDDSDLFEMEQCHGVVVASAIFGASQKFKGKKKKKQSCYGGIVVGLKAGFDMEYETYVLSCPWLDIHGKNFFFVFSTVLVAIPYINRILNKVPKLLLHRMFPNARYSLWIDGKLELVVDPFQILERFLWRKNASFAISRHYRRFDVFVEAEANKAAAKYDNASIDFQVEFYKSEGLTPYSEAKLPITSDVPEGCVIVREHIPISNLFTCLWFNEVDRFTSRDQISFSTVRDKIRAKTNWTVNMFLDCERRNFVVQGYHRDVLEHMASSVALPPPLVLAVEPPPLVNKLPVPPPPPPEISTVRVVSNPVTRVPAKRSRERRSSSKRHRKVVAGAKGIDSS

SEQ ID NO: 81377 - protein, 333 aa, Synechococcus elongatus PCC 7942
MRVGINGFGRIGRLVLRAAWDWPELEFVQINEPYGEAAAAAHLLEFDSSQGRWSREITATVDSLTIEGRSLHYSRAKEPTAIDWAAQGVELVLECSGQFRTAEKLEPHFQAGVQTVIVSAPVKEALNIVVGVNDDRYDPSQHRLLTAASCTTNCLAPVVKVLQEAIGIRHGLITTIHDQTATQSIVDSYHKDLRRSRAAGQSLIPTSTGSATAIGLIFPELQGKLDGLAVRVPLLNASLTDAVFELERETSVAEVNGLFQAASSGSLQGILGYEERPLVSVDYRGDARSAIVDALSTRVINGTQVKVLAWYDNEWGYSNRLAELARKVARAAV

SEQ ID NO: 81378 - protein, 473 aa, Glycine max
MQPPRRKNNNLPNSETSTTMKGKRNSSISISIVVVVFSIFLFGVFMYNEDVKSMAEFTFLRPKAQEIQEETVSNNNSRTQPERKPVEDSEESQEPIDLKAVVAEERIVEEYEERNEEVVLPPEECDLFTGEWVFDNLTHPLYKEDQCEFLTSQVTCMRSGRSDSLYQNWRWQPRDCSLPKFKPRLLLEKLRGRRLMFVGDSLNRNQWESMICLVQSVVPQGKKSLSKNGSLSIFTIEDYNATVEFYWAPFLVESNSDDPKMHSILNRIIMPESIEKHAVNWKNVDYLIFNTYIWWMNTDTMKVLRGSFDEGSTEYDEVPRPIAYGRVLNTWSKWVEDNINPNRTKVFFSSMSPLHIKSEAWNNPDGIKCAKETIPILNMSTTLQVGTDRRLFVVANNVTQSMKVVPVNFLNITTLSEFRKDAHTSVYTIRQGKMLTPEQQADPATYADCIHWCLPGLPDTWNEFLYTRIISQS

SEQ ID NO: 81379 - protein, 482 aa, Shewanella sp. MR-7
MLLKDPSLLRQQCYINGQWCDAQSKETVAIANPATGAVIASVPVMGQAETQAAIAAAEAALPAWRALTAKERGAKLRRWFELLNENSDDLALMMTTEQGKPLAEAKGEVTYAASFIEWFAEEAKRVYGDTIPGHQGDKRIMVIKQPVGVTAAITPWNFPAAMITRKAAPALAAGCTMVVKPAPQTPFTALALAVLAERAGIPAGVFSVITGDAIGIGNEMCSNPVVRKLSFTGSTQVGIKLMEQCAPTLKKLSLELGGNAPFIVFDDANIDAAVEGAMIAKYRNAGQTCVCANRIYVQAGVYDEFARKLSIAVGKLKVGEGITEGVTTGPLINRAAVEKVQSHLEDALSKGATVVAGGKPHSLGGNFFEPTVLTHVDSSMRVAREETFGPLAPLFKFTDVDDVIKQANYTEFGLAAYFYGRDISLVWKVAEALEYGMVGINTGLISTEVAPFGGMKSSGLGREGSKFGIEEYLEIKYICMSV

SEQ ID NO: 81380 - protein, 370 aa, Coprinopsis cinerea okayama7#130
MTLVRHFARHAGAVVCDAAGHILHDDHDHDHDHDHDHDHDHGHGVNDLMGLRIAAVFIILVGSTIGALFPILARRTRWLRVPKSVFDFAKYFGSGIIIATAFIHLLAPALGSLGSNCLSEGWHVYPYALAICMLSIFCLFVTELIAFRWGTAKLARLGKAHDTHGHGVGAHSAHGPEPVVEEKPELKKEGSTSDLETADSHGIKADQSPLAQIIGVGILEFGVVLHSVLIGLTLAVAEEFKILFIVILFHQTFEGLGIGARLAYMELGQKYRWVPYAGAILYGFTTPIGIAAGLGARATYDPTSVTSIIVNGVMYSVSAGILLYTGLVELLAHDFLFSKEMMTASNTKLASALGAMALGAGLMALLGRWA

SEQ ID NO: 81381 - protein, 305 aa, Arabidopsis halleri subsp. halleri
LVYLNNVAEGCVGRVAAKLEMMEPCSSVKDRIGFSMISDAEKKGLIKPGESVLIEPTSGNTGVGLAFTAAAKGYKLIITMPASMSIERRIILLAFGVELVLTDPAKGMKGAIAKAEEILAKTPNGYMLQQFENPANPKIHYETTGPEIWKGTGGKIDGFVSGIGTGGTITGAGKYLKEQNANVKLYGVEPVKSAILSGGKPGPHKIQGIGAGFIPSVLNVDLIDEVVQVSSDESIDMARQLALKEGLLVGISSGAAAAAAIKLAQRPENAGKLFVAIFPSFGERYLSTVLFDATRKEAESMTFEA

SEQ ID NO: 81382 - protein, 104 aa, Arabidopsis halleri subsp. halleri
YMLQQFENPANPKIHYETTGPEIWKGSGGKVDGFVSGIGTGGTLTGAGKYLKEQNKNIKLYGVEPVESPILSGGKPGPHKIQGIGAGFIPGILDVDLIDEVVQV

SEQ ID NO: 81383 - protein, 136 aa, Escherichia coli
SGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPP

SEQ ID NO: 81384 - protein, 122 aa, Brassica napus
  misc_feature (17)..(18): Xaa can be any naturally occurring amino acid
  misc_feature (61)..(61): Xaa can be any naturally occurring amino acid
  misc_feature (111)..(111): Xaa can be any naturally occurring amino acid
MAVSNAFVGCPKLETLXXHHTLSSTSTLQTPLGLIGVPRNNRTRRGLIHRARCELSPSESXTISALEQLKNSAPDRYTKERSSIVVIGLSIHTAPVEMREKLAIPEAEWPXAIGELCGLNHI

SEQ ID NO: 81385 - protein, 272 aa, Parvularcula bermudensis HTCC2503
MLPATKAVAKELLTVVDRPLIHYIADEAKEAGIEHLVFVTGRGKGAIEDYFDHAVELEQALEAKKKTAILEDTMSSLLAPGASSFTRQQAPKGLGHAIWCARDIVGDEPFAILLPDVIVQGPRGCLAQMVDQYEDGRNLVAVEAVPEDLVHKYGIVAPKGEIDGALFEMEGMVEKPEASAAPSNMSIMGRYILQPEVFSILEKTGKGAGGEIQLTDAMATLMDQQPFFAFQYEGESHDCGSKLGFLKANIAYALENDELGADLKSWVSDRIA

SEQ ID NO: 81386 - protein, 360 aa, Pseudomonas fluorescens PfO-1
MSKQILILPGDGIGPEIMAEAVKVLELANEKYSLGFELSHDVIGGAAIDKHGVPLADETLDRARAADAVLLGAVGGPKWDTIERDIRPERGLLKIRAQLGLFGNLRPAILYPQLADASSLKPEIAAGLDILIVRELTGGIYFGAPRGTRTLENGERQSYDTLPYSESEIRRIARVGFDMARVRGKKLCSVDKANVLASSQLWREVVEQVAKDYPDVELSHMYVDNAAMQLVRAPKQFDVIVTDNMFGDILSDEASMLTGSIGMLPSASLDANNKGMYEPCHGSAPDIAGKGIANPLATILSVSMMLRYSFNLHEAADAIEKAVSVVLDQGLRTGDIFSTGCTKVGTQEMGDAVVAALRNL

SEQ ID NO: 81387 - protein, 195 aa, Triticum aestivum
MCKKREGGSSYQAIYLHSTAMAPTVMASSVTSVVPFQGLKSTAGLPVSRRSNGASLGSVSNGGRIRCMQVWPVEGVKKFETLSYLPPLSREALLKQVDYLIRSKWVPCLEFSKVGFIFREHNASPGYYDGRYWTMWKLPMFGCTDATQVINEVEEVNKEYPDAYVRIIGFDNMRQVQCVNFIAFKPPGCEESGKA

SEQ ID NO: 81388 - protein, 306 aa, Schizosaccharomyces pombe
KMATSSAAAAASTPVNANTITETKNSTFFFDFMMGGVSAAVSKTAAAPIERVKLLIQNQDEMIRAGRLSHRYKGIGECFKRTAAEEGVISLWRGNTANVLRYFPTQALNFAFKDKFKKMFGYKKERDGYAKWFAGNLASGGAAGAASLLFVYSLDYARTRLANDAKSAKKGGERQFNGLVDVYRKTYRSDGLRGLYRGFGPSVVGIVVYRGLYFGMYDTLKPVVLVGPLEGNFLASFLLGWAVTTGSGVASYPLDTIRRRMMMTSGEAVKYSSSFECGRQILAKEGARSFFKGAGANILRGVAGAG

SEQ ID NO: 81389 - protein, 366 aa, Erythrobacter sp. NAP1
MGFRCGIVGLPNVGKSTLFNALTETQAAQAANYPFCTIEPNVGQVAVPDERLDKIAAIAKSAKVIATQLAFVDIAGLVKGASQGEGLGNQFLGNIREVDAIVHVLRCFEDDDIQHVSNKVDPIADAEVVETELMLADLESLEKRVSNAEKRATAGDKEAKIMASVLGQALELLKDGKPARLVEPKDVEEERVLKQAQLLTAKPVLYVCNVAEDEAASGNALSQAVFAKAEAEGAQAVVVSAAIEAELVEMPAEDRAEYLESLGLEESGLARVIRAGYTLLGLKTFFTAGPKESRAWTFPDGAKAPQAAGEIHTDFEKGFIRAETIAYDDYIALGGEAGAKEAGKMRQEGKDYDVKDGDIMLFKFNV

SEQ ID NO: 81390 - protein, 617 aa, Oryza sativa
MAAAATAAAAATSTFTAAVPRARGRRHPTRVAAAAAATASSPEAAMAAAAPPLPMMRVAPETLQRQSGYLVRGRGEEGIGEGEAEAVGGDAAGGLGAMEYLTSVLSSKVYDVAIESPLQLATKLSERLGVNLWIKREDLQPVFSFKLRGAYNMMAKLSREQLERGVICSSAGNHAQGVALSAQRLGCDAVIVMPVTTPEIKWRSVERLGATVVLKGDSYDEAQSYAKQRCEQEGRTFIPPFDHPDVISGQGTIGMEIVRQLQGPLHAIFVPVGGGGLIAGIAAYVKRVRPEVGMECSVYFTAALLQVKIIGVEPSDANAMALSLCHGQRVMLEQVGGFADGVAVKVVGEETFRLCRELVDGIVLVSRDAICASIKDMFEEKRSILEPAGALALAGAEAYCKYYGLKGENVVAITSGANMNFDRLRLVTELADVGRKREAVLATFLPEEQGSFKKFAELVGRMNITEFKYRYDCNAKDALVLYSVGIYTDDELKAMVERMESSKLRTVDLTDNDLAKDHLRYFIGGRSEVTDEPVNKFIFPERPGALMKFLDAFSPRWNISLFHYRAQGETGANVLVGIQVPPEEFDEFKSRADNLGYEYMSEQNNEIYRLLLRDPKI

SEQ ID NO: 81391 - protein, 466 aa, Acetobacterium woodii
MAQNIGKVVQVIGPVVDVKFQKDKLPKLNNAVNIELNGHTLVIEVAQQLGDDIVRCIAMDSTDGLMRNQEAVDTGSAIQVPVGKATLGRMFNVLGEPIDGKPFDTKDVVMHPIHRHPPSFEEQQTQPEMFETGIKVVDLICPYVRGGKIGLFGGAGVGKTVLIQELINNIATQHGGLSVFAGVGERTREGNDLYYEMMESGVINKTALCFGQMNEPPGARMRIALAGLTMAEYFRDDEGQDVLLFIDNIFRFTQAGSEVSALLGRMPSAVGYQPTLATEMGALQERITSTSKGSITSVQAVYDPADDLTDPAPATTFAHLDATTVLSRAITEKGIYPAVDPLDSTSRILDPKIVGQEHYETAREVQEILQRYKELQDIIAILGMDELSDADKITVSRARKVERLFANHLMLRNSLPVRWGICKRFGDTIKGFKEILQGQHDDLPESAFLLVGTIEDAVVKAKKIKG

SEQ ID NO: 81392 - protein, 249 aa, Brassica napus
  misc_feature (83)..(83): Xaa can be any naturally occurring amino acid
MAAVAFGSFDDSFSLASLRAYLAEFISTLLFVFAGVGSAIAYAKLTSDAALDTPGLVAIAVCHGFALFVAVAIGANISGGHVXNPAVTFGLALGGQITLITGVFYWVAQLLGSTAACFLLKYVTGGLAVPTHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGITYGNVFMTSEHVPLASDF

SEQ ID NO: 81393 - protein, 425 aa, Bradyrhizobium sp. BTAi1
MRDGSTRIQEIRMTAQSVAAPADEPRLVRSLTLTHAVLYGMGVTIGAGIYVLVGIAAGRSGMHAPLAFIGAALVMSFSAASFAELGTRMPVSASEAAYVQAAFQRKWLSLGTGLLVVLTATVSAATVSRGSAGYVAVFVSAPAPLIVCGVVLAMGAVACLATVQSVTLAGIMTLVEVSGLVLIIVAGLLYGNGVITRLPEVWPATSDVGAWIGIAGTTLIAVFAFIGFEHLVNVAEELKNPSRTLPWALFLTLGLTALIYALVVWIAVTAVPPPELANSPAPLALVFKNLTGLPLPTMSAIAVTATLNGIIVHMIMIGRVIYGLADQGALPKVLARVNSRTKTPVLATAIGIGAILLLALAVPLAGLADLTARLTLVVFALVNIALIRIKSAGEPPPAGAFVCPKWVPFAGLLSSALLIVLDSIS

SEQ ID NO: 81394 - protein, 293 aa, Triticum aestivum
MPRPEVQAPPEIFYNEAEARKYTTSSRIIEIQARISERALELLALPDDGVPKMLLDIGCGSGLSGETLTEHGHSWIGCDISRSMLDVALERETEGDLLLADMGEGLGLRPGVMDGAISISAVQWLCNADKSSHEPRLRLKAFFGSLYRCLARGARAVLQFYADNVKQTEMLVSFAMKAGFAGGVVIDWPHSSKAKKSYLVLTCGTSSVASLPKGKGENGEMCSSDDDGDDDESNDDQTVGTYGRNRSNKRQKVNKKNGRGKDWLLRKKEQMRKRGRDVPADTKYTGRKRKTRF

SEQ ID NO: 81395 - protein, 277 aa, Glycine max
MGTLGRAFYAVGFWIRETGQAIDRLGSRLQGNYLFQEQLSRHRPLMNLFDKAPSVHRDAFVAPSASLLGDVHVGPASSIWYGCVLRGDVNSITIGSGTNIQDNSLVHVAKSNLSGKVLPTIIGDNVTVGLDTVILGHSAVLQGCTVEDEAFIGMGATLLDGVYVEKHAMVAAGALVRQNTRIPYGEVWGGNPARFLRKLTEDEMTFFSQSALNYSNLAQAHSAENAKGLDETEFVKVLHKKFARHGDEYHSVLGGVQETPTELKSSDNVLLDKVPKA

SEQ ID NO: 81396 - protein, 319 aa, Vitis vinifera
  misc_feature (52)..(62): Xaa can be any naturally occurring amino acid
MPRPGDGAPRPVTLIPGDGIGPLVTGAVEQVMDAMHAPVYFERYEVHGDMKXXXXXXXXXXXLNVQLRKELDLYASLVNCFNLPGLPTRHQNVDIVVIRENTEGEYSGLEHEVVPGVVESLKVITKFCSERIAKYAFEYAYLNNRKKVTAVHKANIMKLADGLFLESCREVATKYPGIKYSEIIVDNCCMQLVSKPEQFDVMVTPNLYGNLVANTAAGIAGGTGVMPGGNVGADHAVFEQGASAGNVGHQKLVEQKKANPVALLLSSAMMLRHLQFPSFADRLETAVKRVISEGKYRTKDLGGDSSTQEIVDAVIATLD

SEQ ID NO: 81397 - protein, 483 aa, Marinobacter sp. ELB17
MIESPLLQNITGYAGGQWQQAAADTFDVDNPATGAVIAKVPFVTEQQVQDAIAAAKKAEKLTTPYPLETRRKWLEDIRDALTANRAEMGRILCLEHGKPLNEAQGEVDYAAGFFDYCAKNIEVLSPRNLDERPKGCSWTVHFRPVGVVGLITPWNFPIGMIAKKLSAALAAGCPSVIKPASATPLTMVALFTLMDKYVDLPAGMVNLVMGKASMIGKALSESPDVPMLSFTGSTEVGRQLIIDSADSVKKLALELGGNAPFIVFDDADLDAAVDNLMANKFRGSGQTCVCANRIFAHEKIVESFSQKLAERVRKMTVGDGINGDVDLGPLINRDGYNKVKRHLENALEQGATLVAGKKPSELNDDDLFFPPTVITGVTPQMCCSREETFGPLVPIASFSDENEVIAAGNDTEFGLASYVFTADVKRAQRVAAGLRFGHVGWNTGTGPTPEAPFGGMKMSGTGREGGEEGLFEFTEAQTVPRGF

SEQ ID NO: 81398 - protein, 485 aa, Vitis vinifera
MWPIGLCIVTLVIIWVTNWIHRWRNPRCNGTLPPGTLGFPLIGETIQFFIPGHSLDLLPFFKKRVQRYGRLFRTSLVGRPVAVAADPEVNHFILQEEGKSVEMFYLDSIVKLFGKDGASTHATGHVHKYLRTLVMNYFGFESLRDKLLPKVEAVARKSLDTWSSQPSVELNYAISQVMFEFISMELFSYDPSASTESMSDAFINFLKGLVSIPLNIPGTTFHKCLKNQKKVMKMLREIVEERCASPERRHGDVLDYFLEEMKSKTFITKDFIVYIMFGLLFATFESIPTMFTLVFKLIMEHPLVWQELKDEHEAILRNSQTSNSTITWEDYKSMTFTFDVINEALRMGNISLGSFRRAVEDVRINGYTIPAGWIILVVPSALHMDPETYPDPLVFNPWRWKEDGGSKIRVKNFTPFGRGIRSCPGAELSKLVAATFIHAAVTKYRFTKIKGGRVVRNPMLKFKDGFYVKVSEMVTEGGGSAAEDA

SEQ ID NO: 81399 - protein, 391 aa, Arabidopsis thaliana
MVVLSEIPGDPNEDNQNENPQEEVENLPILLQLPEELIASIVALIPRCHYPSLSLVSRAFRHLITSQELYVARSNLGFTEPVLYALIGFQAYTRPSWFFLRRSNFPLQLHRIRSLPPMLSGAAVVTIDYKMYVMGGCIGYNHPASSNVIVIDCRFHTWKYLPDMKRARCRAATGIIDGRIYVIGGCKKQDADWVEVFDVTTQSWETVPSECPNDANENGEFITYVVMQGRLFILDLECCFSYEPVQGLWESWDDGSELMRFWHSSSSCVVGDLLYALDLTCALEHPIVVYYPNELVWRPVMGVDTAHLPILTEYTSTLANFDGKLVILGGGDCSESSSEIWCVEIALETRQGDQIWGVVKSVSIVSRDLPMRHVIELCRTVMIVSLASSLS

SEQ ID NO: 81400 - protein, 492 aa, Vitis vinifera
MLPIGLCVVSLVIIWITYWIRRWKNPRCNVTLPPGSLGFPLIGESIQFLISCSNSLDLHPFFRKRIQKYGPLFKTSMLGRQVVVTADSEANHFILEQEGKSVEMCYLDSVAQLCGHDESSAGATGHIHKYLRTLILNHFGYERLRYKLLKKVEAMAHKSLGAWSSQPSVELNRATSQIMFDFISKELFSYDPKGCTESMGDAFIDFLDSLASVPLNIPGTTFHKCLKNQKKTMKILREIVDERCASPEIRCGDFLDDFLEGMKKEAFITKDFIAFVMFGLLFASFESIPIMLSLALKLIMEHPLVLQELKNEHEAILRNKDTSNFTLTWEDYKSMTFTLHVIDETLRMANVGLGNFRKALEDIKIKGHTIPAGWTILVVSSVLHMDPNIYPDPLVFNPWRWKDGGSKITTKNFTPFGGGIRFCPGAELSKLTMAIFLHVAVTKYRFTKIKGGNLVRNPVLKFKDGFHIKVSKKISHEDGAEREAKSGSVSIM

SEQ ID NO: 81401 - protein, 733 aa, Antirrhinum majus
MASCGVNMRSSFFSLLKSHDSSSWWLSSSTTTLPSKRQKFSGISAVQQERDTSEKSEIINVNKENLNGKNGRVARTLNFTGEKPSTPILDTINYPIHMKNLSLEELEILADELREELVYSVSKTGGHLSSSLGVAELTVALHHVFSTPEDKIIWDVGHQAYPHKILTGRRSKMHTMRKTFGLAGFPKREESVHDAFGAGHSSTSISAGLGMAVARDLLGNNNHVISVIGDGAMTAGQAYEAMNNAGYLDSNLIIILNDNKQVSLPTATVDGPAPPVGALTKALTRLQTSRKFRQLREVAKELTKQIGTEAHEVAAKVDSFVRGVAGSPGACLFEELGIYYIGPVDGHSIEDLVFIFKKIKEMPAPGPVMIHIITEKGKGYPPAEVAADKMHGVVKFDPRTGQQKKSKSETLSYTQYFAESLIAEAEQDDKVVAIHAAMGGGTGLNIFQKRFPGRTFDVGIAEQHAVTFAAGLATEGLKPFCAIYSSFLQRGYDQVAHDVDLQKLPVRFIMDRAGLVGADGPTHCGAFDTTYMACLPNMVVMAPSDEAELMHMIATAAIIDDRPSCLRYPRGNGIGAVLPPNNKGTPMEIGKGRILREGSRVAILGFGTIIQNCLAAADLLQEHRVSITVADARFCKPLDGDLIRQLVKEHEVLITIEEGSIGGFSSHVSHFLCLNGLLDGNLKWRAMVLPDRYIDHGAQSDQIEEAGLSPRHIAATVLSLIGEGKDSLHLMDL

SEQ ID NO: 81402 - protein, 451 aa, Shewanella sp. MR-7
MNKLIAFLKERKITEVECVISDMTGIARGKIAPVDKFLDEKGMRLPESVLLQTVTGDFVDDDIYYSLLDDADIDFVCVPDENAVFMLPWTIEATAQVIHDCYDRMGNPIELSPRNVLKKVLSLYEQKGWEPVIAPEMEFYLTSRSDDHDLPLKPPIGRSGRPEAGRQSFSIDAANEYDPLFEDMYDWCELQGLDIDTLIHEDGPAQMEINFSHGNPLSLADQVFVFKRTLREAALKHNVCATFMAKPVTDEPGSAMHIHQSVINKETGKNIFTNEDGTQSPLFLSYIAGLQKFIPELLPLMAPNANSFRRFLPGTSAPVNLEWGVENRTCGLRIPESSPQNRRIENRIPGADANCYLAIAASLLCGYIGMVEGLKPSTPVQGKSNESRSNNPHCLPLTLEEALAAMQESDACKEYLGEAFTTGFVAVKQAELENFRRVVSSWEREFLLLSV

SEQ ID NO: 81403 - protein, 141 aa, Escherichia coli
GDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPE

SEQ ID NO: 81404 - protein, 431 aa, Opitutaceae bacterium TAV2
PPPPPPASTKPTWQAHGRKFGNFLRAIAARSWHGEPFLMNIHEYQAKALFQKYGVPAPKGIPVKSPAEFKTALAEFPPGPVVVKSQIHAGGRGKGVFTDGFKGGVKFAQNKDDALEYAKKMFGNTLVTAQTGPAGRKVHTVYFTEACKIRNEYYLAILLDRTTSKPVIVASTEGGIEIEKVAKETPDKIFKVLIDPAFGLADFEVRELIFDLGLNPAESKNAAKLIKNLYQMFWETDASMVEVNPLVTTMDDQVLALDAKVSFDDNALFRHPEIVAYRDLNEEDPKEIEASKFNLSYIALDGNIACLVNGAGLAMSTMDIIKHYGGNPANFLDVGGGATKEQVVAAFKIILGDKNVKGIFVNIFGGIMDCNVIATGIVEAVKETGLKLPLVVRLEGNNVAAGKATLASSGLTIVSGDSMADAAQKIVKLVA

SEQ ID NO: 81405 - protein, 135 aa, Escherichia coli
GSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDL

SEQ ID NO: 81406 - protein, 268 aa, Emericella nidulans
MDSLTTHPATAQQARAFTSPSSLSFPGGTAFPGGADLTPPSDKDANMATNGQSANGNVNGQQQGANAANGNGVMPATPAATPGASAPGSGIVPTLQNIVATVNLDCRLDLKTIALHARNAEYNPKRFAAVIMRIREPKTTALIFASGKMVVTGAKSEDDSKLASRKYARIIQKLGFNAKFTDFKIQNIVGSCDIKFPIRLEGLASRHHNFSSYEPELFPGLIYRMMKPKIVLLIFVSGKIVLTGAKVREEIYQAFELIYPVLSDFRKV

SEQ ID NO: 81407 - protein, 140 aa, Escherichia coli
GDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPP

SEQ ID NO: 81408 - protein, 498 aa, Shewanella sp. MR-7
MSTPKKRSDWESLAASLAINGKAYINGEYRDAAAGSTFDCVSPIDGRVLAKVASCDLMDANIAVANAREVFESGVWSKTAPVKRKQVMIRFAELLEENANELALLETLDMGKPIRFSKAVDITGAARAIRWSGEAVDKLYDELAPTAHNEIGMITREPVGVVAAIVPWNFPLLMACWKLGPALATGNSVILKPSEKSPLTAIRIAELAVQAGIPKGVLNVLPGYGHTVGKALALHMDVDSLVFTGSTKIAKQLMIYAGESNMKRVWLEAGGKSPNIVFNDAPDLKAAAVAAAEAIAFNQGEVCTAGSRLLVESGVKDQLIALIAEELTSWQPGHPLDPTTVSGAVVDKQQLDTILSYIKAGQDEGASLVHGGQQVLAETGGVYVQPTIFSQVHNKMKIASEEIFGPVLSVIEFNGMEEAIAIANDTIYGLAAGVWTADISKAHKTAKALRSGMVWINHYDGGDMTAPFGGYKQSGNGRDKSMHSFDKYTEIKATWIAL

SEQ ID NO: 81409 - protein, 507 aa, Zea mays
  misc_feature (285)..(285): Xaa can be any naturally occurring amino acid
MMASQAMVPLRQLFVDGEWRPPAQGRRLPVVNPTTEAHIGEIPAGTAEDVDAAVAAARAALKRNRGRDWARAPGAVRAKYLRAIAAKVIERKQELAKLEALDCGKPYDEAAWDMDDVAGCFEYFADQAEALDKRQNSPVSLPMETFKCHLRREPIGVVGLITPWNYPLLMATWKVAPALAAGCAAVLKPSELASVTCLELADICKEVGLPPGVLNIVTGLGPDAGAPLSAHPDVDKVAFTGSFETGKKIMAAAAPMVKPVTLELGGKSPIVVFDDVDIDKAVEWXTLFGCFWTNGQICSATSRLLVHTKIAKEFNEKMVAWAKNIKVSDPLEEGCRLGPVVSEGQYEKIKKFILNAKSEGATILTGGVRPAHLEKGFFIEPTIITDITTSMEIWREEVFGPVLCVKEFSTEDEAIELANDTQYGLAGAVISGDRERCQRLSEEIDAGIIWVNCSQPCFCQAPWGGNKRSGFGRELGEGGIDNYLSVKQVTEYISDEPWGWYRSPSKL

SEQ ID NO: 81410 - protein, 589 aa, Vitis vinifera
MGSLGEILTHPGDIYLLLKLKMADCHVKKQLPPEPRWVFCYTLLHKASRDFSLVVQQLNTSCCPRPGVPGGYMDIRGPTEVGRICENCACNLVLLSSFHCATTILPFMSASTRDASFAVEKATKPDPLLIPLGSRITLHEVIVPNYENNSFNLSSAMLSSSKEQLLYHISFISVRWLGSRQGPPKFLHSNATSHKWALGAFAELLDNSLDEICNGATYVNVDILQNKRDGNKMLLIEDNGGGMDPEKMRQCMSLGYSEKSKIANTIGQYKKCRCYCVLTLLLKGWKKLHTEHWIVVLHIFEEYREGRCAYFYIDCEKGGQEWNKIIRSYAADWNKNVETIVQWSPFSSEADLLQQAILHSSNKMECDDSGQLELDFDTDQQDIHIRGVNRDEKNIQMAKQFPNSRHFLTYRHSLRVNSTIFLVCMIEMMRSSVLHSVIINGTIQKKFVLLWKLEAAPKSFPCYSCLMLIACHCVIKWLLLLLLDSSRMQGTILMFKGSMSITRIDSLRLPFWRLWNAAGSDGRGVIGVLEADFVEPAHDKQGFERTIVLSRLETRLQQMQKTYWTTYCHKIGYAPRGNKKLINESVRGI

SEQ ID NO: 81411 - protein, 147 aa, Escherichia coli
KPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEA

SEQ ID NO: 81412 - protein, 434 aa, Vitis vinifera
MASQEPWQMENGNLKGSSKEIKHGRTAHNMSSSSLRKKSDLSLVNKVPCGLVRQLLANLQEVILGTKLSVLFPAIPLAIVAQYYGFAGPWIFGLSLLGLTPLAERLGFLTEQIAYYTGPTVGGLLNATCGNATELIIAIFALSKNKILVVKYSLLGSVLSNLLLVLGTSLFCGGIYNLREEQKYDRKQSDINSLLLLLGLLCHMLPLMFRYAANPSGAALIADSTLSLSRAGSIVMLVAYLAYLVFQLWTHRKLFEAPEVDGDDDTVSSDEEPVIGFWSSVVWLILMTAIIALLSEFVVGTIEVASESWGISVSFISIILLPIVGNAAEHAGAVIFAFKNKLDISLGVALGSATQIAMFVVPLCVLVAWIMGIRMDLDFSLLETSSLALAIIVTAFTLQDGSSHYMKGLVLLLCYVVIGACFFVSKTTPGEYIK

SEQ ID NO: 81413 - protein, 276 aa, Brassica napus
MAMRKLLTKRLFSISNQASQSLTNCRISSSSLAVRTRVPKESGEARIAPEPGDSSISRRFLHNTAMIRPEIMQMPLGGSLIEKLREIDGSKGRIRLDGIAPPMATETETDKPSLTVEDTKKLLRAAQIEIVKTKLRETGKSWMAYEEFVSVCGEASSDLDHGAKIAKMLDDSANVIVLGDSVCIRPDQVTKSIEGLLPLPTVRNPNDPRRIVLRALQAAEAVIDVKAHSLVRRELWAGLGYLILQTAGFMRLTFWELSWDVMEPICFYVTSIYFMA

SEQ ID NO: 81414 - protein, 110 aa, Zea mays
MATATRRLLPALLKTLAPAGARGLSTEKAVGAAAVVGSHTAKWMQDTSKKSPMELINEVPPIKVDGRIAVCEGASEGVGLGHPIEYICLDLEAPNVCKYCGLRYVQVHHH

SEQ ID NO: 81415 - protein, 636 aa, Debaryomyces hansenii CBS767
MSQVYSNSNNEFIFGENGGKGKHLSSFLKNLSLTGSSNSTSNPSPKGNDHYNDINSNIYGSLSYGSSSPNEKNVDNSGSIKTPNFKRSPYQRSVSGPVGASFSHLASTPGDKKGSSNSNTKHGLSTPYKNLGLHPSAGLKSGHRTFSGRQRYTDLDDDWDADLEEVSVPSQNRGSLENKNLSRVNTDNASANSSMNSLTLQPSPMLDSLHPDLTIPINTHSNKDTSNKESLDYDDLQTKLEINKLNQLNVKYSKFHKMITDDTNIAIQDLRRLSWNGIPPELRAITWQILLGYLPTNKSRQSSTLKRKREEYLDGLSVVSSQIKFSDDSPSNSSSTSIASVSNSNSNRDKQLYHQIKIDVKRTNPTIKLYAYPETQQSLRKILFLWAVRHPASGYVQGINDLCTPFYQIFLSNYIWQLQKVAAYRQNPSEDCDMQLFIPGLLDDSDDNEQKLLNDPNLMNYNIGNFNPAKLSSRIMSIIEADTYWCLSRVLENITDNYIHEQPGIIRQVNDLRNLISKIDLELLQHFDNEGVEFIQFAFRWMNCLLMRELSIPLIIRMWDTYLSESPLGFNNFHIYVCAAFLIKFSGELKHKDFQEILLFLQNPPTNCWTEKDIELMLSEAFIWQSLYKNASAHLR

SEQ ID NO: 81416 - protein, 511 aa, Haemophilus somnus 129PT
MISNLTEQPSGAEYLKAILSSKIYELAQVTPLQPMLKLSERLSNTVLVKREDRQLVHSFKLRGAYAMIAGLSQPQKNAGVITASAGNHAQGVALSAKNLGLNALIVMPQNTPRIKVDAVRGYGGEVLLYGANFDEAKAKAIELSESKSMTFIPPFDHPAVIAGQGSLAMELLQQNSHIDRIFVPVGGGGLAAGVAVLIKQLMPDIKVIAVESKDSACLHAALKVGQPVDLERVGLFADGVAVKRIGNETFRVCQQYIDDVVLVDSDEVCAAMKDMFENVRAIAEPSGAVSLAGLKKYVKEHNIQGETLVNILSGANLNFHTLRYVSERCEIGEKHEAIFAVTIPEEKGSFLRFCHLLGDRPVTEFNYRYADKEQACIFVGVRISSEKEKLEIIQQLEQNDYKVMDLSDDEIAKTHIRYMIGGRTTSNSKERLYNFEFPEQKGALLKFLMMLGTHWNISLFHYRAYGADYGNVLAGFQLDEHDEIRFNGHLEELAYTYQDVTDSPAYKYFLA

SEQ ID NO: 81417 - protein, 356 aa, Schizosaccharomyces pombe
KTTEERSALRITRESELLGGQLSTQITREHIILTARFLNEYLEYYARLLAEVVDATKFLPFQLTEEVLPTARIESELFREDILRVAMAKLHEKAFHRGIGNEVYLPASASPSISEIKDFASKAYVKSNFSVISSGPDVQKASDLCAKYFAVIPDGSPLKSAPTKISSGESRVYSKGTNYFCLGFPAPAASPELFVLSSILGGDAAVKWSHGNTLLAKAAGTASEYKATAVADLTPYSDASLLSVVISGSCPKAIKATASESFKALKSLSSNIPNDVVKSGIAMAKTKYLSAFEPVTLNAISASSLVSASKGSDAFISGFDKVTPASISKVVSSLLAKPASTVAVGNLDVLPYYDEL

SEQ ID NO: 81418 - protein, 548 aa, Streptomyces avermitilis MA-4680
MSKTPSTGTPGTEKPVTGTPATETPVTEAPVTEAPVTEASAVDWANPLRDPRDRRLPRIAGPSGLVIFGVTGDLSRKKLMPAIYDLANRGLLPPGFSLLGFARRDWEDQDFAQVVHDSVREHARTEFREEVWQQLAEGMRFIPGDFDDDMAFKQLRASVDELDASRGTSGNYAFYLSVPPKFFPKVVQQLKKHGLADAPEGSWRRAVIEKPFGHDLASARELNAIVHEVFDPDQVFRIDHYLGKETVQNILALRFANQMYEPVWNRSYVDHVQITMAEDIGIGGRAGYYDGIGSARDVIQNHLLQLMALTAMEEPAAFDAESLLAEKLKVLKSVKLPGNLGEHTVRGQYTASWQGGERVRGYLQEDGIDPRSTTDTYAAVKLEVDNRRWAGVPFYLRTGKRLGRRVTEIAVVFQRAPHSPFDSTATEELGANAIVVRVQPDEGMTVRFGSKVPGTSMEIRDVSMDFAYGESFTESSPEAYERLILDVLLGDANLFPRHQEVEESWKILDPIEGYWDTHGKPAQYPSGSWGPEEADEMLARDGRSWRRP

SEQ ID NO: 81419 - protein, 514 aa, Yarrowia lipolytica CLIB122
MSSSNSVPSLLHDVRIANKFQIRRKIGSGSFGDIYLGVNIISGEEVAIKLENIFSKHPQLEYEARVYKTLAGGTGIPFIRWFGSQNEYNALVMDLLGPSLEDLFNFCERRFSYKTVVLLADQLITRLEYLHAKSFIHRDVKPDNFLMGIGRRGNQVNIIDFGLAKRFRDPRTHLHIPYRENKNLTGTARYASINTHLGVEQSRRDDLESLAYVLIYFMRGQLPWQGLKAVTKKQKYDRIMEKKMTTSTDTLTKGLPNEFAIFLSYSRSLRFEDRPDYIYLRRLMKDFFIRSNYRYDYVFDWTVFRYRKVINSMGGREGAQQSQLTAGQGQDEDPNKQQQQQRDSASPAAAGASQGASNSQVSLQPQQAPRAGGEALAAGAQGQGVPPQQGMRAKTPSQRPDLKTRIGDWDIPPPLRLFDIENQQLDYYDDKKADTDQSDWRTRLRREQQRIQGSPTSQGNSGAAGSGTAPGGPQQGVPQQQQQQPQQPLGQFGQPGASAPPGQGHDDYGATPWI

SEQ ID NO: 81420 - protein, 456 aa, Acidobacteria bacterium Ellin345
MIVMKFGGTSVESAEAIDRVAGIVRGRLDRRPTVVVSAMSKATDQLLAMAAAAGAGDKEKAVTLCQALRDRHFGVASALVSDASNPVHTSIAADYLALEQLLEGICAVGELTPRTQDNVVAYGERINSKVVAAAFAARGLKATHVDAREIIVTDHTFGKATPQVAEIDRRLMAKVKPLIDDGVVPVLGGFIGSTPDGITTTIGRGGSDFSAALVGAGLNAEAIEIWTDVDGMKTTDPNLCPDAHRIKVISFEEAAELAYFGAKVLHPATVLPAIEKNIPVYVLNSRNPSNEGTKIVARAPQTRNPFKAIAAKKRITVIDVVAARMLMAHGFLRQIFEIFDRHKCAVDVVSTSEVSVSLTVDSNERIPEIAADMEKLAFVKYSGRKAIVCLVGENIRERPGIAAQVFTAISDINVRMISQGASEINITFVIDEADVPEAVRRLHAHFFTDVDPEVFD

SEQ ID NO: 81421 - protein, 549 aa, Streptomyces avermitilis MA-4680
MSDSPRLTRRPEWTELEDHRAGPLLHPALRELFAADPERAERYVVRAGDLRLDYSKHLITDETLALLQELATATDVFGLRDAMFRGEKINVTENRAVLHTALRAPRDAVIEVDGENVVPAVHAVLDRMADFADRVRSGEWTGHTGSRIRTVVNIGIGGSDLGPAMAYEALRAFTDRSLTVRFVSNVDGADLHEAVRDLDPAETLFVIASKTFTTIETITNATSARSWLLAGLDGDEKAVAKHFVALSTNAGKVSDFGIDTANMFEFWDWVGGRYSFDSAIGLSLMIAIGPERFRELLDGFRIVDEHFRTAPAEANAPLLLGLLGVWYGSFFGAQSHAVLPYSHYLSKFTAYLQQLDMESNGKSVDRDGHPVEWQTGPVVWGTPGTNGQHAYYQLLHQGTKVIPADLIGFINPVDGLSDELAAQHDLLMANLFAQGQALAFGKTGDEVRAEGVPEEQVPHRTFRGNHPTTTILAAELTPSVLGQLIALYEHKVFVQGAIWNIDSFDQWGVELGKVLAKRVEPALTEGADVPGLDPSTAALVAAYRTHRKK

SEQ ID NO: 81422 - protein, 553 aa, Aspergillus nidulans FGSC A4
MKRKHPEVDDEPSISTPKRQRISKTNGHVNGEGSPEPPPSKRVKVTPQKPAAETAATLKASGLRTPSNRSKAKALFSTSTSEKGASTPTKVRADRSAKKKSAQLLLDQVEDSWEGGDQLAEEILAGEDAPDTIDRQRNDIVETVEADSTEPKQDKTEKTQPAPKRRAGRPKGAKNKRSPTPEGDLPPHERYFFQNRAGPPRTSNNNLNKVNLLTHEEYFDKHANYQDPCKRETAFLNDVHRRSFPQWNFEFSQGFNICLYGYGSKRRLTQGFADWLYRRHSSAPPSVVIVNGHTPNLSIRSIFATIVTAVLGADIPSKMGAQPVEVLELLQSALRSRPDQDPITVFINSIDAPSLRRATNQALLARLAATPKIHLLVTADTPNFLLMWDISLRDQFNFVFHDCTTFTPFDAEFDVVEEVHSLLGRKGRRVGGKEGVEFVLKSLPENAQNLYRVLLTELLSMMDEYLNGEDDMDNGDGAADGPKDEPGIEFRALYQKASEEFIASSEMMFRTLLKEFHDHQMITSRMDASGMEILSVPLSRNEMEGVLEDLVLG

SEQ ID NO: 81423 - protein, 385 aa, Physcomitrella patens subsp. patens
MQQASGLQSSFCGASLKQKAAVSGRPQNVAFAVRAAGYDEELIKTARTIASPGRGILAIDESNATCGKRLASIGLENNEVNRQAYRQLLCTTPGLGEYISGAIMFEETLYQSTSDGKKMVDCLVEGGIVPGIKVDKGLVPLAGSNEESWCQGLDGLASRTAAYYKQGARFAKWRTVVSIPNGPSDLAVTEAAWGLARYAAICQDTGLVPIVEPEVLLDGSHGIDRTLEVAEKVWSKVFYYLGENNVLLEGILLKPSMVTPGAECPERATPEQVAEYTLKMLRRRVPPAVPGIMFLSGGQSEVEATLNLNAMNQSPNPWHVSFSYARALQNSVLKTWKGQPENLEAAKKALLVRAKANSLAQLGKYSAEGEAKEAREGMFVKGYTY

SEQ ID NO: 81424 - protein, 203 aa, Streptomyces avermitilis MA-4680
MGDLILVRHGETEWSLSGRHTSRTDLPLTHHGEEQAKSLAPFFAGRSFARVLTSPLDRAVRTAELAGLTGAVTDPDLHEWDYGGYEGITTVEIHRTRPDWDLWTDGVPSASDGSRGESPQEVGERADRVLSRVDAALRGDGEDVVLVAHAHFLRVVTARRLGLPPEQGRLFRLATGTVSRLSTEHGRPVIATWNESGTSHGHH

SEQ ID NO: 81425 - protein, 551 aa, Zea mays
MESLRLAATHRPALPLPTSHSHLRRRHLHLHLHPYPNPLSLSPPIASHLSPIPRRHLPPLLASASASQASSKPAVSAASGGAKPLPLFLSLAAGLAVRFLVPRPAEVTPEAWQLLSIFLSTIAGLVLGPLPVGAWAFLGLTATVATRTLPFTAAFGAFTNEVIWLIVISFFFARGFVKTGLGDRVATYFVKWLGRSTLGLSYGLAISEALISPAMPSTTARAGGVFLPIVKSLSLSSGSKPNDPSAKKLGSYLVQSQLQAAANSSALFLTAAAQNLLCLKLAEEIGVSIGNPWITWFKVSSVPAFLGLLVTPYLIYKIFPPEIKDTPEAPALAAEKLKNMGPVTKNEWVMIGTMLLAVSLWIFGETIGVSSVVAAMIGLSILLVLGVLNWEDCLNEKSAWDTLAWFAILVGLAGQLTNLGIVSWMSNCVAKVLQSFSLSWPAAFVVLQASYFFIHYIFASQTAHVGALYSAFLAMHLAAGVPALMSALALAYNANLFGALTHYSSGQSAVYFGAGYVDLPDVFKLGFITAAINAVIWGVAGALWWKFLGLY

SEQ ID NO: 81426 - protein, 137 aa, Desulfotalea psychrophila LSv54
MEKTFAIIKPDAFAAGNAGKILARIYQEGFTVIGLKKLCMSQREAEGFYAVHNKKPFFAELTKFMSSGPCIVMVLEAEGCIGKWRDLMGATNPADAKPGSLRREFGTIVGENATHGSDAPETAAVELEYFFSGLELL

SEQ ID NO: 81427 - protein, 256 aa, Kluyveromyces lactis NRRL Y-1140
MLGRFSFGPKFYKSVHRTVLNPVWQRSIHIKTLTTPNENALKFVSTDGGLLQEKGTQSVEIKNTDEELLKHAPFPSKVFQQCPGVEAMMIGDDFVTINKDELIHWNQVTPTVIDLLVQHLASGKPTFLPDFFDVKKSSEVGYDVDIPKFEYDEDEQEISEMIDELIQTRIRPAIMDDGGDIQYRGWNPETGTVYLKLQGACKSCSSSEDTLKHGIEAMLKHYIEEVEDVVQILDPEEKIALAEFEKLEKKLESSKR

SEQ ID NO: 81428 - protein, 400 aa, Campylobacter lari RM2100
MFEEIHFNTIERLPNYVFAEVNAIKMAARRAGEDIIDFSMGNPDGKTPQHIIDKLCESANKDKTSGYSASSGIYKLRLAICSWYKRKYDVDLDPESEVVATMGSKEGFVNLARAVINPGDVAIVPTPAYPIHTQAFIIAGGNVATMNFDFNENYELNENTFFENLQKTLHESIPRPKYVVVNFPHNPTTVTVEKSFYERLVAMAKKERFYIISDIAYADLTFGSYKTPSIFEVEGAKDVAVETYTLSKSYNMAGWRVGFVVGNKRLIAALKKIKSWFDYGMYTPIQVAATVALDGDQTCVEEIKATYAKRLEVLLESFYQAGWELKKPNASMFVWAKLPQSKAHLGSMEFSKQLLQKANVAVSPGVGFGEAGNEYVRIALIENENRIRQAARNIKKYLRE

SEQ ID NO: 81429 - protein, 462 aa, Triticum aestivum
  misc_feature (86)..(86): Xaa can be any naturally occurring amino acid
  misc_feature (103)..(103): Xaa can be any naturally occurring amino acid
  misc_feature (188)..(188): Xaa can be any naturally occurring amino acid
MAFSSLATPSSSSPSSSFTLPTKPSPGAGSLSFSRASTGKFRMAAVRAEAVDTSISPRVSALRPSKTMAITDMASALRQAGVPVIXGLAAGEPDFDTPAVIAXEAGINAIRDGSTRYTPNAGTMELRKAICNKLQEENGLTYSPDQVLVSNGAKQCITQAVLAVCSPGDEVLIPAPFWVSYPEMARLXAGATPVILPTSISDNFLLKPESLASVITEKSRLLILCSPSNPTGSVYPKELLEEIAAIVKKYPRLLVLSDEIYEHIIYHPAKHTSFAALPGMYDRTLTVNGFSKAFAMTGWRLGYLAAPKHFVSACGKIQSQYTSGASSISQKAGLAALNLGYAGGEAVSTMVKAFQERRDYLVRSFRELPGVKISEPQGAFYLFLDFSSYYGSEVEGFGTIKDSETLCMFLLEKAQVALVPGDAFGDDKGVRISYAAALSTLQSAMEKIKDAMSLLKAPAAVQ

SEQ ID NO: 81430 - protein, 509 aa, Glycine max
  misc_feature (34)..(34): Xaa can be any naturally occurring amino acid
METPPPQQGVVKKKETRGRKPKPKDEHGKGLKEXEKQQQQQQHDQQQQQQQQDQPSVDEKYTQWKSLVPVLYDWLANHNLVWPSLSCRWGPQLEQATYKNRQRLYLSEQTDGSVPNTLVIANCEVVKPRVAAAEHISQFNEEARSPFVKKYKTIIHPGEVNRIRELPQNSKIVATHTDSPDVLVWDVESQPNRHAVLGATNSRPDLILTGHQDNAEFALAMCPTEPYVLSGGKDKTVVLWSIEDHITSAATDSKSGGSIIKQNSKSGEGNDKTADGPTVGPRGIYCGHEDTVEDVTFCPSSAQEFCSVGDDSCLILWDARVGSSPVVKVEKAHNADLHCVDWNPHDDNLILTGSADNSVRMFDRRNLTTNGVGSPIHKFEGHKAAVLCVQWSPDKSSVFGSSAEDGLLNIWDYEKVGKKIERTGKSISSPPGLFFQHAGHRDKVVDFHWNAYDPWTIVSVSDDCESTGGGGTLQIWRMSDLIYRPEDEVLAELEKFKSHVVACASKTEK

SEQ ID NO: 81431 - protein, 182 aa, Escherichia coli
AYELVAPILTKIAAVAEDGEPCVTYIGADGAGHYVKMVHNGIEYGDMQLIAEAYSLLKGGLSLTNEELAQTFTEWNNGELSSYLIDITKDIFTKKDEDGNYLVDVILDEAANKGTGKWTSQSALDLGEPLSLITESVFARYISSLKDQRVAASKVLSGPQGQPAGDKAEFIEKVRRALYLGK

SEQ ID NO: 81432 - protein, 232 aa, Aspergillus nidulans FGSC A4
MTYPLTKKIINNVNESQQEKQVTTVSPLDPGESDVGKLELPENFGEVVKGIYRCAFPQPWNLPALKTLGLRTIITLVDEPYTQSHEKFLEETGITHHRIPFIANKDPAIKTPERVVNTILRLMLNKSNHPILIHCNKGKHRTGCVTACFRKLQGWDRQDIMNEYIRYSRPKQRLLDEVFIDEFDPSALSHLAQASGAMSWELSGTYASITQEDKNSPENLIQPPRNGIRVAS

SEQ ID NO: 81433 - protein, 182 aa, Escherichia coli
AYELVAPILEQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGK

SEQ ID NO: 81434 - protein, 615 aa, Vitis vinifera
MEPTQHVSYLCLTQVKQKSCVVCGIISSVLLGNLVCSLHCVSELSMSKQTYRVCFCFRRGFKLKVAEAPSEIKALFNDYSEQGVMSLEQLQKFLIEVQGEDEASMEDVQGIMDSLHEFKHLPIFQLRKGLNLEAFFRYLCHDLNPPLSPHNTVHHDMNAPLSHYFIYTGHNSYLTGNQLSSICSDVPVINSLQCGVRVIELDMWPNSTKDDIDVLHGRTLTTPVKLSKCLISIKKYAFVASEYPVIITLEDHLTPDLQAKVAEMATQIFGDLLFSPESECLAEFPSPESLKRQIIISTKPPKEYLETKIKDKDEGSQKETASIQKKDNGSQKATKSAKKKDNGSQKAKKIWRIGITSCSRQKGGIKEWIRLDPDKVRRLSLSEQELENAIITHGQDIIRFTQRNLLRVFPKVMRVDSSNYNPLIGWMHGAQMVAFNMQGYDRPLWLMQGMFRANGGCGYVKKPDLLLKVGPHDKVFDPKANLPVKTTLKVKVYMGEGWHLDFHHTHFDIYSPPDFYTKVGIAGVPADSLMKKTKAVEDDWTPTWNEEFEFPLTAPELALLRIEVHEYDMSEKDDFGGQTCLPVSELRTGIRAVPLHNQKGEKYNSVKLLMRFEFV

SEQ ID NO: 81435 - protein, 182 aa, Escherichia coli
AYKLVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGK

SEQ ID NO: 81436 - protein, 599 aa, Beta vulgaris subsp. vulgaris
MGCVFGKESLAPEGRERGGRREKENLGTESGRKVDLPVADVVSGWDTGKDGENGGVELNDGGKKDEEKNGEEDGEEKREGEGKGRSQKPRGERRRTKANPRLSNPPKNVHGEQVAAGWPSWLSAVAGEAIDGWVPRRADTFEKIDKIGQGTYSNVYKARDSLTGKIVALKKVRFDNLEPESVKFMAREILILRRLDHPNVVKLEGLVTSRMSCSLYLVFEYMEHDLAGLAASPDIKFTEPQVKCYMHQLISGLEHCHNRGVLHRDIKGSNLLLDNGGILKIADFGLATFFDPNKKHPMTSRVVTLWYRAPELLLGATDYGVGIDLRSAGCILAELLAGRPIMPGRTEVEQLHKIYKLCGSPSDEYWKKSKLPNATIFKPREPYKRCIRETFRDFPPSALSLIDSLLAIDPAERKTATDALNSDFFSTEPLACDPSTLPKYPPSKEMDAKRRDDEARRLRAASKAQGDATKKTRTRDRPRAMPAPEANAELQANLDRRRIITHANAKSKSEKFPPPHQDGGLGYPLGASQHIDPSNIPPDIPYSSTSFTYSKGVGQHWSGPLVDPASAGGPRRKKKNVVEGNEPKSTGRRDISSSRARGK

SEQ ID NO: 81437 - protein, 182 aa, Escherichia coli
AYDLVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQVQPAGDKAEFIEKVRRALYLGK

SEQ ID NO: 81438 - protein, 224 aa, Brassica napus
VRREQVDLVVSLIEKRRRAIRNKTAPSFSYLDTLFDLKVEGRETAPSNEEIVTLCSEFLNGGTDTTGTAIEWGIAQLIANPEIQSRLYDEIRSTAGDRSIEEGDVDKMVFLQAFVKELLRKHPPTYFSLTHAVMETTSLGGYDVPAGVNVEVYIPGISEDPRIWSNPKQFDPDRFISGKEDADITGISGVKMIPFGVGRRICPGLGMATVHVHLMLARMVQEFE

SEQ ID NO: 81439 - protein, 116 aa, Parvularcula bermudensis HTCC2503
MDKLIVAAAALLGFAGVGLGAFGAHGLADRLTGPALGWWETATLYLLLHAVAALCVGATGLSSIGGGCFVAGALIFSGTLYAMALGAPTFLGAVTPIGGLLLLGGWAATFLAVITK

SEQ ID NO: 81440 - protein, 179 aa, Parvularcula bermudensis HTCC2503
MMIMNQLTRRSVLLGGSAALTVACTGRDSKAQEAAMSPSSPSEINDDTDWAELSEAAWKDRLTAEEFRVLRKEGTERAGTSPLNAEKREGTYVCAGCALPLFLSSHKFESGTGWPSFFDVIDGAVDTKTDFKLIVPRTEYHCSRCGGHQGHVFKDGPQPTGLRYCNNGVALDFVPAESA

SEQ ID NO: 81441 - protein, 213 aa, Triticum aestivum
MGSRPADAAGGQQQQQAEEPSMADVYGGHELTPLQKHAAFFDRNRDGIIYPSETYQGLRAIGCGVVLSAAGTVFINVFLSSKTVPANVKPPAFKFPIYVKTIQQGKHGSDTDVYDTQGRFVPEKFEEIFKKHAHTRPDALTDKELGEMLKANRDPKDFAGRVGAFVEWRLLYALCKDKEGFLHKETVKAVYDGSVFEKLEREKKEAKEFAKKK

SEQ ID NO: 81442 - protein, 148 aa, Janthinobacterium lividum
MKVSEILQVKGNILYTVTPDQPLLDAANTMAEKDIGSLVVMEFGDLVGMLTFREVLNALHENAGQIGGGTVRKHMDDHPITVTPDTEVNEVRRIMLEKHARYLPVMNAKTLLGVISFYDVARAVLEAQSFENQMLKAYIRDWPAETTD

SEQ ID NO: 81443 - protein, 263 aa, Microcystis aeruginosa PCC 7806
MDPSFALTLQIVITVVAGITAQVIAEYLKVPSIVFLLIFGIALGSDGWEILHPQSLGIGLEVLVALSVAIILFEGGLSLSGRELGRVSGSLRNLVTLGTSITLIGGGMAAHWLGEFPWPIAFLYASLVVVTGPTVIGPLLKQVAVDRRVATLLEGEGVLIDPVGAILAVVVLNTIIDSHSRPMEIITGLTLRLGIGAAIGIAGGGLLSFIIKTCNFLTFELKNLVVLAGVWGLFGLSQFSRSESGLMAVVMAGIVLKTAAVPR

SEQ ID NO: 81444 - protein, 360 aa, Debaryomyces hansenii CBS767
MNNEQPPPQQAHTRQISFNVSDHYQILEVVGEGAYGIVCSAIHKPTNQKVAIKKIEPFERSMLCLRTLRELKLLKHFNHENIISILAIQRPINFNLFNEIYLIQELMETDLHRVIKTQKLSDDHIQYFIYQTLRALKTMHLANVLHRDLKPSNLLLNSNCDLKICDFGLARSIASSEDNFGFMTEYVATRWYRAPEIMLTFQEYTTAIDVWSVGCILAEMLVGRPLFPGRDYHNQLWLIIEVLGTPNMEDYYNIKLKRAREYIRSLPFVKKVPFANLFNSEAINPLAIDLLENLLVFNPAKRITVDNALNHPYLNIYHDPNDEPISEKIPEDFFDFDKRKDELSIEDLKKLLYDEIMKPL

SEQ ID NO: 81445 - protein, 367 aa, Acidobacteria bacterium Ellin345
MPTDRILVVDDEEPIREIVSSMLSNAGYKTQQAGSGLQALAVLESGEEFELMLSDLMMAELDGIGLLEKTKERYPDMPVVMVTAVHDISVALAAIRNGAYDYLLKPFEREQLLAMVRRALENRRLKLENRAYQTNLESLVSARTEQLRQAMADLERSYDITLEALGDALDLKDAETEGHSKRVTAFTIAIARAMGLETEKIRVIARGAFLHDIGKMAIPDAILRKPGPLTPEEVAIMREHCYRGYHMLRKIPFLYEAAEIVYAHQEFYDGTGYPRGLKGEQIPLGSRIFAVADTLDAITSDRPYRAAQSIQAAREEIAQWSARQFDPKVVDTFLQMPDTIWRDLRREIDQQVYRFAYAQKNTKVGNA

SEQ ID NO: 81446 - protein, 315 aa, Acidobacteria bacterium Ellin345
MNTSEMSTLRVAEDISELVGQTPMLHLRKMVPPEIADIYVKLEFLNPGGSIKDRAALGMILRAEKEGVLKPGATILEATAGNTGVGLALIGVSRGYKVVLAVPQKFSKEKVMLMEALGAQVYRTPDAEGMEGAIRLVKKFLTEIPNSWLAGQFENQANPDFHYETTGRELWEQMGGKIDAIALGAGTAGTFTGVARYLKERSPQTLCVLVESQASVYGGGKSGPHAVEGIGASFIPATFDRSVCDEVIAVKDVDAFRTIKDLAAKEGVLAGSSSGAAVFASLELAKRLGPGKRVVTIIPDSAERYLSKDPYHFNE

SEQ ID NO: 81447 - protein, 420 aa, Debaryomyces hansenii CBS767
MSKYFSSIKELPPDPLFGLKARYTADDRSDKVDLGIGAYRDNNGKPWILPAVRKAEVKLVNSEEYNHEYLSISGYQPFLTESAKVILGNNSAAIKESRVTSQQSLSGTGALHLAGAFLKEFFTTESKKAPTVYLSNPTWANHNQIFTSLGLQVEKYPYWDNDTKSLNLKGFLSTIQEAPKNSIFVLHACAHNPTGLDATKEQWEEILEALAKNEHLALYDSAYQGFASGNLDNDGFAVRLAVDSKKLKTPIVICQSFAKNCGMYGERVGAIHVIPAENDKSLNNAIKSQLNKLTRSEISNPPAYGAKVVATILTDSELRQQWEDDLVTMSSRINKMRTRLRDLLTNQYSTPGNWDHIVSQSGMFSFTGLTPDMVSRLEKNHGIYLVSSGRASVAGLNDGNVEQVAKAIDEVVRFYSKSKL

SEQ ID NO: 81448 - protein, 106 aa, Zea mays
QNSIIFLINNGGYTIEVEIHDGPYNVIKNWNYTGLVEAFHNGEGACYTAKVRTEEELTEALEAALGPKKDCLCFIEVIVHKDDTSKELLEWGSRVSAANSRPPNPQ

SEQ ID NO: 81449 - protein, 202 aa, Zea mays
PNEPLRVNVLFKHVQKMLTGDSAVIAETGDSWFNCQKLKLPEGCGYEFQMQYGSIGWSVGALLGYPQGANHKRVIAFIGDGSFQVTAQDVSTILRCEQNSIIFLINNGGYTIEVEIHDGPYNVIKNWNYTGFVDAIHNGLGKCWTSKVKSEEDLTAAIETALGEKDCLCFIEVIAHKDDTSKELLEWGSRVSAANSRPPNPQ

SEQ ID NO: 81450 - protein, 130 aa, Brassica napus
MAIVPALQTTFVASTNSLKQSRPSSSWGSSSPSNVTLPRNKRSSSVIVAAVGDVSSDGTIYLIAGAAAVALVGTAFPILFKRTDTCPECDGAGFVRKGGATLRANAARKDQAQIVCANCNGLGKLNQIDK

SEQ ID NO: 81451 - protein, 324 aa, Rhodospirillum rubrum ATCC 11170
MAKAIRFREVGGPEVLTLETVDLPDLGPGDVLLRQTAVGVNYIDTYQRSGLYALPLPSGLGLEAAGVVEAVGPGVSLVAVGQRVCYGTGPLGAYADRRVMPENTLLAIPDTITDTQAAGMMLRGMTVRYLIRQTFPVQSGMTVLLHAAAGGVGLIACQWLKHLGVTTIGTVGSDEKAALARAHGCSHVINYSTENFVERVREITGGQGVPVVYDGVGAAVFEGSLDCLQRRGMMVTFGNASGPVPPIAPALLSQKGSLFLTRPTLAHYTADRRELVDTANDLFAVVGNGAVKIDIGQTYALADAVKAHQDLAGRRTTGSTVLIP

SEQ ID NO: 81452 - protein, 321 aa, Calystegia soldanella
KGQNPVFPRILGHEAAGIVESVGEGVTDLKAGDHVLPVFTGECKECRHCKSEESNMCDLLRINTDRGVMLEDQKSRFSINGKPIYHFVGTSTFSEYTVCHVGSVAKINPLAPLDKVCILSCGISTGLGATFNVAKPPKGSTVAVFGLGAVGLAAAEGARMAGASRIIGVDLVPSRFELAKKFGVTDFVNPKEHSKPVQEVIVEMTDGGVDRSVECTGNVNAMISAFECVHDVWGVAVLVGVPHKDAEFKTHPMNLLNERTLKGTFFGNYKPRSDLPSVVEKYMNKELELEKFITHEVPFAEINKAFDLMLKGEGLRCIITM

SEQ ID NO: 81453 - protein, 356 aa, Campylobacter lari RM2100
MPADLNDYFNKKNNQNNNKQNLNFKAPEFNFKGFGKFSPLIYSAIAIILVFALFKPFAIVNSGEMGIKSTTGKYSPTPLEPGLHFFMPILQKITIVDTRVRQINYASIEGVNENLQIGSGVVNKNSISVLDSRGLPVSIDVTVQYRLNPLQVPQTIATWGLNWENKIIDPVVRDVVRNVVGQYTAEELPTNRNTIAVQIDQGIRKTIESQPNEPAELQAVQLREIILPIKVKEQIERVQIAKQEAERTKYEVERANQEALKKAALAEGEANATIISAKGRASAVKIEADAQAYSNREIAKSLNNPLLDLKQIETQKQFNEALKVNKDAKIFLTPGGAVPNIWVDSKDSKRTSSVAN

SEQ ID NO: 81454 - protein, 497 aa, Emericella nidulans
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAEQTPLSALYAAKLIKEAGFPAGVINVISGFGRTAGAAISSHMDIDKVAFTGSTLVGRTILQAAAKSNLKKVTLELGGKSPNIVFDDADIDNAISWVNFGIFFNHGQCCCAGSRILVQEGIYDKFVARFKERAQKNKVGNPFEQDTFQGPQVSQLQFDRIMEYINHGKKAGATVATGGDRHGNEGYFIQPTVFTDVTSDMKIAQEEIFGPVVTIQKFKDEAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 81455 - protein, 497 aa, Emericella nidulans
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAEQTPLSALYAAKLIKEAGFPAGVINVISGFGRTAGAAISSHMDIDKVAFTGSTLVGRTILQAAAKSNLKKVTLELGGKSPNIVFDDADIDNAISWANFGIFFNHGQCCCAGSRILVQEGIYDKFVARFKERAQKNKVGNPFEQDTFQSPQVSQLQFDRIMEYINHGKKAGATVATGGDRHGNEGYFIQPTVFTDVTSDMKIAQEEIFGPVVTIQKFKDEAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 81456 - protein, 268 aa, Wolbachia endosymbiont of Drosophila simulans
MHLFCFGYGYVAKFLSKKLLNLGWKVSGTSRSKNIQDVILFNYEKVSQDLLKSATHVLISIPPDGDDVVERYGDCLQNVKWLGYLSATSVYGDHSGNWVDEESETRPIEIRGEKRLKSEKKWLNSKLPVHIFRLAGIYGPGRNVLIDLQLGKARNVKKEGHFFSRIHVEDISNILFSSMQNIKPGEIYNCADDLPTTQSEVVIYATKLLNVSPPEPIELPDYAQSFYLGSKRVSNVKIKKDLNVSLIYPNYKVGLESLHVNKTEITSE

SEQ ID NO: 81457 - protein, 458 aa, Triticum turgidum subsp. dicoccoides
MTSTAAAGSDSRRLLPGRQNSHQMDRINGNGQKSGIQASTFSDGADEFDDDTLIASEGLSRRTGGFERNAGPGNLGMFGSLKFVLFKSKLNLLIPCGFVAIVVKDMTGNNGWVFPLTLLGIIPLAERLGFATEQLAFFTGPTVGGLLNATFGNATELIISIHALRSGKLRVVQQSLLGSILSNLLLVLGCAFFSGGVTCGKTEQNFSKSEAVVSSGLLLMAVLGLLPPTVLHYTHSEVHSGKSGLALSRFSSCVMLVAYACYIYFELTTSRRREESNEGRGENVGDADNNEAPDISKSEAIAWLAILTIWISVLSDYLVNAIDGASQAWNIPVAFISVILLPIVGNAAEHASAVMFAMKDKLDLSLGVAIGSSTQMSMFGIPFCVVIGWMMGQPMDLNFHLFETASLLMTVLVVAFLLQDGTSNCLKGLMLFLCYLIVAASFYVHSDQDPDGNNPAQN

SEQ ID NO: 81458 - protein, 200 aa, Nicotiana tabacum
MAEVGLEGNQPVDLSKHPSGIVPTLQNIVSTVNLDCKLDLKAIALQARNAEYNPKRFAAVIMRIREPKTTALIFASGKMVCTGAKSEQSSKLAARKYARIIQKLGFDAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 81459 - protein, 182 aa, Escherichia coli
AYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGK

SEQ ID NO: 81460 - protein, 326 aa, Aspergillus nidulans FGSC A4
MAFRYTRMLSKTASSSFLSAASRTSGLATRSTFATTTRASSSSTSALAYKALHRRSPLTLPVTDVSQQWDAQTAVSSILYETPVRPTNPPKRHVLNCLVQNEPGVLSRVSGILAARGFNIDSLVVCNTEVEDLSRMTIVLQGQDGVVEQARRQLDDLVPVWAVLDYTDSALVQRELLLAKVSILGPEYFEELLQHHREITTPVESMEAQKKSTDSKASTKTEEYHPRNLPSSQALRHKHEHLDAITRLTHQFGGKVLDISTNNCIVELSAKPSRIDSFMKLISPFGILESTRTGLMALPRSPLFEANEELEKEAADVVDASTLPPG

SEQ ID NO: 81461 - protein, 454 aa, Opitutaceae bacterium TAV2
MPPFCAIGSVSLPSPPPRLPLHTIMPTPSLLATADRRMLETFWNKPVHRTVLPNGVTAIVLADDSAPVASVQVWVKTGSIHEGPLLGSGVSHFLEHMLFKGTTRRAGRAISAEIQARGGNLNAYTTFDRTVYYADLPAEHIDTGLDVLADMVLHSTLPDDEFTRERDVILREIAMTRDDMDGRLGEALFDTAFREHPFRHPIIGYKDVFSSLTHADLVAYYKGRYAANNLVVVVCGDVEPAAAHALIEQKFGSAPRGRLTPAPIAGEPAQLAPRSLDLFEDVELTRAGLAWQAPGLTHPDSPVLDLLSMILGHGDSSILWQALREKKRLVHSIDTSNWAPGATGLFFVSFTCDADQCATATAAVHAELRRALTSGLTHERLLQAVRQVVVGEINSRKTMSGQASRLGAAEVVAGDIHFSRAYFERIARVTTADLRRVLRAWLPAGRETTVSLNP

SEQ ID NO: 81462 - protein, 182 aa, Escherichia coli
AYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKAEFIEKVRRALYLGK

SEQ ID NO: 81463 - protein, 182 aa, Escherichia coli
AYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKDEFIEKVRRALYLGK

SEQ ID NO: 81464 - protein, 362 aa, Pseudomonas fluorescens PfO-1
MTSALKSFVPGALALLLLLPTALQAKEAETQTKLANVVVLATGGTIAGAGASAANSATYQAAKVGIEQLIAGIPELSTLANVRGEQVMQIASESITNENLLQLGRRVSELADSKDVDGIVITHGTDTLEETAYFLNLVEKTDKPIIVVGSMRPGTAMSADGMLNLYNAVAVASSKEARGKGVLVTLNDEIQSGRDVSKMINIKTEAFKSAWGPLGMVVEGKSYWFRLPAKRHTMDSEFDIKNIKSLPDVEIAYSYGNVSDTAYKALAQSGAKAIIHAGTGNGSVSSRVVPTLQALRKDGVQIIRSSHVNAGGFVLRNAEQPDDKYDWVVAHDLNPQKARILAMVALTKTNDSKELQRMFWEY

SEQ ID NO: 81465 - protein, 182 aa, Escherichia coli
AYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDMILDEAANKGTGKWTSQSALDLGEPLSLITESVFARYISSLKEQRVAASKVLYGPQAQPAGDKGEFIEKVRRALYLGK

SEQ ID NO: 81466 - protein, 182 aa, Escherichia coli
AYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQRAGDKAEFIEKVRRALYLGK

SEQ ID NO: 81467 - protein, 273 aa, Vitis vinifera
MACSAPSTPTTLLSSNPRAFPSKSLSTVASFSKPLSPQTLTIPNSFNPLRKPFQSPVPRSISSRGSHSRRSLVVRASEAPLVGNKAPDFEAEAVFDQEFIKVTLSEYIGKKYVILFFYPLDFTFVCPTEITAFSDRYEEFEKLNTEILGVSIDSVFSHLAWVQTDRKSGGLGDLKYPLVSDVTKSISKSYDVLIPDQGVALRGLFIIDKEGIIQHATINNLAIGRSVDETMRTLQALQYVQENPDEVCPAGWKPGEKSMKPDPKLSKEYFAAI

SEQ ID NO: 81468 - protein, 618 aa, Microcystis aeruginosa PCC 7806
MVQQKFDEIIERIIKKFKNLEKKYDFILCEGSDYLQENSAFEFELNTEIAKNLGHPILILGNAHQRSIEDALSPILISCDTYQDKGCKVIGIIINQAEEEKTEELRKTLTKIFPPQEYALGVIPHNAKLSSPRVAEIAQQLQAKVLYGQHRLDSLASNFLVVAMQMQNALERIKEDSLIITPWDRGDVIIGMLQAHQSANYPQLAGIVLTAGHDLNPSIARLIEGLPDPLPILSVTTDTYTTAEHIHDVRTTLTSTDYDKINLSLQLFHSNINLDRLEAQIRTLRTQGITPKMFTYNLVQQAKAQKRHIVLAEGTEPRILQAATVLIEQDIVDLTLLGQPDEIEIVIKKHGITLDLDRLQIINPVASPHFESYVQTLYEARKAKGMNLDMARDYAQDVSYFGTLMVYQGDADGMVSGAVHTTQHTIRPALQIIKTKPDCAIVSSVFFMCLEDRVLVYGDCAVNPDPSAEELAEIALSSAETAQKFGIEPRIALLSYSSGQSGQGEDVEKVRQATKIAREKRPDLKLEGPIQYDAAVDREVAAQKMPGSEVAGQATVFIFPDLNTGNNTYKAVQRETKALAIGPILQGLKKPVNDLSRGCTVPDIINTVVITAIQSQSF

SEQ ID NO: 81469 - protein, 393 aa, Mycobacterium sp. JLS
MTATCRQSPCFVAASQKRHSSMNPALPIRHARTSHTRSAQPQRGRNERPATMVGQTPVLRISAPFTSEERGFWAKLEGFNPGGMKDRPALHMVERARSRGALAPGARIVESTSGTLGLGLALAGTVYGHPVTLVTDPGMEPIIQNMLAAFGADIELVTEPHPQGGWQQARRDRVQKILATDPRAWHPDQYSNPDNVEAYRGLALELNEQLGAVDVLVCSVGTGGHSAGVARVLREFNPQLRLIGVDTVGSTIFGQPAASRLMRGLGSSIYPGNVDYQAFNEVHWVAPAESVWACRTLAATHYASGGWSVGAVALVAGWVARNSPAGATVAAIFPDGPQRYFDTIYNDDYCRAHGLLDAAPPRHPATIEDPMTQTVTAWTRCTTVVDPTEVQSR

SEQ ID NO: 81470 - protein, 167 aa, Penicillium citrinum
MSLKAGDSFPEGVTFSYIPWAEDASEITSCGIPINYNASKEFANKKVVLFALPGAFTPVCSANHVPEYIQKLPELRAKGVDQVAVLAYNDAYVMSAWGKANGVTGDDILFLSDPEAKFSKSIGWADEEGRTYRYVLVIDNGKIIYAAKEAAKNSLELSRADHVLKQL

SEQ ID NO: 81471 - protein, 241 aa, Dichelobacter nodosus VCS1703A
MRKPIAAANWKMNGDFSLLDDFAQANITSDKCETIFALPSVLLDRAQKLGLNALAGQDVSAQVKGAFTGEISASMLKMLGCQYCIIGHSERRQYHHEDEALLIEKWRRLKEAEITPIYCIGELQAEYDAHATQQALERQLRPILEENLVDHKTIIAYEPVWAIGTGKAATPDYAQHVHQMIRQIVAQNYASIAPAMRLLYGGSVKPDNAGLLICQADIDGFLIGGASLDVGLFTKIIETMK

SEQ ID NO: 81472 - protein, 105 aa, Triticum aestivum
  misc_feature (26)..(26): Xaa can be any naturally occurring amino acid
  misc_feature (47)..(47): Xaa can be any naturally occurring amino acid
ARVLKKVEELHKTYYYMKDIFFQAHXPLIEKFRELTGYRMKVQKAMXKKDRHLPDKFLNLPPTNKLVRLIIERYTSLVDALRVLDDSLTMEHLFAGLPSIEGELV

SEQ ID NO: 81473 - protein, 478 aa, Vitis vinifera
MSYSYSSEKQNPYLPLKKSPSSWSNLWFKSPNKALNHVVFTMHLKSLTKHQLQPHKALIFDRTLLLSDELLLRVFQKLPESQRKPNSLVCKRWLSLQGRLVQSVKLLEWDFLESGRLVSRFPNLTRVDLVHACIVWPRSCGVLLNHRVVSVPVDSEVSQNGFLENGKVLASNVVDRGLRFLASGYPNLRKLAVVGASELGLLSVAEECSTLQELELHKCSDATLRAISGFGNLQILKLIGNAEGLYKSLVSDVGLTILAQGCTRLVKLELSGCEGSYDGIKAIGQCCQMLEELTLSDHRLDGGWLSALSYCENLKTLRFQSCRRIDVCPGLDEYLGSCPTLERLHLHKCQLRDKLSMRALYMISGAVRDFVIQDCWGLDNDILGLATTCRRVKLLSLEGCSLLTTEGLESAVLSWKDLQKLRVVSCKNIKDSEVSPALSTLFSILKELQWRPDTRSLLSSSLVESGMGKRGSKFFRKI

SEQ ID NO: 81474 - protein, 305 aa, Triticum aestivum
MGKSSKKSAVAVAPAAGLVPDGKSGKKGKRNAEDDIEKAASAKKQKTAPEKAVPVKNDLKVKKLPPKKVESSSSDEDSSESEDEVMVQPKKAAPSAKQESSSDSSDESSSDDEPAKKPATASKKPAALASNGSKKVKSDSSSSDSSSDEDVMVPPKKAAQSAKQESSSDGSDESSSDDEPAKKPAAASKKPAAKTEDSDSSSSDEDEDMLPAKAPAAAKKIEESSESSDFGSSDSDDAVRAQLARFQHEEEDDLTGSNTACLFCFSVASYSINTEHYARKSAAAIVQECTNSLNIVLFFYSKLFL

SEQ ID NO: 81475 - protein, 321 aa, Calystegia soldanella
KGQNPVFPRILGHEAAGIVESVGEGVTDLKAGDHVLPVFTGECKECRHCKSEESNMCDLLRINTDRGVMLEDQKSRFSINGKPIYHFVGTSTFSEYTVCHVGSVAKINPLAPLDKVCILSCGISTGLGATLNVAKPPKGSTVAVFGLGAVGLAAAEGARMAGASRIIGVDLVPSRFELAKKFGVTDFVNPKEHSKPVQEVIVEMTDGGVDRSVECTGNVNAMISAFECVHDVWGVAVLVGVPHKDAEFKTHPMNLLNERTLKGTFFGNYKPRSDLPSVVEKYMNKELELEKFITHEVPFAEINKAFDLMLKGEGLRCIITM

SEQ ID NO: 81476 - protein, 152 aa, Zea mays
ITVNEILRAKGEAEAGAVYWCSTGHLVHEAVQHMAAHNVGALVVLKSGDMNQLAGIVTERDFARKILLPGRPSQQTRVEDIMTEEDKVITVSGRTNILRAMEVMTDKRIRHVPVFDDKVVGMISIGDVVRTIVDQQHQEVKQLKKYIRGDYY

SEQ ID NO: 81477 - protein, 230 aa, Streptomyces avermitilis MA-4680
MTENFGVLGGTAHLSGVERVVNAPLPTVYGDFHAVGYLDHDRGEEQVALVYGEIGDIGGLGGVRGAGEEGVLTRLHSECLTGDAFGSRHCECGPQLTTALREIVAAGRGILVYLRGHEGRGIGLLAKLRAMKLQAEGLDTVEANLALGLPVDARDYGVAAKILHDLGVRSVRLLSNNPRKLESLLQHGINVVEQVPLLIPPCEENITYLRTKRERLDHILPHLDAVARSS

SEQ ID NO: 81478 - protein, 364 aa, Listeria monocytogenes str. 1/2a F6854
MRTIDSSSKKDGFRMPGEFEKHAGCYIIWPERPDNWRLGAKPAQKAFVDVATAISHFEPVTVVASSSQYVNARYMLPDEIRVVEMDNDDAWVRDSGPTFVVNDSGDVRGVDWSFNSWGGLVDGLYFPWDKDDQVAQKICELERKDRYRLADFVLEGGSIHVDGEGTLVTTEECLLSEGRNPQLSKQQIEMVLKEYLNLEKIIWLKRGIYLDETNGHVDNIFNYVRPGVVALAWTDDETDPQYEISKECFDILSNETDAKGRKLEVHKINVPKPILITDEESKGVDAVEGTLPREEGDRLAASYINYYTANGGVVFPLFGDPNDELAREKLQQLYPNCEVVGVKAREILLGGGNIHCITQQVPRG

SEQ ID NO: 81479 - protein, 369 aa, Listeria monocytogenes str. 1/2a F6854
MGQLKGLPVEDGFRMPGEYEPHIGCFMIWPERPDNWRLGGKPAQQNYKEVAVAISNFEPVTMFVSPNQYKNARKELPDTIRVIEMSNDDAWIRDYGPSFLVDDKGDMRGVDWGFNAWGGLLDGLYFPWDKDNQIAKKVCELERIDYYSQKDFILEGCSIHVDGEGTLVTTEECLLSEGRNPNLTKIEIEQTLKKYFHAQKVIWLKHGFYLDETNGHVDNIFNFVAPGEVVLSWTDNKSDPQYEISRECYDILANKTDAKGRTFIIHKLHCPDPVLITQTESEGVEAINGTFPRQAGDRLAASYVNYYTANGAIIFPLFDDPKDKDAQELLEMLYPDRKIVGIKAREILLGGGNIHCITQHLPDKSTIRE

SEQ ID NO: 81480 - protein, 1337 aa, Streptococcus downei
MNNRMLSFPSMLFLLAFGIVLSVSAGTTHADELANQTAKVADEASIVVSTSQAAVEQTQSQEKEISPAMEEDTSNLSLKPNAQQESQSPDSSTELQDPAEQTPPETSDASAPATTSADSVEKYAQDATQNQSSTSNGPGVIRATSAQVTATRSVVSSQSGDAIVDLSADKASYRQGEDVNLSVDFKNTTDKEQDVTVYADVYYIDNKLGTYKFSKHLKAGEGYKMQSGDLKIPASQFENNHGYLLKVRVRDADNNTLSEVNKAIAVESDWTKFPRYGIVGGSQDTNNSLLSKDADRYRAEIEKMKNMNINSYFFYDVYKTATNPFPSDEATFKQDWNTWSGSEIDTQAVKDIVNQVHDGGAVAMLYNMILAENTNTGEAPVLPETEYAYNSDDRGYGAQGQPMSYTVKIPKDGQEEDVEIQRYYNPTSKLWQDYIADKMGQAMKNGGFDGWQGDTIGDNEVYSYADKDSNDPSKKFWLTEGYAEFLRAIKEKLPNYYLTVNDVNGEQIYRLKDGNQDVIYNEIWPFGPALPSEMAAVKPNTVTSRPVLTKVRQGDWKISIVGAYMEGSENGGSKADAEAGKSLQTDAVLLTSASIAAAGGYHMSLAALANQQDETDGGQGIGVLQTAYYPTQSLKTSSELTRKNNDYQQFITAYENVLRDGVENDDAQVNTFDSNGQKLSTDAKGITGNQVWTYGKKGDNFRTVQLLNLMGINSDWKNEDGSAANKTPDEQTNLTVKYALGDVSMEDAQRMANQTYVTSPDDWSKSNLQKVSASVKTDENGKPVLVINVPKLTLWDVVYISNANQESAPEADQAQTPAAQSSDDKVAENETSQPAAEDAKEQTSEPAQDQAAPAEQGQAINQAESPATEPEAEVTPATAEPAKVDAPEANQAADQAVSPEPASQEQAASQSQPEANQTPASNETPATQGNSEQPELNEPTAQTQPSSQVSPANTSVTPVAEQPTNQGQAADKADQAPTNSTSTPESTSPVEPAATDQSSDTPIVTAGNLSVQPAETETPTVPDKQGDSKANQSSTETPVADQVPAVAEQPQATEPNQAKPSVDKAAAPEALSLIQLKQQTPAIQAKEADDPEVDETKSEVTPDSGTDKAPEAGQVDSDKAPTVKPSTPENNDNQPNNANDADKNKTNEADSNKANQDSTKGSSADQSGKSTTPEDGPDNSSPEDPETKPSDPNTDTSDQEQVKPSLPVVPNQTVDDPKTDDTDTPANTDSAKSKKVADADKNKVATDSEGRQKSSEFPKEATDLEKVGQPASPQVAGVKSSVATSPEKKSEPVSKTSTTSSSDKLPKTGDHKTVVLIIVLGLVFVGMTGLLARHEKK

SEQ ID NO: 81481 - protein, 433 aa, Burkholderia cepacia
MSLNDDATFWRNARQHLVRYGGTFEPMIIERAKGSFVYDADGRAILDFTSGQMSAVLGHCHPEIVSVIGEYAGKLDHLFSGMLSRPVVDLATRLANITPPGLDRALLLSTGAESNEAAIRMAKLVTGKYEIVGFAQSWHGMTGAAASATYSAGRKGVGPAAVGSFAIPAPFTYRPRFERNGAYDYLAELDYAFDLIDRQSSGNLAAFIAEPILSSGGIIELPDGYMAALKRKCEARGMLLILDEAQTGVGRTGTMFACQRDGVTPDILTLSKTLGAGLPLAAIVTSAAIEERAHELGYLFYTTHVSDPLPAAVGLRVLDVVQRDGLVARANVMGDRLRRGLLDLMERFDCIGDVRGRGLLLGVEIVKDRRTKEPADGLGAKITRECMNLGLSMNIVQLPGMGGVFRIAPPLTVSEDEIDLGLSLLGQAIERAL

SEQ ID NO: 81482 - protein, 320 aa, Kluyveromyces lactis NRRL Y-1140
MATNSIKLLAPDVHRNLAELVAKRLGLKLTNCKLKRDPSGEVSFSIGESVRDQDIFIVTQIGSGDVNDRVLELLIMINASKTASARRITAIIPNFPYARQDRKDKSRAPITAKLMADMLTTAGCDHVITMDLHASQIQGFFDVPVDNLYAEPSVVRYIKENVNFKEAIIISPDAGGAKRAAGLADRLDLNFALIHKERARANEVSRMVLVGDVSDKICIIVDDMADTCGTLAKAAEVLLENKAKSVIAIVTHGILSGKAIENINHSKLDRVVCTNTVPFEEKMLRCPKLDAIDISSVLAEAIRRLHNGESISYLFKNYPL

SEQ ID NO: 81483 - protein, 359 aa, Desulfotalea psychrophila LSv54
MHYCQSLQMGCLLLFFAVVRIAVSFRIAINGYGRIGQSVLRALYTSEVGKHFKVVAINELADIETIRYLTKYDTTHGRFPLPISSENGCLIVNDDRIEIFREKDPRMLPWKELDIDLVFECSGSFHDRETAELHLASGAKRILISHPSCKEVDATVVFGINEGLLKPAHRVVSNASCTTNCILPVLHLLEKNFGVENGLITTVHSAMNDQPVIDSYHNTNLRLTRSALQSIVPVDTGLSNGLQTIYPAFKGKFQCLHLRVPTINVSLMDLSVNLKENVSVEDINNLFAGVAKRELQGLLGYTRETHASVDFNTDSRSCVVDGTQTRVCGGKLVKMICWFDNEWGFANRMVDVAGHWLTL

SEQ ID NO: 81484 - protein, 295 aa, Mycobacterium avium 104
MLSGMARIAIIGGGSIGEALLSGLLRAGRQVKDLVVVERVPERAKYLADTYSVLMTSVADAVENASFVVVAVKPADVESVMSEIARAAGQAESDTAEQVFVTVAAGVTIGYFESRLPAGTPVVRAMPNAAALVGAGVTALAKGRFVTAPQLEGVSALFDSVGGVLSVPESQMDAVTALSGSGPAYFFLLVEALVDAGVAAGLSREVAADLTAQTMAGSAAMLLERMDADRRLGEAETPGMRVDATATQLRATVTSPGGTTAAGLRELERGGLRAAVDAAVQAAKIRSEQLRITSE

SEQ ID NO: 81485 - protein, 309 aa, Desulfotalea psychrophila LSv54
MKNMKKIAVIGSNMVDLVTYTDRMPVAGETLEAPDFDLGFGGKGANQAIAAAKLGGEVLMLSKVGDDVFGPNTRANFVANGIDARYVETAAGISSGVAPIFVDAKGQNSILIVKGANKHLSPVDVDRAIDDIRACDLIVMQLEISLETVYYVIELGLREHIPVLLNPAPAVAGLDMEKICQLDMLVPNETELEILTGMPVQTLEQIQAAAKFLIDAGIKKVIVTMGSKGALLVTEKEMTSVPCPQVKAKDTSGAGDAFIGCFAKHYVEGGELIPAMEEAVIYASLSTTRPGTQKSYADIDQFEAYKRFL

SEQ ID NO: 81486 - protein, 182 aa, Escherichia coli
AYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGK

SEQ ID NO: 81487 - protein, 305 aa, Pseudomonas fluorescens PfO-1
MSANVVVIGSLNMDLVTRAPRLPRGGETLIGHSFATVSGGKGANQAVAAARLGAQVSMVGCVGNDEYGVQLHDALLAEQIDCQAVSVVEDSSGVALIVVDDNSQNAIVIVAGANGSMTPAVIDRFDAVLQAADVIICQLEIPDATVGHALKRGHELGKMVILNPAPASRPLPVDWFAAIDYLIPNESEAAALCGLPVDSLETAEKAAAHLISLGAGKVIITLGAQGSLFANGTGYQYFPAPKVKAVDTTAAGDTFVGGFAAALAAGKTEDEAIRFGQVAAALSVTRAGAQPSIPTTSDVQAFKPA

SEQ ID NO: 81488 - protein, 451 aa, Vitis vinifera
  misc_feature (368)..(368): Xaa can be any naturally occurring amino acid
MASRAVVPRDHQQPRGEAVAGNGKQKKIVAAERRNRQALGDIGNLVTIGVDGKPQPQISRPITRGFCAQLLAKAKEAENNKKAVRANVDGAQLRANVDGALLVTNGAAAGKGPEAEKAAQKKVAVKTKPEAVIELSSDTEEVKKEKPINTKKTGEGSSRKKVQTMTSILTSRSKEQIVDIDAADANNELAVVEYVEDIYKFYKLIESESHIHDYMDSQPEMNEKMRSILVDWLIEVHHKFELMPETLYLTINIIDRFLSVKTVPRRELQLVGISAMLIASKYEEIWAPEVNDFVCISDRAYSDQQIRNMEKAILGRLEWTLTVPTPYVFLVRFIKASIPDQEMEHMVYFYAELGLANYATMMYCSSMXAASSVYAARCALNKSPVWDETLKAYTGFSEAQLLDCAKLLASFHSMAAENKLIKAVYRKYSQPHRSGVAFRPPAKVLLAAAAS

SEQ ID NO: 81489 - protein, 186 aa, Oryza sativa
  misc_feature (12)..(12): Xaa can be any naturally occurring amino acid
  misc_feature (57)..(57): Xaa can be any naturally occurring amino acid
  misc_feature (96)..(96): Xaa can be any naturally occurring amino acid
  misc_feature (124)..(124): Xaa can be any naturally occurring amino acid
  misc_feature (138)..(138): Xaa can be any naturally occurring amino acid
  misc_feature (175)..(175): Xaa can be any naturally occurring amino acid
MGLFNNIPTDPXIEVFHLTELFNQDANPSKVNLGIGVYQDENSKTLTLPVVRSVEQXMAQDLTLTKTYLKGTGLDAFCTACLKLVLGEQSPAIVEXRACSIQSLSGTGALRIGLDFLYRMVSVXAYVSAPTWGNHDSXLQTVGFEVRKYRYWDKEKLGLNIDGLIADLKPAPEKXVVILHACAHNP

SEQ ID NO: 81490 - protein, 384 aa, Haemophilus somnus 129PT
MTDLDLAGKRVFIRADLNVPVKEGKVTSDARIKATIPTLKLALEKGAKVMVTSHLGRPTEGEFKPEDSLQPVVDYLKGAGFNVRLAQDYLNGVEVNEGEIVVLENVRVNKGEKKNDPELSKKYAALCDVFIMDAFGTAHRAQASTYGVAEFAPVACAGPLLAAELEALGKALKEPQRPMLAIVGGSKVSTKLTVLDSLSKIADQLIVGGGIANTFIAAEGHNVGKSLYEADLIPEAQRLSKVTNIPVPVDVRVGTEFSETALSTEKSVADVSGEESIFDIGDKSAEQLADIIRNAKTILWNGPVGVFEFPNFRKGTEIVSNAIAEATANGAFSIAGGGDTLAAIDLFGIKDKISYISTGGGAFLEFVEGKVLPAVEILEKRANG

SEQ ID NO: 81491 - protein, 280 aa, Glycine max
MAATSSLCSSTLQSQINGFCLHKTSLSHPRSLTFSRKKISTTVKATSRVDKFSKSDIIVSPSILSANFAKLGEQVKAVELAGCDWIHVDVMDGRFVPNITIGPLVVDALRPVTDLPLDVHLMIVEPEQRVPDFIKAGADIVSVHCEQSSTIHLHRTVNQVKSLGAKAGVVLNPATPLSAIEYVLDVVDLVLIMSVNPGFGGQSFIESQVKKISDLRRLCAEKGVNPWIEVDGGVGPANAYKVIEAGANALVAGSAVFGAKDYAEAIRGIKTSKRPEVVAV

SEQ ID NO: 81492 - protein, 318 aa, Bradyrhizobium sp. BTAi1
MDWTDRHCRVFHRLLSRRALLYTEMVTTGAVIHGDRKRLLGFDASEHPVALQLGGSDPADLATSARIGEDFGYDEINLNVGCPSDRVKDGRFGACLMAEPELVAACVAAMKRAVRIPVTVKCRIGIDDQDPELALDTLADAVVDAGADALIVHARKAWLNGLSPKENREIPPLDYDRVYRLKARLPNVPVIINGGITSIAAAQAHLAHVDGVMLGRAAYQEPWQLLDVDPMLFGDAAPHRSMKDALAALEPYIERQLREGSRLHAITRHLVGAYHAVPGARAFRRHLAERGVKPDAGIEVLREAVAMVEERAPAAAFA

SEQ ID NO: 81493 - protein, 242 aa, Rhodospirillum rubrum ATCC 11170
MDCEMIEPLPAPCLDVVENLRAVRGAIADACKPVGRDAAGVALVAVSKNNGPERVRAALRAGHRLFGENRVQEAQGKWPAFKADHADIDLHLIGPLQTNKVREAVALFDAIDSVDRPRLARALAEEMDHQGRRLPVLIQVNTGEEPQKAGILPRDADGFLRECREDLGLDVRGLMCIPPVDDEPSPHFALLREIARRHGLGVLSMGMSADYGVAVAFGATHVRLGTAIFGDRRALLGTPIGG

SEQ ID NO: 81494 - protein, 620 aa, Pisum sativum
MQAKPIHSPLPYIVPPLLRPPPVHHASLSSQTITKPKPVPAPAPIPTTDVVIPGRILQPVQPFIDHDDPIAASWDYNFLFMSQRSETTQPIRLRVVEGEIPTDFPSGAYYLTGPGIFKDDHGSTVHPLDGHGYLRAFAFDNATKEVKYMAKYIKTEAQVEEFDRKTNSWRFTHRGPFSVLKGGKKIGNTKVMKNVANTSVLMWGKKLLCMWEGGNPYEIESDTLDTIGKFNMTDGCDSADHGESHGGDVWEVAANLLKPILYGIFKMPPKRLLSHYKLDSSMNRLLTVACNAEDMLLPRSNFTFTEYDSNFKMVEKQEFKIPDHMMIHDWAFTDTYYIVFANRIKLDILGSMFAVCGASPMISALTVNPSKSTSPIYLLPRFPNKSESKKRDWKIPLEIPSQLWLLHVGNAFEVKHDHGNLDIQILASACSYQWFNFRKLFGYKWQTKHLDPSIMNVKGENALPHLVQVSIKLDSDYNCQECDVKPIHKWKKSADFPAINPTFSGKQNKYLYSATTLGSRKSLPSFPFDTVVKFDLTNNSVQTWTAESRRFIGEPIFVPKGEDEDDGYLLVVEYATSMQRCCLVVLNPKEIGTKKALVARLEIPMHLNFPLGFHGFWAAS

SEQ ID NO: 81495 - protein, 390 aa, Sulfolobus shibatae
LDTLEALSQPERVIQVKIQIRGSDGKLKTFMGWRSQHNSALGPYKGGVRYSPNVTQDEVIALSMIMTWKNSLLLLPYGGGKGGIRVDPKKLTLKELEDLSRKYVQLIHNYLGSDVDIPAPDINTNPQTMAWFLDEYIKITGEVDFAVFTGKPSELGGIGVRLYSTGLGVATIAREAANKFIGGIEGSRVIIQGFGNVGSFTAKFLNEMGAKIIGVSDIGGGVISDDGIDVNKALEVVQSTGSVVNYPEGKKVTNEELLTSDCDILIPAAVENVINKFNAPKVKAKLIVEGANGPLAADADEIIKQRGIVVIPDILANAGGVVGSYVEWANNKSGGIISDEEAKKLIIDRMTNAFNALYEFHKRKFADQDLRTVAMALRVDRVVGMKARAI

SEQ ID NO: 81496 - protein, 321 aa, Calystegia soldanella
KGQNPVFPRILGHEAAGIVESVGEGVTDLKAGDHVLPVFTGECKECRHCKSEESNMCDLLRINTDRGVMLEDQKSRFSINGKPIYHFVGTSTFSEYTVCHVGSVAKINPLAPLDKVCILSCGISTGLGATLNVAKPPKGSTVAVFGLGAVGLAAAEGARMAGASRIIGVDLVPSRFELAKKFGVTDFVNPKEHSKPVQEVIVEMTDGGVDRSVECTGNVNAMISAFECVHDVWGVAVLVGVPHKDAEFKTHPMNLLNERTLKGTFFGNYKPRSDLPSVVEKYMNKELELEKFITHEVPFTEINKAFDLMLKGEGLRCIITM

SEQ ID NO: 81497 - protein, 384 aa, Rhodospirillum rubrum ATCC 11170
MTDNAPCVPFASAAADPLADTGRLLARVDRGLAELRLGAAVTITGDDGRLMALAAESASAQTLADLAALGPSPRVILTGRRASVLGLAPAATTPVAVTLKGGLDVGAICRLADPCLDLDGPLPAIAAVDPIAGDGSAGAAVVLAKLARLLPAAVVVALEGAGPPATDPAAPLAFALAATDILRYQTAAARSLRKVSEARVPLAGAEHTRILAFRPSDGGTEHLAIIVGEPDSLQPVLTRLHSECFTGDLLGSLRCDCGDQLRGALDAIAAEGSGVLLYLAQEGRGIGLVNKLRAYQLQDQGFDTLDANGQLGFDDDERIYLPAAEILRQLGISRVRLLTNNPLKVEALGRHAITVVERVPHIYEPNPYNLRYLQTKARRSGHLF

SEQ ID NO: 81498 - protein, 261 aa, Bacillus megaterium
MYTDLKDKVVVVTGGSKGLGRAMAVRFGQEQSKVVVNYRSNEEEALEVKKEIEEAGGQAIIVRGDVTKEEDVVNLVETAVKEFGSLDVMINNAGVENPVPSHELSLENWNQVIDTNLTGAFLGSREAIKYFVENDIKGNVINMSSVHEMIPWPLFVHYAASKGGMKLMTETLALEYAPKGIRVNNIGPGAIDTPINAEKFADPEQRADVESMIPMGYIGKPEEIASVAAFLASSQASYVTGITLFADGGMTKYPSFQAGRG

SEQ ID NO: 81499 - protein, 269 aa, Escherichia coli O157:H7 EDL933
MEKKIGFIGCGNMGKAILGGLIASGQVLPGQIWVYTPSPDKVAALHDKFGINAAESAQEVAQIADIIFAAVKPGIMIKVLSEITSSLNKDSLVVSIAAGVTLDQLARALGHDRKIIRAMPNTPALVNAGMTSVTPNALVTPEDTADVLNIFRCFGEAEVIAEPMIHPVVGVSGSSPAYVFMFIEAMADAAVLGGMPRAQAYKFAAQAVMGSAKMVLETGEHPGALKDMVCSPGGTTIEAVRVLEEKGFRAAVIEAMTKCMEKSEKLSKS

SEQ ID NO: 81500 - protein, 440 aa, Synechococcus elongatus PCC 7942
MSLWGNRVDCYEVARSMVAALAAPRLNAPHWQQLENGLIIIAERLPVPAVTFDLWVKVGSAVEPDAVNGVAHFLEHMVFKGSQRLKAGEFEQQVEARGAIANAATSQDYTHFYFTCAPSDFTDLVSLQTDVVLNPLLAEAEFERERRVVLEEIRRAADNPRRRAYYRMIEAAFERLPYRRPVLGPYDTIAQLPLTDLQAFHRQWYGPNQLVAVVVGDLPEAEMIDAVRAAVADHPPVTAQRSPLLPEPAFSQPQQQIYHDADLHQARLYLTWRVPGLSQLSRTYALDAIASILASGRTSRLVAQLREQQGLVSNIVASNSTYRDQGLFAITARLPVAHLDTVRSQVLAELQSLQTEPVTPAELERIRRQVVNRFIFGNERPSDRASLYGYYATLLGSLEPAFNYVDEIHALSVDDLQAAVQTYLAPEACSTIQILPGEHG

SEQ ID NO: 81501 - protein, 511 aa, Coccidioides immitis RS
MESLPFPSPTVQLLPTVVIIGVLSIFIGNLLRQFAPHRGAKPPVVFHWVPFIGSAISYGLDPYRFFTSCREKYGDIFTFVLLGRKVTVYLGVKGNEFILNGKLQDVNAEEVYSPLTTPVFGSDVIYDCPNQKLMEQKKFIKFGLSSEALASYVPLIQHEVEQYIASSPHFKGESGTMNVLQVMAEITILTAARTLQGEEVRSKLDSSFANYYHDLDSGFTPINFLLPWAPLPHNRKRDAAHKKMRDVYMDIIKKRRISGQERGHDMLWNLMDNCVYKDGTALPDKEIAHLMITLLMAGQHTSSAISAWAILQLAAHPEVMEGLYQEQVQVFGPSKSITLGDIDRLSFSQMVIKETLRLHAPIHSIMRKAKNTMAVPGTNLVIPESHILLSAPGFTARSEDHFKDAAKWNPHRWLSVIERSEADEKIDYGYGVTIKGTKSPYLPFGAGRHRCIGEKFAYVNLGVILAVMVRHFKLRNPDNRVGVPATDYRSLLSRPMEPSSVHWEKRNFVSE

SEQ ID NO: 81502 - protein, 215 aa, Wolbachia endosymbiont of Drosophila simulans
IAQVLMMVTTVTMAFTPLLSGLGDWIANSFSTEKTILDDEAVETDTQDLYNHVIVAGFGRVGYMVTKMLTAEHLSYVVVDIQSKIVKEGKSDSFPIYLGDVTRCEILKSVGIERAQALVISIKNEVTIKKVVSLVAANFPHVNIVIRLPDLSNVEVYRDLGASKIIPETSEIGLQLGGAALSLSGISESGVTSLKSRFRKGNYSMLKDLGSDKDE

SEQ ID NO: 81503 - protein, 175 aa, Triticum aestivum
MAPTVMASSATSVAPFQGLNSTVGLPVSRRSNGASLGSVSNGGRIRCMQVWPIEGIKKFETLSYLPRLITEALLKQVDYLIRSKWVPCLEFSKVGFIFREHNTSPGYYDGRYWTMWKLPMFGCTDATQVINEVEEVKKEYPDAYVRIIGFDNMRQVQCVSFIAFKPPGCEESDKA

SEQ ID NO: 81504 - protein, 233 aa, Dechloromonas aromatica RCB
MSAKDYVIAPSILSANFAKLGEEVANVIASGADWIHFDVMDNHYVPNLTIGPLVCEAIRPCTTAPIDVHLMVKPVDRIIPDFAKAGANIITFHPEASEHVDRSLSLIRDAGCKGGLVFNPATPLDYMDYVLDKIDVILLMSVNPGFGGQKFIPGTLAKAKQARAKLDAYERETGRRIRLEIDGGVNTANIAEIARAGVDAFVAGSAVYGAGKDSDPHRYDSIIGALRSELAKV

SEQ ID NO: 81505 - protein, 570 aa, Shigella flexneri 2a str. 301
MSEKHPGPLVVEGKLTDAERMKLESNYLRGTIAEDLNDGLTGGFKGDNFLLIRFHGMYQQDDRDIRAERAEQKLEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPGRPLKTGLLEIAKIHKGDFRITANQNLIIAGVPESEKAKIEKIAKESGLMNAVTPQRENSMACVSFPTCPLAMAEAERFLPSFIDNIDNLMVKHGVSDEHIVMRVTGCPNGCGRAMLAEVGLVGKAPGRYNLHLGGNRIGTRIPRMYKENITEPEILASLDELIGRWAKEREAGEGFGDFTVRAGIIRPVLDPARDLWD

SEQ ID NO: 81506 - protein, 442 aa, Debaryomyces hansenii CBS767
MLSRSIKTTTRRLPSVCKKPVLQTGAKIGNVMMTRSIQTESYKSVRDMNKMSNNMLNFKRFASQTVKVPEMAESITEGTLSEYLKEVGDFVNQDETIATIETDKIDVEVNAPVSGTITERLVEVEENVTVGQDLVKIEEGEAPAGGAKEESKEESKEEPKKEESAAPKKEEAPKPKKEEAPKPKKEEPKKEAKKETSKSGEEATFTNFSRNEERVKMNRMRLRIAERLKESQNTNASLTTFNEVDMTNLMEMRKLYKDEFLDKTGIKLGFMGAFAKASTLAMKEIPSVGASIENNDTLVFRDYADISVAVATPKGLVTPIVRNAESLSILGIEKSISDLGRKARDGKLTLEDMTGGNFTISNGGIFGSLYGTPIINLPQTSVLGLHGVKQRPVTVNGQIESRPMMYLALTYDHRVLDGREAVIFLRTIKELIEDPRKMLLLQ

SEQ ID NO: 81507 - protein, 430 aa, Dichelobacter nodosus VCS1703A
MTITISRIHALEILDSRGNPTLQVGVTLSDGSFAQAGVPSGASTGSREALELRDGDAQRYLGKGVQKALANVKNHFAPALIGKPIYDLAALDRIMLAQDGTDFKTHLGANAILGVSLALARAKGASLKKPLYAVLCPQEEYTLPVPMMNIINGGEHADNSVDIQEFMIVPAGFDRFSEALRAGSEIFHTLKKVLKEQGLNTAVGDEGGFAPDLPSNEAAFAVIMQAIERAGYRAGEQIFLAMDAAASEFYREGRYHLASEQKAYTSAEFVDYLADLCRRYPIVSIEDGLHESDWDGWQLLTQSLGERVQLVGDDLFVTNSAILQEGIDKGVANAILIKPNQIGSLSETLQTIALADAAHYAAIISHRSGETEDTTIADIAVATTATQIKTGSLCRSDRVAKYNRLLTIEDELGTRARYAAKAAFLGKIKA

SEQ ID NO: 81508 - protein, 476 aa, Candidatus Kuenenia stuttgartiensis
MLEIMKETKFDYGMIGLGTMGCNLVYNMSDNGYTVIGFDKNRSQVETLKKEAGTEKISATSDLNEFLNTLKTPKVIIMLVPAGKIVDDVISELKPFLSKNDLLMDFGNSHFTDTNRRSEQLEESAIHFMGVGISGGELGARHGPSIMPGGPKKVYERVAEMLKAVSAKANNEPCVTWLGPGSAGHYVKMVHNGIEYGLMQLIAEAYHLLKECAAMSNDELHTVFSKWNEGELQSYLIEITADIFMQKDELTDSRIIDRILDSAKQKGTGAWTSEDAMNLQVPIPVIDIAVSMRDLSAYKNEREVAHQNMGGSEVKFTGDKNDLVKWVEQALYFSIITVYVQGMALLQVASKKYKYDLKLEDIAAIWRGGCIIRAALLEDIRSAFSKQPDLSNLILSVAFSKKLMQSQEGIRKVIQTGVGFGIPVPAMMGALAYFDSYRSGWLPANLIQAQRDDFGAHTYERNDREGIFHTHWNQKK

SEQ ID NO: 81509 - protein, 509 aa, Candidatus Kuenenia stuttgartiensis
METETKIGHTIIIILGATGDLTWRKLIPAIYNLWLDGWIPGEFAVIGVSRRKYTDPEFGKHLHEGVDKFSRQGKAKKDHWDVFTKYLTYLQGEFDATSTYAAIGKQIKALEKKWNATANSVFYLAVPPNQFEGISMKIGSSELAENKEKSRIVIEKPFGHNLESAINLNTLLHTHFDESQIYRIDHYLGKETVQNILAFRFANALFEPIWNRNYIDHIQITVSEELGVEHRGNYYETAGALRDMIQNHLLQLMCLIAMEAPISFDANEIRNKKVDVLNAVRKMKPEEVHKNAIRGQYGSGWVKGKKVKSYRQEPDVSPSSNVETFAAVKLYVDNWRWQGVPFYVRTGKRLNETISVITIQFKPVPHHSFPVEAIENWQSNKLILNIQPHMGIQLSFQAKQPGLKMLLNPVHMLFNYHDTYTGGTPEAYETLLIDVFRGDATLFMRADQVEAAWTILMPVLDAWKANTSPNFPTYDAGSHGPQDADALIAVDGHNWITIPFEKNEIASTK

SEQ ID NO: 81510 - protein, 665 aa, Dichelobacter nodosus VCS1703A
MYQVLARKWRPKTFRELVGQQHITQALSYALDHDRLHHAYLFTGTRGVGKTSLARIYAKSLNCLINGTSAQPCGQCEHCLEIDQGRFPDLIEVDAASRRGIDETKELLDNLPYAPVKGRYKVYLIDEVHMFTRESFNALLKTLEEPPPHVKFILATTDIQKVPTTVLSRCLQFHLKNINPEQLRQHLAHILQVERIDYEAEALVLLAQAARGSMRDGLSFLDQAIAYGQGVVKTDDVAYLLGAVPTAQIYRLLTKIAESDARAVRAILTELDAFSPDYMDVLRHVFQGLQQITVAQLQAQQNPNEIDQTLVRLAQQLPVELVQLWYQIISDAWQSMPYQPDMRVALEMTFLRMIALQPLLPETTISEKHIIPEPDNDVDLPPWRDDESEMNTAPLESSENDVPDNNDVDLPPWHDDESEMINTAPAEPLENDAPDNNGVDLPPWRDDELEMMNTAPAEASENDVPNDNDADMPPWRDDELEMINTAPLESSENDVPDNNDVDLPPWHNDELEMNTVPLKSSENKSVIQLEQAVNQLQLWSQFLNTLPVEDVFLQSLVEQSIPVSFQNDSLQLAVLSAAASWVNEQRLADLTRILSASCARKIAVSITFDDTIATSAMLRQQESDQMHQMAKQKLLQNPVVRTLMTDFHGKIMRDSICVLDKKESI

SEQ ID NO: 81511 - protein, 719 aa, Capsicum annuum
MALCAYAFPGILNRTVAVASDASKPTPLFSEWIHGTDLQFQFHQKLTQVKKRSRTVQASLSESGEYYTQRPPTPIVDTINYPIHMKNLSLKELKQLADELRSDTIFNVSKTGGHLGSSLGVVELTVALHYVFNAPQDRILWDVGHQSYPHKILTGRREKMSTLRQTNGLAGFTKRSESEYDCFGTGHSSTTISAGLGMAVGRDLKGRNNNVIAVIGDGAMTAGQAYEAMNNAGYLDSDMIVILNDNRQVSLPTATLDGPVPPVGALSSALSRLQSNRPLRELREVAKGVTKQIGGPMHELAAKVDEYARGMISGSGSTLFEELGLYYIGPVDGHNIDDLISILKEVRSTKTTGPVLIHVVTEKGRGYPYAERAADKYHGVAKFDPATGKQFKGSAKTQSYTTYFAEALIAEAEADKDIVAIHAAMGGGTGMNLFLRRFPTRCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFHIVATAAAIDDRPSCFRYPRGNGIGVELPAGNKGIPLEVGKGRILVEGERVALLGYGSAVQNCLAAASVLESRGLQVTVADARFCKPLDRALIRSLAKSHEVLVTVEKGSIGGFGSHVVQFMALDGLLDGKLKWRPIVLPDRYIDHGSPADQLAEAGLTPSHIAATVFNILGQTREALEVMT

SEQ ID NO: 81512 - protein, 590 aa, Desulfovibrio vulgaris subsp. vulgaris str. Hildenborough
MARGILYGIAVSSGISIGKAFFMDRSRQSAAHDIIQPGAAESEVARLDEAAAQVASDLDRARAQVPADLRDHAAIIDSHRMICRDPKLMGDAARRIREQNISAPWALEQAVDAIAQAFRAIDDPYIRERVQDVRAVAERILSRLAGNARELKSTGERMVLLAHDLTPADTIELQVSRIMSFATAEGGKTSHTGILARSLQIPAVVGVSGLEEATADGDLVIIDALRGRILIDPDEHELAEYTELKYQFESYQRSIRRQSTLPAETLDGYRIEVQSNIELLEEVPQVLDSGADGVGLYRTEYAFLARRQPPSEQDLCDEYSQVAALMSPRQVVFRTLDVGADKMLREQVRMEEPNPALGLRAIRFCLRHQDVFRTQLRAILRASVHGNVALLFPMISGIQELRQARHILQEVRQELDAEGIPHAPDMPVGIMVELPSAVLIADALAHEVDFFSIGTNDLIQYSLGIDRGNRHVSYLYQPLHPAIVRSIKLVVDSAHRAGISVSVCGEVASDPFCLPILMGMQIDSISIAPQAVPGIKHIIRKTNMEECKTLTRDVLNATTVSTINRMVKETIYNRFPEELTFFSSMLDTDD

SEQ ID NO: 81513 - protein, 284 aa, Rhodospirillum rubrum ATCC 11170
MPLTPALRERLAALLGTPLLEDHALSGGDIAEVRAARCADGRRLVIKLGAKGADLASEGAQLGRLAAAGVPVPKVWLAEDAVLVMAQVEAGEALAGPAQEDLARVLAALHAQPQPFFGFECATAVGGLVQPNPQGPRWIAFFAEHRLLAMAAQGVAAGRLPIALAKRVETLAGRLERWLIEPPHPSLIHGDLWGGNVLCRGGKVAALIDPAPSYSHPVELAFGTLFSTLDDVFFDHYQRFLPIEPGFFEERRVLYTLYPLLVHVRLFGGGYGSQVDRLLSRFGL

SEQ ID NO: 81514 - protein, 2208 aa, Arabidopsis thaliana
MSAASSSSVLHLRTNQQLLSLRSLKNSTSVASQLAVTSGVSRRRSCTARCSVKKPVIPESPFLGTRVRRSGSETLQFWRSDGPGRSAKLRTVVKSSFSAVPEKPLGLYDPSYDKDSCGVGFVAELSGETTRKTVTDSLEMLIRMTHRGACGCESNTGDGAGILVGLPHDFYAEAATELGFVLPSAGNYAVGMFFLPTVESRREESKNVFTKVAESLGHSVLGWRLVPTDNSGLGNSALQTEPIIAQVFLTPTTKSKADFEQQMYILRRVSMVAIRAALNLQHGAMKDFYICSLSSRTIVYKGQLKPDQLKDYYYADLGSERFTSYMALVHSRFSTNTFPSWDRAQPMRVLGHNGEINTLRGNVNWMRAREGLLKCNELGLSKKELKKLLPIVDVSSSDSGAFDGVLELLVRAGRSLPEAVMMMIPEAWQNDKNIDPSRKEFYEYLSALMEPWDGPALISFTDGRYLGATLDRNGLRPGRFYITHSGRVIMASEVGVVDVPPEDVMRKGRLNPGMMLLVDFEKHIVVDDDALKQQYSLARPYGEWLKRQKIELKDIIESVPEAERIAPSISGVVPASNDDDSMESMGIHGLLSPLKAFGYTVEALEMLLLPMAKDGSEALGSMGNDTPLAVMSNREKLCFEYFKQMFAQVTNPPIDPIREKIVTSMECMIGPEGDLTETTEEQCHRLSLKGPLLKIEEMEAIKKMNYRGWRTKVLDITYAKERGTKGLEETLDRICDEANEAIKEGYTLLVLSDRAFSATRVAVSSLMAVGAVHHHLVKTLARTQVGLVVESAEPREVHHFCTLVGFGADAICPYLAVEAVYRLQVDGKIPPKSNGEFHSKEELVKKYYKASNYGMMKVLAKMGISTLASYKGAQIFEALGLSSEVIQKCFAGTPSRVEGATFEMLARDGLQLHELAFPTRGYAPGSAEASALTNPGNYHWRKNGEIHLNDPLAIAKLQEAARTNSVAAYKEYSKRINELNKQSNLRGLMKFKDADVKIPLDEVEPASEIVKRFCTGAMSYGSISLEAHTTLAMAMNKLGGKSNTGEGGELPSRMEPLADGSRNPKRSSIKQIASGRFGVSSYYLTNADELQIKMAQGAKPGEGGELPGHKVIGDIAITRNSTAGVGLISPPPHHDIYSIEDLAQLIHDLKNANPGARISVKLVSEAGVGVIASGVVKGHADHVLIAGHDGGTGASRWTGIKNAGLPWELGLAETHQTLVANDLRGRTVLQTDGQLKTGRDVAVAALLGAEEFGFSTAPLITLGCIMMRKCHKNTCPVGIATQDPVLREKFAGEPEHVINFFFMLAEEVREIMSGLGFRTVTEMIGRADMLELDREVVKNNDKLENIDLSLLLRPAAEIRPGAAQYCVQKQDHGLDMALDQELIALSKSALEKSLPVYIETPICNVNRAVGTMLSHEVTKRYHLTGLPKDTIHIKFTGSAGQSLGAFLCPGIMLELEGDSNDYVGKGLSGGKVVVYPPKGSSFDPKENIVIGNVALYGATSGEAYFNGMAAERFSVRNSGAKAVVEGLGDHGCEYMTGGTVVVLGKTGRNFAAGMSGGIAYVLDVDGKFNTRCNLELVDLDKVEDEEDKMTLKMMIQQHQRHTNSQLAQEVLADFENLLPKFIKVFPRDYKRVLSAMKHEEVSKQAIERASEEADETEEKELEEKDAFAELKNMAAASSKEEMSGNGVAAEARPSKVDNAVKNGGFIAYEREGVKYRDPNVRLNDWNEVMEESKPGPLLTTQSARCMDCGTPFCHQENSGCPLGNKIPEFNELVYQNRWQEALNRLLETNNFPEFTGRVCPAPCEGSCVLGIIENPVSIKSIECAIIDKAFEEGWMVPRPPLKRTGKKVAIIGSGPAGLAAADQLNKMGHLVTVYERSDRIGGLMMYGVPNMKTDKIDVVQRRVDLMTKEGINFVVNANIGKDPSYSLDGLKEENDAIVLAVGSTKPRDLPVPGRDLSGVHFAMEFLHANTKSLLDSNHEDGNYISAKGKKVVVIGGGDTGTDCIGTSIRHGCTNIVNLELLPQPPSTRAPGNPWPQWPRVFRIDYGHQEATTKFGKDPRTYEVLTKRFIGDDNGNVKGLELVRVSWEKDETGRFQFKEIEGSEEIIEADLVFLAMGFLGPEPTLAEKLGLECDNRSNFKAEYGRFSTTVEGVFAAGDCRRGQSLVVWAISEGRQAADQVDKFLTKTDDDEDAKLQQDLNQMKHNTITN

SEQ ID NO: 81515 - protein, 544 aa, Candida glabrata CBS 138
MGSDDDRDMRKDVQMEQVPVSILTNKLHISGTGPVPVRDLRSSEKKVGGGILNTSAKENSSVPMDNEFLSQNKSVDGNGLVSMSSGDGRVIGSRNISFSSGIIQFPNGNDDGASIISDANGITVERKASITSPKSTISFTVDENEKTSHHRYSISSKPGKSTTSIDSLAIEGKNNSIDAKDSVKGNTKDEVEAVPEQKNSIVNMPGDFIFFESRKHEHNSNETDGKEKSLKSKKSGISGASGSKEVIGSTSGPQIPFSEYFLRQDDKKFHILIGATGSVATIKVPLIIDKLLKLYTPDKISIQLIVTKPAEHFLNGLKISTHVKIWREEDVWSDCKKMGDMILHHELRKWADIFLIVPLSANSLAKIANGISNNLLTAVLRDWSPNTPIYAAPAMNTFMYINPMTKKHLNILASDMPYITVLKPVEKVLICGDIGMGGMREWSDIVEIVRKKINEIKKARDEDTTTPEKDEDEDEEEDEDEDEDEDEDEDEDDSFRKNETDSEDDDDDDEEEEDDDDDDEDDEDGHNVDKDRMILKEESESKPI

SEQ ID NO: 81516 - protein, 100 aa, Arabidopsis thaliana
  misc_feature (60)..(60): Xaa can be any naturally occurring amino acid
HELSLSLSLSLSLSLSLSLSLSLSLSLSHSSMLSNATMEAYPAQATMVATYNGLKPYADXQDTRRANNDNTKITRPGGRDNRMHMKPTIAKKKPATYNDQ

SEQ ID NO: 81517 - protein, 457 aa, Escherichia coli O157:H7 EDL933
MESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVWFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 81518 - protein, 317 aa, Haemophilus somnus 129PT
MSKTLTVLGSINADHVISVPHFAKPGETLSGKQYHIAYGGKGANQAVAAARLADFSQGATVNFVGCIGSDDIGQAMKKAFAQDGINVATITEIPNEMTGIAMIQVADSGENSIVISAGANAYLTPEIVDKFATEIERADYLLMQLETPLNAILEAAKLAKKHGATVVLNPAPASQLPDELLSLLDMITPNETETEILTGVKVTDEQSAAKAASVLHQKGVATVLITLGSKGVYVSRKSSTQELGQNKVIAGFRVNAVDTTAAGDTFNGAFLTALLENKSLDEAIRFAHAAAAISVTRQGAQPSIPTRRETLDFLAQH

SEQ ID NO: 81519 - protein, 592 aa, Cryptococcus neoformans var. neoformans JEC21
MAPIDYSRLHPSHDPQFSPFPSRRSTVFSTKGAVATSQPLAAQVGLEILNKGGNAADAAVATAAALNVCEPSMTGIGGDVFCLFYDAASQTVKGVNGSGRSPKALTLEYLRSQGITGDAIPLTNLNAVTVPGAAAGWLKTIEEFGSGKLSMREILEPAIRLAREGVPQYELSSNQWQIAEQLIKQASSNWREMMMPDGNPPRPSYVMTHNTLADTLEEVADHGHDGFYKGRIAQAIVDLVKSGGGVMTLEDLAECTADVIQPISYTFKPHHPPNHEEPSDPGLTLWECPPNGQGITALMALGIIEAVEEVHGIDVLEIEHNGKLYLHILIESLRLAFADTRYYVTDPDVEHVPMKELLSKEYLRKRASLIDLNKSSTIRHGTPVQSSDTVYLATADKEGNSCSFIASNYAGFGTGAIPKGCGFTLQNRGTGFTLIEGHPNCIKGGKRPYHTIIPGMVTHGDDLMMSFGVMGGFMQPQGHIQVLLNKLRGFSNQSTLDAPRFCISAGLPDNGVKNAEQGAGDIDSEIWFEDGIDPKVIEELRAMGHQCEIAEGYERKIAGKGQIIQRVVDPNGRRVWACGSDLRGDGCAVGQI

SEQ ID NO: 81520 - protein, 86 aa, Brassica napus
  misc_feature (20)..(20): Xaa can be any naturally occurring amino acid
TQTKGNVSPGGGGVSGGGPXPLTPVMTTPLMGLVEARMSPEGTGLPFGLSNTLLGGIFLGGFGLFWTFSFPHPSSLAEDKKFGFSL

SEQ ID NO: 81521 - protein, 370 aa, Vitis vinifera
MSQTGKLMPNLDQHSTKLLNLTVLQRMDPFIEEILITAAHVTFYEFNIELNQWSRKDVEGSLFVVKRNSQPRFQFIVMNRRNTDNLVENLLGDFEYDVQVPYLLYRNAAQEVNGIWFYNSRECEEVANLFSRILNAYSKVPPKPKLSSSKSEFEELEAVPTMAVMEGMLEPSSTASATTDAPEDSTFVNFFGAAMNIGSNTSNVANSGQSYQPSITVPSFSHAPSVVPSPVPTLQVPSLPRSASSTPPLPIHETPDPISSSNLATNLVKPSSFFAPPSSSSALIMPPMPSSMPTAGLHPPLNLQRPYGAPMLQPFPPPAPPASLTPTSSPSPNYGPVINRDKVRDALLLLAQDNQFIDLVHQALLKLLTS

SEQ ID NO: 81522 - protein, 381 aa, Oryza sativa Japonica Group
MAGQIPQPIRCKAAVCRAAGEPLAVEEIVVDPPKAHEVRIKIVCTSLCHSDVTFWRMQDFPGVFPRIFGHEAFGVVESVGEHVEGFAAGDPVVPTFLGQCTECVDCASERSNVCSTYRFAVRPGMPRDGTARFRDRHGAPIHHFLGVSSFSEYTVVDANQVVRVDPAVPPATASLLSCGATTGVGAAWKLAKVEPGSSVAIFGLGAVGLAVAEGARICGASTIIGVDLNPEKHELGKKFGVTHFINPQELGDKPVSQAIIEMTDGGADYCFECIGLASVMSDAFRSSREGWGKTIILGVEMHGAPLSIPSLEILNGKCVMGSLFGGVKPKQDIPILADKYLNKELELDKFITHEVPLKDINTAFDLLLQGKSLRCTIWMDK

SEQ ID NO: 81523 - protein, 299 aa, Aspergillus oryzae
MLRRQARERRDYLYRRALLLRDASIAEKRAQLKASLASGKPLDPSIANDKQLREDFKYDESLPTSDKKDKDADMLDLDDEYALTSGVVDPRPIVTTSRNPSVRLGAFAKEIRLLLPTSIRLNRGGLVLPDLVSSANAAALTDMVLLHEHRGTPTAMTISHLPHGPTASFSLHNVVLRADIPNAARGTVSESYPHLVFEGFKTKLGLRVVQILKHLFPPREAGKVGNRVVSFVNREDSIEVRHHVFVKTSYRDVELAEVGPRMTMRLFEIRGGSLEKGSSGDVEWALTQYTRTSRKKDYL

SEQ ID NO: 81524 - protein, 379 aa, Oryza sativa Japonica Group
MEDQSLKPIRCKAAVCRAASEPLIVEEIVVDPPKAYEIRIKIICTSLCHTDVTLWHKVDPAFPRILGHEAYGVVESVGENVEGLAAGDTVVPTFMGQCDSCASCAAEWTNQCTAVPFTMGPGMRRDGTTRFWDGEGKPLSDTVAVTSFSQYTVVDVNQVVKVDPAVPPKIACLLGCCGGTGVGAAWRLAKVQPGSSVVVFGLGSVGLAVVQGAKMCGATKIIGVDLNPNKEEVGKEFGVTDFVNPSQLGDKSVSEVINAMTDGGADYSFECIGISSVMTEAVRSTKSGRGKTIILGVEKDSQPLCLPSFEFLFGKCVMGSLFGGAKPKTDIPILAEKCMNKELELEKLVTHEVGLTEINTAFDLLLQGKSLRCIIWMDK

SEQ ID NO: 81525 - protein, 386 aa, Dichelobacter nodosus VCS1703A
MNLHEYQAKALLRAAGIKTPRGIIIKNSVEAKEAAQQLGGNRWVVKAQIHSGGRGKAGGIKTAQTLDEVHHISAAMLGSRLKTEQSSADGLPINEVLIEEECRAIATYYLALTLDRPRQQIVFIASMAGGTEIETVAETNPEAIIYAGVNPAIGFSPYLSARVGGALQLDKSYQLPLTKLMNRLYQLFIDNDLTLLELNPLIITEDHEFLPLDAKISIDDNALFRHQELVDLRDTTQEDHRETQAQELQLNYVPLDGTIGCIANGAGLAMATMDIIKLYGGEPANFLDVGGDATSERVKQAFKLILTSSRIKSILVNIFGGIVRCDLIADGIIQAAKEIDLKIPVIVRLQGNNVDLGRKMLDECPLNLQAADDLIDAAQKAIAAAQ

SEQ ID NO: 81526 - protein, 376 aa, Streptomyces avermitilis MA-4680
MDLYEHQARELFADHGILVPRAEVTDSSQEARVIARRLGGRVVVKAQVKTGGRGKAGGVKLAADPAAAELTARQILGMDIKGHTVGKVMLAEPVDIEAEFYVSYVLDRAAGRFLAIASAEGGMEIEEVAATRPEAVARVPVDPAEGVTSAKAAEIAEAAGLPPATVDVLVRLWEVLLREDAVLVEVNPLVRTAQGQILALDGKVTLDDNARFRQTRWGAEAAEHGDQLEAAAAAKGLNYVKLDGEVGIIGNGAGLVMSTLDVVAGCGARPANFLDIGGGASAQIMADGLSVILSDPAVKSVFVNVFGGITACDAVADGIVQALDTVRLTKPLVVRLDGNNAARGRAILDGRRHPLVQQVTTMDGAARRAAQLADAG

SEQ ID NO: 81527 - protein, 126 aa, Brassica napus
ADGYSTGTGLAAEIIGTFVLVYTVFSATDPKRNARDSHVPVLAPLPIGFAVFMVHLATIPITGTGINPARSFGAAVIFNESKPWNDHWIFWVGPFIGAAIAAFYHQFVLRASGSKSLGSFRSAANV

SEQ ID NO: 81528 - protein, 260 aa, Bordetella petrii
MTDSPAYPTATSIDDFRRNLARVREHIAAACQRAGRDPAEVRLLPVSKTVDEARIRLAYAAGCRELGENKVQEAHAKWEAMADLPDLRWAVIGHLQTNKAKLVARFASEFQALDSLRVAEALDRRLQAEGRALDVFVQVNTSNEASKFGLPPEQAAAFVRELPAYSSLRVRGLMTLALFSPDPALVRPCFVRLRELRDRLRQEAPAGIAIDELSMGMSGDYALAIEEGATTVRVGQAIFGARALPDSHYWPGLASAGPQS

SEQ ID NO: 81529 - protein, 334 aa, Acidobacteria bacterium Ellin345
MAIKVGINGFGRIGRNVYRAALNDSNIEIVAVNDLTDPKTLAHLLKYDSILGNLHHNISATADAITVDSKSVKVFAEKDPAALDWSALGVQVVVESTGRFTKAADAKKHLKGSVKKVIISAPATDEDITIVLGVNQDKYDASKHHILSNASCTTNCLAPVVKVLHETFGIVSGLMTTIHSYTNDQVILDFPHKDLRRARAAAINMIPTSTGAAKALRLVIPEMAGKLDGFAIRVPTPNVSVVDLTFTAEKPITKDAINEAVKKAAEGELKGILGYETAPLVSSDFKGNSLSSIFDAELTKVLGNTAKVISWYDNEWGYSCRVRDLITFLGNKGL

SEQ ID NO: 81530 - protein, 403 aa, Acidobacteria bacterium Ellin345
MSKLSIKDLQLSNKRVFMRVDFNVPLDENGRVTDDTRIRETLPTIEYALRHGAKLILCSHLGRPKGKPNPKMSLKPVAERLRVMLDHAISPGQNVGFSPDCIGMQAQEMAKQLEKGQALLLENVRFHAEEEKNDPAFAKELASLCELYVNDAFGSAHRAHASTEGITHYVEKSAAGLLMQKELDYLGKATSNPAKPFVAILGGAKVSDKIGVIQNLMAKVDAIIIGGGMAYTFLKAQGQEIGKSLFEADKLDLAKQILADAHKRGLKFLLPVDHVTADKFDMHATPHQIGEGQSIPAEQMALDIGPKTVALFSEEIAKARTIVWNGPMGVFEFDNFAKGTRAIAKAVAGNSGATSIVGGGDSVAAVHDAGVADKITHISTGGGASLEFLEGKKLPGVEALTNK

SEQ ID NO: 81531 - protein, 431 aa, Shewanella oneidensis
MAKIINVIGREIMDSRGNPTVEAEVHLEGGFIGMAAAPSGASTGSREALELRDGDKSRYLGKGVLTAVANVNGPIRTALIGKDATAQAELDQIMIDLDGTENKDKLGANAILAVSLAAAKAAAAFKGMPLYAHIAELNGTPGQYAMPVPMMNILNGGEHADNNVDIQEFMVQPVGAKNFREALRMGAEIFHTLKKVLHGKGLSTSVGDEGGFAPNLSSNADALAVIKEAVELAGYKLGTDVTLALDCAASEFYKDGKYDLAGEGKVFDSNGFSDFLKSLTEQYPIVSIEDGLDESDWDGWAYQTQIMGDKIQLVGDDLFVTNTKILTRGIENGIANSILIKFNQIGSLTETLAAIRMAKAAGYTAVISHRSGETEDATIADLAVGTAAGQIKTGSLCRSDRVAKYNQLLRIEEQLGEKAPYRGLKEIKGQA

SEQ ID NO: 81532 - protein, 225 aa, Nicotiana tabacum
FAFGQCNLLPRTTTVNPTQLHSPLYSLSLPFHRQSITSSPALSFTQSQGLGSAIERHCDRSDLFQTCAVRQLTGSVTSAKGHRFAVVVARFNDLITKKLLEGALDTFKNYSVREEDIDVVWVPGCFEIGVVAQQLGKSQKYQAILCIGAVIRGDTSHYDAVVNAATSGVLSAGLNSGTPCIFGVLTCDTLEQAFNRVGGKAGNKGAETALTAIEMASLFEHHLKA

SEQ ID NO: 81533 - protein, 230 aa, Bradyrhizobium sp. BTAi1
MDALKRQAAAHALREVESGMKLGLGTGSTAKHFVDLLGEKVRAGLKVVGVPTSEATRAQAEACGVPLTTLDEIDHLDLTVDGADEINPALDLIKGGGGALLREKIVASASDRMIVIADESKWVARLGRFPLPIEVIPFGLAATRHAIAAAFAKAGVSGQMDLRKSADGHVFVTDGGHWIVDVRLGEIEDPPRLAGLLSAIPGVVEHGLFIGLGSTAILAGAQGIRVIQRP

SEQ ID NO: 81534 - protein, 195 aa, Synechococcus sp. WH 5701
MTPSTPESAGGRPAVPLARRLADALTVARAFLGLPLLLALGAGQAGLGWALLLLGGFSDWADGWLARRSGGGSVWGARLDPLTDKILISAPLLWLAREGTLPLWAVWLLLARELLISGWRAGQASGAPASAAGKAKTVLQFAALLLLLWPLTWPLANGLRSLGWWLFWPSLLLALSSGASYLRAGLSRPAEPDRS

SEQ ID NO: 81535 - protein, 461 aa, Bradyrhizobium sp. BTAi1
MAEFDVDLFVIGGGSGGVRAARIAAGYGARVMVAEEYRMGGTCVIRGCVPKKLFVIGSHVRQEIADAAGFGWTIPTATFDWKTLIANKDKEIARLEAAYTANVEKSGARIVKTRAVLEDAHTVRLATGETIRAKYILIATGGAPNHGTPIPGIEHVISSNEAFHLEELPRRIVIQGGGYIALEFACIFANFGSDVTVVYRGDNILRGFDEDVRKHVRAEMEKEGITILTGCTVASVDKHGKDYTTHLSNGSSIASDKVMFAIGRHPAVANLGLEKAGVAINPRNGGIAVDAFSQSSVPSIYAIGDVTHRFNLTPVAIREGHAFADTVFGGKTVRVDHADIPTAVFSQPEVGTVGLTETQARELYDRVDIYKTSFRPIKATMSGRDTRVLMKLVVDGASDRVLGCHIVGDMAAEITQAVAIAIKMKATKADFDATVALHPSAAEELVTMRTVTERHVRQAAE

SEQ ID NO: 81536 - protein, 247 aa, Mycobacterium avium 104
MQRWRRRGIPAPGSVKRVSRAELDKNPRDVASMFDGVARRYDLTNTVLSLGQDRYWRKATRSALGIGPGQKVLDLAAGTAVSTVELNKSGAWCVAADFSVGMLAAGAARRVPKVAGDATRLPFADDVFDAVTISFGLRNVVDTQAALREMARVTRPGGRLVVCEFSTPSNALFATVYKEYLMRALPRVARAVSSNPDAYVYLAESIRAWPDQAALADQIAGAGWAGVRWRNLTGGIVALHAAHRPPR

SEQ ID NO: 81537 - protein, 327 aa, Mycobacterium avium 104
MTSPPLDPDAAARIASFGETAPMRQRGLPAVRAGLESAPRPATMPEMASVTEALVPSAAGGIPVRIYRPTTDSGVAVLVYLHGGGLVMGSNRSFEPLARELASASAATVVAVDYRLAPESPPPAQFDDAYAATEWVSRKAGELGVDADRLAVIGDSAGGSLAAAVALAARDRRGPPICAQVLLYPGLDRDMSVASIAAMPDAPLLIRDDIDYMHALVDGDAGPPTDPYLVPAYAADLSGLPPAIVVTAGCDPIRDWGERYADRLRDAGVQTTVTRYPGMYHGFLMRSDATARGRLAIAEIGGLLRAKFTHPLRFDVPITGRHSTPTR

SEQ ID NO: 81538 - protein, 388 aa, Escherichia coli
MKITISGTGYVGLSNGILIAQNHEVVALDIVQAKVDMLNKKQSPIVDKEIEEYLATKDLNFRATTDKYDAYKNADYVIIATPTDYDPKTNYFNTSSVEAVIRDVTEINPNAVMVIKSTIPVGFTKSIKERLGIDNLIFSPEFLREGKALYDNLHPSRIVIGERSERAERFAALLQEGAIKQNIPTLFTDSTEAEAIKLFANTYLAMRVAYFNELDSYAESLGLNTRQIIEGVCLDPRIGNHYNNPSFGYGGYCLPKDTKQLLANYQSVPNNLISAIVDANRTRKDFIADAILSRKPQVVGIYRLIMKSGSDNFRASSIQGIMKRIKAKGVEVIIYEPVMKEDSFFNSRLERDLATFKQQADVIISNRMAEELKDVADKVYTRDLFGSD

SEQ ID NO: 81539 - protein, 526 aa, Chlamydomonas reinhardtii
MIAWSWKMCVICFRGTASIKAACVDLKAMLKPYYNREAWMSESKLARLAAVHHGFQWSWRHRGFNCRVLDWVVSYRKKHPHGKLLVTGHSLGGAHATLCTLDIIHELRGSLPPHHISCYTYGAPRVGNHAFAAMYDKVVYETWNVVNCNDMVPLTPKCVGWFVYKHPGHKVIVKRRGDLIVRPTFMENAVARLPCSRSVRHHLLGSYLRSMMAVLRAQTRGKHVEGGVRGLLHLTMYRLPEVDAVLADVVEEVQAVALAAVEAVQMVEKRSLAAAAAKTSSSGSAVYHSLAKYGSIRLLMDQESRKSLHNSVQQQATSSTAVSSVTVSRPPAVSATDPVVAENAGCSGAATVGITGEPLSAGLPAASGESFILKSIVRPRAVLHGLARRLNMGMELMGVETGLLDDDDPVPATASQALAGTDEAGLLASTSHTGSALSSMPTVSPNEMMAFQRALVAQHEAHEVYKRNKELGSEALDYLNRHLTHFPRNYDLQSQALSCTCSTAVLKCHSLMLEWMSTQGPNIRYR

SEQ ID NO: 81540 - protein, 419 aa, Schizosaccharomyces pombe
LMGFGAGLAILRRGLISGASLVKRRMLVSVEIPSKEKSYNAFLHWMSTVPKRYSNQLAVESNRQLKMPQNAREKPDKQVANRFFSLVPGPGKHYIKYKKCWIQVERERSNRLQDLTTGTPWETITLTTLSRDRGIFSELLLEAQKFMQSAQKNKTTIYTAWATEWKPFGHPRSKRMLSSVVLESNVKKMITDDVHDFLRNSQWYDTRGIPYRRGYLLYGPPGSGKTSFLYALAGELDYDICVLNLAEKGLTDDRLNHLLSNVPPKAVVLLEDVDSAFQGRERSGEVGFHANVTFSGLLNALDGVTSSDERIIFMTTNHPEKLDPALVRPGRVDVKAYLGNATPEQVREMFTRFYGHSPEMADDLSDIVCPKNTSMASLQGLLVMNKSSPADAVDMAKELPDNPPSTPFSFNVHRKSLSV

SEQ ID NO: 81541 - protein, 866 aa, Oryza sativa
MEFLDVSLVEVDKWAKAHIDLVVGLQSRFARLELSNGLRLRLLRFSFPSPSSSPLRWVRVGNLVPLNEGNASSSNGSVSSIPIYLGANVVGRNHLVVVDKRVSRKHLSLHASADGSIEAVVEGPNPIIVRSEGQRRKVCAQERVKIAHDDVLELIPGEYFVKYLNVGDNHKSSTSMGSSDFKKGKRLCEDDTVVIKRNRQIMEDEALARSLQKSFAEESSTISGLGCDQMLSSLDSAGFSERNNERIHSVDYLKDVLSLTFRLMRVQGLPSWTNTSSVTIQDVIQGEVLLAVLSNYMVDMEWLLTACPSLRKVRHVLVIHGEDGASVELLKKVKPANWILHKPPLPISFGTHHSKAMLLVYPQGIRVVVHTANLIHVDWNNKTQGLWMQDFPWKDAKDVNRSVSFENDLVDYLSAIKREILELLATCCKLIWPEFRVNLPVVGDVNINAAFFRKFDYKSSSVRLIGSVPGYHVGPNIKKWGHMKLRSVLEGCTFEQQFCKAPMIYQFSSLGSLDEKWMSEFAFSLSAGKSDNGSPLGIGKPLIVWPTVEDVRTSIEGYAAGSCIPSPQKNVEKDFLRKYWARWKADHLGVLFLPKTHQSVPQFSCTGKNNSNLFLTQNNLAPGKEIKTKLVTLCWKSDEEKEQSTEIIRLPVPYQLPPKPYGTEDVPWSWDKRYTKKDVYGSVWPRHVQYCFFTLCLTQAIFSLAITNNRGENETPDMKTESNIIETENGAKTNRREYVLGVACHFHQQSFMSDLDIQIPTAFDPFAEANAGDSGAAAGSKDYVHVRIQQRNGRKSLTTVQGLKKEFSYNKILKDLKKEFCCNGTVVQDPELGQVIQLQGDQRKNVSNFLVQAGIVKKEHIKIHGF

SEQ ID NO: 81542 - protein, 250 aa, Acidobacteria bacterium Ellin345
MSRKKIIAGNWKMHNTPQQSLAFVKAFLPLVADHTRDEIVLCPPYLSLATVVEATKGSNVMVGAQNMHWEVKGAFTGECSPEMLVESGVTHVIIGHSERRQYFNETDDTVNRKLEVALEHGLTPIVCVGEVLEEREAGLTEDVLRRQCSRAFRGISGKKAAKLVMAYEPVWAIGTGKTATPEIAEDAHLVIRGEAAKAFGDDFAHALRIQYGGSVKADNARTLMSQPDIDGALVGGASLDAAGFAKIVKY

SEQ ID NO: 81543 - protein, 169 aa, Microcystis aeruginosa PCC 7806
METIFIPHLLKSPDRQRVIIIDNFIPGLETLTPVRGTLLVRHGGNFLEVSVKAETIVTLTCDRCLQQYNHRLQLNTSELIWLDKNKDYDSSYPLEREIAYEDLSETLDPNGDFDPQMWLYEQLCLTLPPRQLCGANCQPPDFLLPEKTAIDGRWASLESLKSQLSQSQN

SEQ ID NO: 81544 - protein, 747 aa, Aspergillus oryzae
MPPSLIPQTPHKDDLDETAVHNFCTSQKAVGNGHGLQAHRGGSSSSTHKSSKIYRAPGSNTASAHLLGEELYKLLGEYLSRHLDAVHHESKGHAEEALLGFYIREWTRYTTAAKYINHLFGYLNRHWVKREIDEGKKNVYDVYTLHLVKWKDDFFMKVHEKVMEAVLNLVEKQRNGETIEQSQIKSIVDSFVSLGLDESDSSKSTLEVYRMFFEKPFIAATKVYYENESRQFVAENSVVEYMKKAEARLEEEKARVGLYLHPDISKHLTDTCLDVLVTAHSELLRDEFQVLLDNERQEDLARMYRLLSRIKEGLDPLRTKFETHVRKAGLAAVEKVAAEGEAFEPKIYQSLVNEAFNGESEFVRSLDNACREFVNRNKICASSSTKSPELLAKYTDSLLKKGSKAAEESELEEMLVQIMTVFKYIEDKDVFQKFYSKMLAKRLVHVSSVSDDAETSMISKLKEACGFEYTNKLQRMFQDIQISKDLNASYKDWQDKVLDDDDRRKLVDAHFQILGTGFWPLQAPSTDFLAPPEIVKTAERFQNFYFDKHNGRKLTWLWQLCKGEIKTNYIKNTKVPYTFQVSTFQMGILLLFNETDTLTYEDIQKATTLAPEILEPNLGIFLKAKVLTINPEGSKPEPGTSFTLNYNFRHKKVKVNLNIQIKSEQKVESDDTHKTIEEDRKLLLQSAIVRIMKSRKKMKHVQLVQEVIQQVKSRFPPRVPDIKKNIEALMEKDYIERLDGDEIAYIA

SEQ ID NO: 81545 - protein, 355 aa, Aspergillus oryzae
MGSCVSTEPADNEPKKRSQAIDRRLEEDSRRLRRECKILLLGSGESGKSTIVKQMKIIHQNGYTVEELALYRLTVCKNLLDCAKSLVGAYHQFSLEPSSQKVRDYVQYISDYNIDPDPHTTLDAKVGEAITYIWNDPCTSTVLEHQNEFYLMDSAPYFFEEAKRIASPDFIPNVNDVLRARTKTTGIYETRFTMGQLSIHMFDVGGQRSERKKWIHCFENVTSIIFCVALSEYDQVLLEESNQNRMMESLVLFDSVVNSRWFMRTSIILFLNKVDLFRQKLPRSPLSNYFPDYSGGNDVNRAAKYLLWRFNQVNRAHLNLYPHLTQATDTTNIRLVFAAVKETILQNALKDSGIL

SEQ ID NO: 81546 - protein, 197 aa, Oryza sativa
IIRNDELIVANAGDSRCVLSRKGRAYDLSKDHKPDLDAEKERILNAGGFIVAGRVNGSLNLARAIGDMELKQNEFLPAERQIVTAEPELNTVKLSEDDEFIVLACDGIWDCMSSQEVVDFVHKEMNTEDSLSAVCEKLLDHCLAPVSGGDGCDNMTVIIVKFKKPSKSAATSSTNQSVSSEEMRPNELDDGPSDPNK

SEQ ID NO: 81547 - protein, 635 aa, Chlorobaculum tepidum
MISQAYPLLSSIHSPADLKKLSLHELELVAAECRKKVIELVSQNGGHFGSSLGVVELTVALHYVYQSPTDRIIWDVGHQAYVHKILTGRLAQMETNRRYHGLAGFPKRSESPHDAFGTGHASTSISAAAGLAAARDLAGRKEKVVAIIGDGSLTGGMAFEAMNHLGDTKSDVLVILNDNQMAISPSTGGLKNYLVNLTLNKTYNRLRKFVWDSLSLLHNEIGETAKTAVHRIEDGIKAAFTPGAYFEALGFRYFGPIDGHNMEQLIKALREMRQLHHPKLLHVITTKGKGFKPAEENQPKWHASVGGFDIETGKNVKAPGKPAKPKYQEVFGEALVELALKDPTITAITAAMPSGTSLDLFQQAIPSRCFDVGIAEQHAVTFAAGLACGGFKPVFAVYSTFLQRAYDQLIHDVALQNLHVVFAIDRAGLVGEDGPTHHGAFDLSYLNVVPNLTIMAPGDEQELRNMLYTALYDIKGPVAIRYPRGSGSGATLHKEFTPVPVGRGRILRDGKSVALLGIGTMSNRALETAALLEAAGLDPLVCDMRFLKPLDTEIIDMAASRCTHIVTIEENSIIGGFGSNVVNYLHHAHPGIKCISFGLPDAFVTHGSMDELYREVGLDAESLSGKILEFYKDKP

SEQ ID NO: 81548 - protein, 321 aa, Calystegia soldanella
KGQNPVFPRILGHEAAGIVESVGEGVTDLKAGDHVLPVFTGECKECRHCKSEESNMCDLLRINTDRGVMLEDQKSRFSINGKPIYNFVGTSTFSEYTVCHVGSVAKINPLAPLDKVCILSCGISTGLGATLNVAKPPKGSTVAVFGLGAVGLAAAEGARMAGASRIIGVDLVPSRFELAKKFGVTDFVNPKEHSKPVQEVIVEMTDGGVDRSVECTGNVNAMISAFECVHDVWGVAVLVGVPHKDAEFKTHQMNLLNERTLKGTFFGNYKPRSDLPSVVEKYMNKELELEKFITHEVPFAEINKAFDLMLKGEGLRCIITM

SEQ ID NO: 81549 - protein, 174 aa, Triticum aestivum
SGDNFDRDEDHLALMMELLGMMPRKIALGGRYSRDYFNRYGDLRHIRRLRFWPLSKVLVEKYEFSDIDAIAMSDFLVPILDFVPEKRPTAAQLLQHPWFDAGPLRRQPRALADTAENPVDGAPENKGKEKDDERDAMAAELGNIAIDGASSSKTAKDPQAGSKQKIANGTPSKK

SEQ ID NO: 81550 - protein, 321 aa, Calystegia soldanella
  misc_feature (280)..(280): Xaa can be any naturally occurring amino acid
KGQNPVFPRILVHEAAGIVESVGEGVTDLKAGDHVLPVFTGECKECRHCKSEESNMCDLLRINTDRGVMLEDQKSRFSINGKPIYHFVGTSTFSEYTVCHVGSVAKINPLAPLDKVCILSCGISTGLGATLNVAKPPKGSTVAVFGLGAVGLAAAEGARMAGASRIIGVDLVPSRFELAKKFGVTDFVNPKEHSKPVQEVIVEMTDGGVDRSVECTGNVNAIISAFECVHDVWGVAVLVGVPHKDAEFKTHPMNLLNERTLKGTFFGNYKPRSDLPSVVXKYMNKELELEKFITHEVPFAEINKAFDLMLKGEGLRCIITM

SEQ ID NO: 81551 - protein, 576 aa, Rhodospirillum rubrum ATCC 11170
MIHATPLITILVAGLGIAFIFGAIAHRLKVSPLVGYLLAGIVIGPATPGYVADQNLASELSEIGVILLMFGVGLHFSLKDLLSVRAIAVPGAIVQIAFATVLGIGIAHFAGWGLGGGIVFGLALSVASTVVLLRAMQDRRLIDTLRGRIAVGWLIVEDLAMVMALVLLPAVAGALGVGTANGTPSLSLVDVGISLGVTLAKVAAFIVLMLVVGRRVIPWLLHRMASTGSRELFRLAVLVIALGVAFGSATLFGVSFALGAFFAGMVMNESELSGQAAQDTLPLRDAFAVLFFVSVGMLFNPSSVIESPLLFVATLLVIVFGKSVAAFGLVLMFGHSKATALTIAASLAQIGEFSFILAPLGVSLGLMPQQGQDLILAAAIVSILLNPFLFMLLDRYFLHDASASASAAADPPEPAPSSGAADDEDEAAIAVAKPAPVAPASGHAVVVGSGRVGALIGEMLAEREVRRVVIEESESVIEALRGKGVSCHLGNAADPETLALADTIEARWLFVAIPNAFEAGQVVEQARKSNPDLQIIARAHSDAEVEHLKARGASRVVMAERETARGMIAEALLPRL

SEQ ID NO: 81552 - protein, 394 aa, Xanthomonas axonopodis pv. citri str. 306
MDSLLQYAGGYSRRSQDIAPFHVMSLLARANALEQAGHDVIHLEIGEPDFTTAAPIVAAGQAALAAGHTRYTAARGLPALREAIAGFYAQRYACNLDPERILVTPGGSGALLLASSLLVDPGRHWLLADPGYPCNRHFLRLVEGAAQLVPVGPDSDYQLTPALVESAWNADSVGALVASPANPTGSVLSRTQLAALSQALHARGGHLVVDEIYHGLTYGLDAHSVLEVDDGAFVLNSFSKYFGMTGWRLGWLIAPPDAVPELEKLAQNLYISASTIAQHAALACFTPESIALFEARRAEFQQRRDYLLPALRALGFEIAVEPQGAFYLYADISGFSDDAQAFCAHFLETEHVAFTPGIDFGHYRANQHVRIAYTQSLPRLQQAVERIARGLKRL

SEQ ID NO: 81553 - protein, 321 aa, Calystegia soldanella
KGQNPVFTRILGHEAAGIVESVGEGVTDLKAGDHVLPVFTGECKECRHCKSEESNMCDLLRINTDRGVMLEDQKSRFSINGKPIYHFVGTSTFSEYTVCHVGSVAKINPLAPLDKVCILSCGISTGLGATLNVAKPPKGSTVAVFGLGAVGLAAAEGARMAGASRIIGVDLVPSRFELAKKFGVTDFVNPKEHSKPVQEVIVEMTDGGVDRSVECTGNVNAMISAFECVHDVWGVAVLVGVPHKDAEFKTHPMNLLNERTLKGTFFGNYKPRSDLPSVVEKYMNKELELEKFITHEVPFAEINKAFDLMLKGEGLRCIITM

SEQ ID NO: 81554 - protein, 365 aa, Gypsophila paniculata
MVADRPKTLTSLEGDNKLNPNFIRDEDERPKVAYNTFSNDIPVISLAGLDGENRAEICRKIVEACEDWGIFQVVDHGVGDDLIADMTRLAREFFALPPDEKLQYDMSGGKKGGFIVSSHLQGEVVQDWREIVTYFSYPITSRDYTRWPDKPDGWKKVTEEYSNKLMGLACRLLGVLSEAMGLESEALTKACVDMDQKIVVNYYPKCPQPDLTLGLKRHTDPGTITLLLQDQVGGLQATRDGGRTWITVQPISGAFVVNLGDHGHFLSNGRFKNADHQAVVNSECSRLSIATFQNPAPEATVYPLAIREGEKSIMEEPITFAEMYRRKMSKDLEAARLKRLAKEELVIKEMDKAKLETKSIEQILA

SEQ ID NO: 81555 - protein, 156 aa, Escherichia coli O157:H7 EDL933
MNIIEANVATPDARVAITIARFNNFINDSLLEGAIDALKRIGQVKDENITVVWVPGAYELPLAAGALAKTGKYDAVIALGTVIRGGTAHFEYVAGGASNGLAHVAQDSEIPVAFGVLTTESIEQAIERAGTKAGNKGAEAALTALEMINVLKAIKA

SEQ ID NO: 81556 - protein, 474 aa, Ehrlichia ruminantium str. Welgevonden
MIKKYRKKCMQNYDIVVIGGGPGGYKCAIRSAQLGLKVACVDKNEILGGTCLRVGCIPSKALLHFSHEYYHIKNHLDEVGITCNSLSFNLDKIMSFKNKNITELSNGINYLFASNKIDRLCGVGKIRSINSNNFDITVTGNNGEEKITAKYVVIATGSEVASFPGIEIDEKNVVSSTAALSFKEVPKKLVVVGAGAIGLEMSSVWSRFGSEVTVVEFFDKIAPSMDIDISKALLASLKKQGINFKLSTKVTSIDKSSDNLTIHLESVKDGKSEIIEAEKVLISIGRMPYTDGLIDQNCIECDSRGFIKVNNKYETNIPGIFAIGDVIGGAMLAHKAEEEGIAVAELIAGNIPHVDYDIIPSVIYTHPAVASIGKTEESLKNINYAYNVGKSNFSANSRSKITNNGEGFVKVLTSKENNAILGVHIIGAYADTIINEAAIAMAYRASSEDVFRISHSHPDVNEAFKDACEAAYLK

SEQ ID NO: 81557 - protein, 286 aa, Mycobacterium avium 104
MTVIDEIYSSSSAIPTVALNDEAKMPVLGLGVAKLSDEETESSVLAALEAGCRLIDTAASYGNEAAVGRAIAASGIPREELFVTTKLGTSRQGFHSAQESCKESLDRLGLDYLDLYLIHWPAPKLGKYVESFEGMIEARERGHVRSIGVSNFTEDLLATVIEETDEVPAVNQVELHPRLNQAELRQVHAQHDVTTQSYSPLGVGRLIEEPTVTTIAAEYGRTPAQVLVRWNLQLDNVVVSRSSKPERVAENLDVFDFTLEPEHMEAIEGLHDGTRVLHDPMTFMGT

SEQ ID NO: 81558 - protein, 359 aa, Ehrlichia ruminantium str. Welgevonden
MENISLGKSIGNKSNAVGEVCFTTSMTGYQHTITDPSFAGQIITFTFPHIGNIGINKEDFENTQVLAHGIVVKTISEDSHSSSYSNLENWMIENKITGISEIDTRALTRHLRNYGSQNGIIHHFHDMNSLNLKELQNTASQYNYVNHCQSISQAFISDYNQEPKYKTLYNIVVINFGVKSSILNALSNIGCKVHIVPGHEFNLIDKILSFNPDGIVLSNGPGDPSAISEHTIQQIRSIIELKVPTLGICLGHQLIALALGAQVKKMLFGHRGSNHPVYNKMLNNIEITSQNHGFTIDENSLSSNIQITHTSLFDNTIEGIKVENYPIISVQYHPEGSPGPNDTKYILEDFVNLIQEKTV

SEQ ID NO: 81559 - protein, 677 aa, Arabidopsis thaliana
MIPLSFAALGDIVDKKLDEDYVKEEVEMMIQVSLLSTQAAPGERPTMSEVEIFRNSCLCYINWFCNIISIIYSNSLLLRIDSGSSSISVVFLVFTLSRMEQRRMLTAARPRLSSTIRTITSHVAFSASRLLKPYVAYRLGLEDANQRKTENESTGGDKEIANSLLHCLKFHYLLLHFPSFSLQIHNRSTSLSLSRFEKMAKLVMLLVLCILPAIAMAARRGNIGKKTMVVQGSTYCDICKFGFETPESSYFIPGATVKLSCKDRKTMEEVYTDKAVSDKEGKYKFIVHDDHRDQMCDVLLVKSSDKTCSNLSVGREKSRVILNHYSGIASQIRHANNMGFEKEVRMATSTTMSHQAIGSVVSQRPFKASQFLKEPLNNVPMKFRQKRFKIEATASQISVVDNTFLSPSPSKNKPHESKKKSNEAALILIRHGESLWNEKNLFTGCVDVPLTQKGVGEAIEAGKKISNIPVDLIFTSSLIRAQMTAMLAMTQHRRKKVPIILHNESVKAKTWSHVFSEETRKQSIPVIAAWQLNERMYGELQGLNKKETAERYGTQQVHEWRRSYEIPPPKGESLEMCAERAVAYFEDNIKPELASGNNVMIAAHGNSLRSIIMYLDDLTSQEVTTLDLSTGVPLLYIFKEGKFMKRGSPVGSTEAGVYAYTKRLAQYREKLDAAATI

SEQ ID NO: 81560 - protein, 207 aa, Agrobacterium tumefaciens str. C58
MKTLASLSAFVGKTFAIWVILFAVLGFFFPETFRQIAPWIVTLLSIIMFGMGLTLSVDDFREVVKRPFDVTIGVLGQFLIMPLLAVLLTRIIPMPPEVAAGVILVGCCPGGTSSNVMTYLSKGDVALSVACTSVTTLAAPLVTPFLVWLFASQFLPVDGWAMFLSIVKVVLLPLALGAALQKLVPGIVKAAVPALPLVSVIGIVLIV

SEQ ID NO: 81561 - protein, 267 aa, Triticum aestivum
  misc_feature (253)..(253): Xaa can be any naturally occurring amino acid
VTYRTSLYKKAGWYRSGIPGISSTHASEKLNKATFKGKKLRVSSSQAKNKLFVGNIPHSWSFDDFKKAVEEVGPGVLKVDLIKDPRTDRNRGYGFVEYYNNACAEYSRQKMTAPNFKLDTNAPTVSWADPKNGDSASTGSTSQVKSVYVKNLPKNVTQGQLKKLFERHGEIIKIVLPPSKDGHDNRYGFVHFKDRHMAMKAVKSTEKYELDGQLLDCSLAKPPADKKDDTVSLPTAKGGPLLHAPLGYGMPRXDPYGAPPAYSAPPA

SEQ ID NO: 81562 - protein, 220 aa, Pseudomonas fluorescens PfO-1
MHIQKLVLAMAIGAVLSASTVLIPDNLSGVSSVQAKEGGSGGGGSGGGGGGGGNGGGGGGNGGGGSGGGGGGNGGGGSGGGGGGNGGGGSGGNGGGHGGSGSGGNSGSGGGGNSGHSGSDHGSGHSGNTASSGRSGTHSEPGDDHGVHRAGEVGDDHGVHRAGEIGDDHGVHRAGEVGDDHGVHRAGEIGDDHGLHAAGQPGDDRGVHVGGEPGDDKRAN

SEQ ID NO: 81563 - protein, 242 aa, Schizosaccharomyces pombe
MSHLEILSLEGLRNDGRRWDEMRNFQCRFGIEPSENGSAFIELGNTKVLCIVDGPSEPVIKSKARADRTFVNVEINIASFSTIDVKKRFKSDRRIQLQCLALQNTFEEIIQTELYPRSQISVYLHVLQDDGAVMASCINATTLALIDAGIPVKDFVCCSTAGIVESDMLLDLNSLEESALSWLTVAVLGNIKKVVYMQLETSMHLDYLESVMNMAIAGSEHIYNTMQSAVRQSAKPALASLS

SEQ ID NO: 81564 - protein, 417 aa, Aspergillus oryzae
MKTNLSLRGSELAQQKPVFLDILSDAWGPVSNPEGVVNIGLAENTLMHSEMLQFIESRSQVTSHILTYGDGFSGSRLLKESLCHFLNQRFSPLTPLSPSHISVTSGVSNAIECCAWALCDPGDYILLGRPYFNAFKSTFGLRAGVAVYDVKFGAIDPFSHEAVRQYEQAYNQAQRDGIRIKALVLCSPHNPLGRCYSEDVLAEYMVFCNRHKLHLISDEIYALSVWENPALPDSVPFKSILSMDIKSLMDPSMAHVVWGLSKDFGSTGLRIGCLISQSNTHLLEAADGISLYNFPSSLADNIASSLLRDDKFTSSYIATNQHRLAESYSFVTSFLRRYGIPFYESNAAFFVWINLGAVTKDGANDTEIMARLREKKVYVGAGYMYASEEPGWFRMVFAHPTPILQEGLQRIAQALEI

SEQ ID NO: 81565 - protein, 551 aa, Zea mays
MESLRLAVTHRPALPLPTSHSHLRRRHLHLHLHSYPNPLSLSPPIASHLSPIPRRHLPPLLASASASQASSKPAASAASGGAKPLPLFLSLAAGLAVRFLVPRPAEVTPEAWQLLSIFLSTIAGLVLGPLPVGAWAFLGLTATVATRTLPFTAAFGAFTNEVIWLIVISFFFARGFVKTGLGDRVATYFVKWLGRSTLGLSYGLAISEALISPAMPSTTARAGGVFLPIVKSLSLSSGSKPNDPSAKKLGSYLVQSQLQAAANSSALFLTAAAQNLLCLKLAEEIGVSIGNPWITWFKVSSVPAVLGLLVTPYLIYKIFPPEIKDTPEAPALAAEKLKNMGPVTKNEWVMIGTMLLAVSLWIFGETIGVSSVVAAMIGLSILLVLGVLNWEDCLNEKSAWDTLAWFAILVGLAGQLTNLGIVSWMSNCVAKVLQSFSLSWPAAFVVLQASYFFIHYIFASQTAHVGALYSAFLAMHLAAGVPALMSALALAYNANLFGALTHYSSGQSAVYFGAGYVDLPDVFKLGFITAAINAVIWGVAGALWWKFLGLY

SEQ ID NO: 81566 - protein, 338 aa, Silicibacter pomeroyi DSS-3
MAGQASAGEAGFHVPPEEARHDRTFMQWPVNRRVHPDPVFLDMAQQTIADIANAIAEFEPVTLLAAAEDHARARRKLSDKVTLWDIPTEDLWCRDAGPLFARDGRGGLAVSHIQFNGWGRKQVHRRDARVAEQVAQRLGLPLLPAGLRGEAGGVEQDGHGLLMAHESSWVNDNRNPGLSRAEIEARLLRAYGAQRMIWSPGVWGEDITDYHIDSLARFTGPGRVLINLPDDPDMDDPFHLAALDTHDALVAAGLMVEVIPEPHRRRVKSVDFVASYANYYVCNGAVIAAQFGDAETDRIAARALARHYPGREIVTLNVDPLGEMGGGIHCATQQMPAT

SEQ ID NO: 81567 - protein, 579 aa, Physcomitrella patens subsp. patens
MSSPPPIYPVIESTACLARHLARRLVEIGCNDIFTVPGDFNLILLDHLLNEPGINNIGCCNEINAGYAAEGYARWKGVGCVVVTFTVGGLSVINSIAGAYSENLPVICIVGGPNTNDYGTNRILHHTIGIPDFSQEFRCFQTVTCFQAVINHLDDAHELVDRAISKALHKNKPVYISVSCNITNTVHPSFTGSTIPYTIKQQVSNKVSLDAAVESTVKFLNTCAKPVLIGGPKMRLGKAKEAFAKLVTACGYAYAVMPSAKGQVSEQHPRFMGTYWGAVSTPYCLEIVESADAYIFVGPIFNDYSSVGYSLLLKKQHMIIVNPDRVKVCGKAEFGCVLMKDFVEALAEKIVKNSNSYDNYKRIFVPEGTVPSSVPGEPLRVNSLFKHIQGMLSGDTAVLAETGDSWFNCQKLRLPEDCGYEFEMQYGSIGWSVGATLGYSQALKGIKRVIACIGDGSFQVTCQDISTMIRQEQNSIIFLINNGGYTIEVEIHDGPYNVIKNWSYTGFVDAIHNGEGKVWTTKVTTEDELIPAISTALGAQRDCLCFIECVVHKDDTSRELLEWGSRVSAANSRPPTSYT

SEQ ID NO: 81568 - protein, 197 aa, Brassica napus
MQSDSGKLFIGGISWDTDEERLKEYFSSFGEVIEAVILKDRTTGRARGFGFVVFADPAVAETVITEKHNIDGRLVEAKKAVPRDDQNTVTRSNSSSLQGSPGGRTRKIFVGGLPSSITESDFKTYFEQFGTTTDVVVMYDHNTQRPRGFGFITYDSEEAVEKVLLKTFHELNGKMVEVKRAVLRVVSSQLAEAPRGC

SEQ ID NO: 81569 - protein, 336 aa, Oryza sativa Japonica Group
MAAALMRRAARAPPAACGLRRFMQEQTAFRPAAVPVVPPERRGFIPLADRIRDLGAAFPRINLDGLVPPAPPQTHPTVAREERASASAVAGLTVEEARKVLRATQMEAARARLRASGAGTVPYAEFLRLCCDAAGAESGASVARALDESGSVIVLGKTVFLRPEMVVKAIEKAIPIPRAQPIALDGPAREELKAMEAQKVEIDRTAALQVRRELWLGLAYLVVQTAGFMRLTFWELSWDVMEPICFYVTSMYFMAGYTFFLRTKKEPSFEGFFESRFAAKQKRLMHARDFDLRRYDELRRACGLPVVRTPTSPCRPSSSSSSSTQESHCHSYCHCQ

SEQ ID NO: 81570 - protein, 86 aa, Avena sativa
TIKYLLEKGAKVILSSHLGRPKGVTPKFSLAPLVPRLSELLGITVTKADDVIGPEVEKLVAALPNGSVLLLENVRFYKEEEKNEPE

SEQ ID NO: 81571 - protein, 398 aa, Vitis vinifera
MASAAPSLLKSSPVLDKSDWVKGQTLRQSSVSVIRCLPTAPSGLTIRAGSYADELVKTAKTIASPGRGILAMDESNATCGKRLASIGLENTEANRQAYRTLLVTVPGLGNHISGAILFEETLYQSTTDGKKMVDVLVEQKIVPGIKVDKGLVPLVGSNDESWCQGLDGLASRSAAYYQQGARFAKWRTVVSIPNGPSALALKEAAWGLARYAAISQDNGLVPIVEPEILLDGEHGIERTFEVAQKVWAEVFFYLAENNVMFEGILLKPSMVTPGAECKDRATPEQVADYTLKLLKRRIPPAVPGIMFLSGGQSEVEATLNLNAMNQGPNPWHVSFSYARALQNTCLKTWGGRPESVKEAQEALLIRAKANSLAQLGKYTGEGESEEAKKGMFVKGYVY

SEQ ID NO: 81572 - protein, 176 aa, Acidobacteria bacterium Ellin345
MARTPGLYATFETSEGNIVVRLFEKEAPKTVKNFVDLAEGKREWTHPGTRKKSSDPLYNGTIFHRVIPNFMIQGGDPMGSGFGGPGYQFEDETKGSPHKFDKPGKLAMANSGPNTNGSQFFLTVAATTWLTGNHTIFGEVVEGMDVVEKIVNVPRSRQDKPNSDVSIKTVKIERAE

SEQ ID NO: 81573 - protein, 526 aa, Physcomitrella patens subsp. patens
MQATQLLLEEPIRLASILEPSSPTAFSALTKIIGTLGPQSRDVETIEALLKAGMTVARFDFSWGDDAYHQETLENLKKAVKNTRRLCAVMLDTVGPELCVLNSDEGVIELVEGASVLLAADRTVKASATVLPLNYDGLASAVKKGDTIFVGQYLFTGSETTSVWLEVVETKGKDVVCTVKNTATLAGNMFTAHVSQVRIDLPTLSEADLKTMATWGVKNQIDFVSLSYTRHADDVRACREHLSKLGDLRQTQIFAKIENYEGLAHFDDILKEADGIILSRGNLGIDLPPEKVFLFQKVALQKCNAAGKASIVTRVVDSMVDSPRPTRAEATDVANAVLDGTDGIMLGAETLRGLYPEESISTVHKICAEAEKVFNQAVYFKRTIKGVKEPMQHLESIASSAVRAATKVRASVIVVFTSSGRCARLIAKYRPTMPVLCVVIPRLTTNHLKWSFTGAFQARQCLAVRGLFPMLADPRHSSDSASTTNESILKVALDHGKAAGIVKAHDRIVVCQKVGDSSVVKIIELD

SEQ ID NO: 81574 - protein, 107 aa, Triticum aestivum
TRPLPPYVARLLRAKITQAHALRDVALRGRKLRAPEAREMGIVDAVCAGAPETAAEAVKLAEQLAAREWDGAVYASIRVSTFPDACRAVGIAVESDEEKSRHFASRL

SEQ ID NO: 81575 - protein, 620 aa, Escherichia coli O157:H7 EDL933
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKNRRTVCVIGDGAITAGMAFEAMNHAGDIRPDMLVVLNDNEMSISENVGALNNHLAQLLSGKLYSSLREGGKKVFSGVPPIKELLKRTEEHIKGMVVPGTLFEELGFNYIGPVDGHDVLGLITTLKNMRDLKGPQFLHIMTKKGRGYEPAEKDPITFHAVPKFDPSSGCLPKSSGGLPSYSKIFGDWLCETAAKDNKLMAITPAMREGSGMVEFSRKFPDRYFDVAIAEQHAVTFAAGLAIGGYKPIVAIYSTFLQRAYDQVLHDVAIQKLPVLFAIDRAGIVGADGQTHQGAFDLSYLRCIPEMVIMTPSDENECRQMLYTGYHYNDGPSAVRYPRGNAVGVELTPLEKLPIGKGIVKRRGEKLAILNFGTLMPEAAKVAESLNATLVDMRFVKPLDETLILEMAASHEALVTVEENAIMGGAGSGVNEVLMAHRKPVPVLNIGLPDFFIPQGTQEEMRAELGLDAAGMEAKIKAWLA

SEQ ID NO: 81576 - protein, 134 aa, Prototheca wickerhamii
MILFMSATTLEILEKLKAITLLEATELVSQIEKTFGVDASAPAVSGLRPILVEPIKQEDIIEEKTTFDVILEEVPSDKRVPILKVIRALTSLDLKQAKESITDLPKTILQGVSKEESEAAKQQLEAVGGKIKVS

SEQ ID NO: 81577 - protein, 518 aa, Oryza sativa Japonica Group
MVKAYIAIFSIAVLLLIHFLFRRRGRSNGMPLPPSPPAIPFFGHLHLIDKPFHAALSRLAERHGPVFSLRLGSRNAVVVSSPECARECFTDNDVCFANRPRFPSQMLATFNGTSLGSANYGPHWRNLRRIATVHLLSSHRVSGMSGIISGQARHMVRRMYRAATASAAGVARVQLNRRLFELSLSVLMEAIAQSKTTRREAPDADTDMSMEAQELRHVLDELNPLIGAANLWDYLPALRWFDVFGVKRKIVAAVNRRNAFMRRLIDAERQRMDNNDVDGGDDGEKKSMISVLLTLQKTQPEVYTDTLIMTLCAPLFGAGTETTSTTIEWAMSLLLNHPEILKKAQAEIDMSVGNSRLISVVDVHRLGYLQCIINETLRMYPAAPLLLPHESSADCKVGGYHIPSGAMLLVNVAAIQRDPVIWKEPSEFKPERFENGRFEGLFMIPFGMGRRRCPGEMLALQTIGLVLGTMIQCFDWGRVDDAMVDMTQSNGLTSLKVIPLEAMCKPREAMCDVLRKFM

SEQ ID NO: 81578 - protein, 299 aa, Escherichia coli O157:H7 EDL933
MDFPQQLEACVKQANQALSRFIAPLPFQNTPVVETMQYGALLGGKRLRPFLVYATGHMFGVSTNTLDAPAAAVECIHAYSLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKAQDLIDDARQSLKQLAEQSIDTSALEALADYIIQRNK

SEQ ID NO: 81579 - protein, 271 aa, Haemophilus influenzae 86-028NP
MQHKLIAFIGGGNMAQAIILGLLKQGYPAEQIIVNDPNEEKRAFFANLGVATSENNVESAIKAEVVLLAVKPQMMADVCLPLSAVDFSDKLLISIAAGISTERLNALIPSVKSIVRVMPNTPALVGEGMAGLFAPKNTSENYRTFAQDLLGAVGRTVWVDDETQMHAVTAASGSSPAYFFLMLEAMQQALIKMNIDEKTARELVQQSMLGAAKMVTENPQIALSTLRENVTSKGGTTAAALAVFDAQHFNQTIEQAMQACLSRSQEMETLF

SEQ ID NO: 81580 - protein, 253 aa, Xanthomonas axonopodis pv. citri str. 306
MSESPYTSGTTHFGFRDVAAKDKQKLVGEVFTSVARNYDLMNDLMSLGVHRAWKRYFVATAQVKPGDRVLDLAGGTGDIAVLLKERVGNEGAVVLGDINAGMLSVGRDRLTNRGLVSGFDYVQCNAEALPFPDQSFDLLTISFGLRNVTDKDAALREMYRVLKVGGQARVLEFSEVTADWFKPIYDFHSFKILPRLGQLFARDADSYQYLAESIRKHPPQESLKGMMGEAGFARCHFKNLTGGIVAIHSGYKI

SEQ ID NO: 81581 - protein, 207 aa, Zea mays
MENHGNKRVWDQSSDSNTQRVDSPESKIRRVDSSDSGINSSESQLESVLDSSEVQLQDDIFNMLDDTDNVPERDSVQGLDSVIKSFEDEINAPGSDSGSGDPAQEPDSGELQSNLGYLLEASDDELGLPPTVGDGEEMGRAAPEMAELARFVGFEDDIPSYDAFGFGSGFTAENDGGAGGFVTVDGLFDYSDPSADVLWRSESLQAM

SEQ ID NO: 81582 - protein, 786 aa, Ehrlichia ruminantium str. Welgevonden
MLLGHENFDSLLDTDPLSHDTQESTDFIDEKSSNEFEESKELVDHKDTIESIPDVDHTSDAFGKELDVPQTSDQELIDMNAEGNSSVNVLSDQYQDTASELSSSESSDGTESRGSESDDQVLEPELQANTYYATDNEVLDVASLELGLPGVAVGNVEPVQEGSETKPEAVEVEGNESEGVVNVTEEHSDSAASSESIDKESSEDSQLDQTSMEEQDKVEEFERDSNAEDTSVDKEVSEKPDIVEPAPEDSGTKPEAVEVEGNESEGVVNVTEEHSDSAASSESIDKESSEDSQLDQTSMEEQDKVGESERDSNAEDASIDGKEVRGKPDIVEPAQEGSETKPEAVEVESNESEGVVSVTEEHSDSAASSGNIDKESSEDSQLDQTSMEEQDKVGESERDSNAEDASVDKEVSGKPDIVEPAQEGSETKPEAVEVESNESEGVVDVTEEHSDSAASSESIDKESSEDSQLDQTSMEEQDKVGESERDSNAEDTSVDKEVSEKPDIVEPAQEGSTEEESTSVLDEDSKRDVEESEEEGHDTSSDEGTEVDEVDSDGDSADVEKGSNDTLENDLEAEESKVELTEELAVKDMPEESVTEGHGMKKASVVTDDMSEGLAAVHQVDSGKEFKLQEKMGLEGAQSIHIPKSLKSEEKDAVSKKSSTAKKTESTDSKDNAKEKKGTSTSNKTKKTSLPKIMSGVKILVNQYAKQISTGLSESFDKFFEDTESKKRGKRKLSKEDIESMVRDLEQLLVSLKDKKSKLTDPSEIANIEDDIRKLESTIKSILDNQ

SEQ ID NO: 81583 - protein, 1569 aa, Ehrlichia ruminantium str. Welgevonden
MMVNVNVVLLLLHYLQRMVIGHHVVVSQFLKVLHLVLVNNMKNSIILLMLCFITGCGINCIEGSKGVSSTSVSVDVPPVAKVSIITKKVKEKNGKETTIDYRKVHPNWIDTGIRVSENQKINLTINGSVNLCPKDSFNPREIIVPAISCQYGVPDDEYQNESTYFHIRKVCGEAFKNQVKDNAKQKLIDSVIFKRGVTGNQEQSKKQQPTKQQVDQMIFAPDVHTVSTFRLNKGDVFRVNLVPRTVKVKGCSSAELKGLGIIYYSDNEIFEDDQCSKPVKAEYICKNGIQSFSMKIGDEQACINFTEGAGAINRLQGTEVSALVDNRYSPRGNKIFYTNDSKKNWIEAPFIYDARTVKNQKSIDKLKDQCEIIKELNKKNMISHIVNTSTSDADILKYYKEQKERNIIKSEVTQDTIDVLNSFTTYDINCVCGTVCKFDQSLSQQSRISSILTLNEGSSECSVANNSDQEFKNATKEDLEKKDWTKQEWKKDVKTEIIVGLTAYFRLFDNRVDRKSREPLHRCFPSESNSQGFRCISAIFGKSVEENSIKSNVNYTYGFDEPVVLKFGIIGGYNQYAGYSGGYNIHVERMCNFVDGKKLYMYIGNTPPTMLPGSNNTVELFVPKKGKDGKQSTSGTATYTINDDNSQKKSGTIYLGVDVQGYEDQFDYRSMPSVESDNKYTVDFAINRWNPNFSKAFVMIRDFLLKVLYGLPDNQKVSSISQAMDVVRTTKSKGAVQHIYTNQTTSGKLWRGVQALCTLYIIFTVLGYVIGVVKCTKYDLGVRIAKIAVVVGLLSQDSWELFSSHFFSLFVQGVSDLISTFNGELDGDNSFAFLDPTIGVLLTGEVWIRFLTLIITGPIGWLVFAMIIWAVFVFFVCIIEAVIAYLFTIVAIAFLATLAPIFITFLLFQLTKTLFDSWIKMLVNFSLQPIILFAALAFLNQVMLTVLHDVTGFTVCNQCFIGLSLPASVTEKGAPPDVCVMPVLLPVGYASELSIDDAVRESDSRDGRIGFLGLPFGITSVLILLITANAMKAFRGMSEAISQSISGSVAGIGASLHAATQSLASIVGLDQETQSIIKNAMANRRSTGQSDVNISSRANPNPVNEGESLNKDGDDSSNRPVTGDHDKLGSSSVSSGENFDSDEKHQVSSGSRYGPVDDTLINSTKGQVLDTDSSHYKDNGDGVKDTSGNVMDDGSTKTRDNVPDEGSTTNRNDSTQDNIDGKTVEESVATGDGDMQGSNDSDIGDRDGSSSAEDKVPTDNENQNDNDNAQQDGSNVEEESHAADRHDTIDSEDSTDDTSDSSVSEGESDVSESDVESSGDNTTEVGSNTDDKTPGDDDNKDESVQQNESDLGEESNTTDRTDTMDSTDDTSDSSVSEGESDVSESDVESSGDNTTEVGSNTDDKTPGDDDNKDESVQQNESDLGEESNTTDRTDTMDSTDGTSDSPVSEGETNGSGSDVESNTSENDSDDKNLNTNTTVDENNNTNDMQDAESKASSAVDDSSSESEGVGKKRGKRDINFLDGPQKRRLYMDEYSSVKEKIAGHQSAIDVETESHERSQVKRRGKKKDE

SEQ ID NO: 81584 - protein, 258 aa, Alkalilimnicola ehrlichei MLHE-1
MNDRSGDTRSKRDGTIDFGYQQVPVQEKARRVGQVFRSVADRYDLMNDLMSAGLHRLWKHQAINRVQPRRGHRILDLAAGTGDLTLALSKRVGPEGQVVMTDINEAMLARGRDRMIDAGRVDNVRYALCNAEALPFPDQYFDRVTIAFGLRNVTHKDTALREMYRVLKPGGWATVLEFSRVYIPPLRPVYDLYSFRVLPLMGRLVANDAESYRYLAESIRMHPPQEQLAAMMAEAGFEDCDYLNLSAGVVAIHRGFRY

SEQ ID NO: 81585 - protein, 334 aa, Zea mays
MGSGEEPSQMRRALVDSLAGAISGGISRTVTSPLDVIKIRFQVQLEPTTSWGILRRDIYGPSKYTGLLQATKDILREEGLPGFWRGNVPALLMYMPYTAIQFTVLHKLKTFASGSSKTEDHLHLSPYLSYVSGALAGCAATIGSYPFDLLRTILASQSEPKIYPNMRSAFVDIIKTRGVQGLYSGLSPTLVEIIPYAGLQFGSYDTFKRSMMTWNRYKYSHLNFGSEDDSVSSFQLFLCGFAAGTFSKAACHPLDVVKKRFQIEGLKRHPRYGARIESSTYKGMYHALKEIVAKEGFGGLYKGLFPSLVKSAPAGAVTFVAYEYISDWLESILM

SEQ ID NO: 81586 - protein, 1467 aa, Aspergillus oryzae
MALAMDGGTSSGTQTYANSERSDLEQKDKLAENRAEIDEQLTNLARKLTTKSEQLHHRSPFEAPEGGCLDPNSPNFRARDWAKAFYNARYNADENCPPRVAGVAFKDLNVSGYGSPVDYQMSVGNALLKLPTQIYQFLGGKKRKINILQGLDGLVLPGEQLCVLGPPGSGCSTFLKTIAGETHGFQVDPAAYINYHGITPKQMSTDFRGEAIYTAEVDAHYPQLSVGDTLYFASLARAPRHLPGGISSQEYATHLRDVIMAMFGISHTINTRVGNDFVRGVSGGERKRVTIAEAALSYAPLQCWDNSTRGLDSANAVEFCRTLRTQSDVFGMTSCVAIYQAPQAAYNLFDKVIVLYEGHQIYFGTAHDAKSYFERLGFLCPESQTTADFLTSMSSPTERIVRPGFESLAPRTPEEFAKLWKESPERQSLLRQIDQYATEHPFDGADLDRFSQSRKTEKSKNQRQKSPYTLSYWGQIRLCMWRELQRLKNDPSVTIVMLINNFFEALIISSIFYNLSGNTSSFFSRGAILFMMVLLNAFSSMLEILSLYAKRTIVEKHNRYALYHPSAEAISSMIMDMPYKIVNSILMNITLYFMANLRREPGPFFFNYLISFMMVMSMSMFFRLFASLTKTIQQALAPSSIILMALVLYTGFAIPVSYMRGWASWIRHLNPVAYGFEAIMVNEFHGRTFPCASFVPSGVGYENISKDERVCSVVGSVPGSDLVDGTTFVKSTYGYENSHRWRNFGIILALTIFLALCQIIATELVASERSKGEVLVFRRGSSQKARAKQHQHDEERTQAPVIQNEKHSEGPDSTLGVEKQTSIFHWENVCYDVKIKSETRRILDHVDGWIKPGTLTALMGSSGAGKTTLLDVLANRTTVGVVGGDMLVDGRPRDSSFQRKTGYVQQQDLHLHTSTVREALEFSALLRQPPQYTREEKLDYVEKVLDLLNMRDYADAIVGIPGEGLNVEQRKRLTIGVELAARPKLLLFLDEPTSGLDSQTSWSICNLMETLTKNGQAILCTIHQPSAMLFQRFDRLLLLAKGGKTVYFGDIGRESRILMDYFTRNGGPALPPGSNPAEHMLEVIGAAPGAKSEIDWPAVWRNSPEYQNVRHELSNLRALANQPSPVSDTNDKSSYAEFAAPFATQFVQVGLRVFQQYWRTPAYIYSKVLLTIGCSLFIGFSFFKADNTAQGLQNQMFGVFVFLFVVIQLIIQIIPSFVTQRTLYEARERQSKTYSWQAFVVTNILVELAWNSIMAIFCFLVWFYPVGLFHNAEYTDTLHYRSTLTFLFIWVTFLFASSLAHMLIAGIESEEIASSLSNILAIMMYAFCGILAGPDALPGFWIFMYRVNPFTYLVSGLLSTSLGEAPMHCAEKEFLSFSTPANLTCGEYMQDYISTNGGYLLNSGAQGGEDCHFCATGNTTQFLQHVNIDFSTRWRDFGLMWVYVVFNIFAAISLYWLCRLPKGKKNK

SEQ ID NO: 81587 - protein, 332 aa, Chlamydomonas reinhardtii
MSTQPWVEKYRPKNVSEVAYQEEVVNTLTRALETANLPHLLFYGPPGTGKTSTALAIARQLYGPELMKSRVLELNASDERGIHVVREKVKAFAATAVGAPVPGYPCPPYKLLILDEADSMTQDAQNALRRTMETYSRVTRFVFICNYVSRIIEPLASRCAKFRFKPLQPAIMAGRIEHICERESVTLGPGALDTLSAVSGGDLRRAINTLQSAARLGGGHVDRATLLDVSGQVAPEVVSSLAAACRATGAAGRFGALQKQVQNIIAEGYAAQQVLLQLQAELLSGADGGSDLRLCGALEALAGADYSLVVGADEALQLLNVTGQVHAALAAA

SEQ ID NO: 81588 - protein, 284 aa, Microcystis aeruginosa PCC 7806
MNQKDAINLLSLIGGLLVTIVILAAFNAYVIITPGQAGVLSVLGKAKDGVLLEGLHFKPPFVSSVDIYDVTVQKFEVPAQSSTKDLQDLSASFAINFRLDPTQVVAIRRTQGTLQNIVAKIIAPQTQESFKIAAAKRTVEEAITRRSELKEDFDNALSTRLEKYGILVLDTSVVDLNFSPEFARAVEDKQIAEQRAQRAVYITQEAEQQAQAEINRAKGKAEAQRLLAETLKEQGGGLVLQKEAIEAWREGGAQMPRVLVMDGSGKNSVPFLFNYSDSLSENTP

SEQ ID NO: 81589 - protein, 268 aa, Shigella flexneri 2a str. 301
MSVVISDAWRQRFGGTARLYGEKALQLFADAHICVVGIGGVGSWAAEALARTGIGAITLIDMDDVCVTNTNRQIHALRDNVGLAKAEVMAERIRQINPECRVTVVDDFVTPDNVAQYMSAGYSYVIDAIDSVRPKAALIAYCRRNKIPLVTTGGAGGQIDPTQIQVTDLAKTIQDPLAAKLRERLKSDFGVVKNSKGKLGVDCVFSTEALVYPQSDGTVCAMKATAEGPKRMDCASGFGAATMVTATFGFVAVSHALKKMMAKAARQG

SEQ ID NO: 81590 - protein, 436 aa, Acidobacteria bacterium Ellin345
MNFFVIGVNHKTAPVEVRERFAIPESRLPEATKLLASYPGIEEGMIVSTCNRVEMVARSVNGNADMRGFLKQLYNIDPAQYEQYLYEYRSTEAVRHMFRVASSLDSMVVGEPQILGQVKEAYATARAVGAVSSQLDALLTRAFAVAKRVRTDTSIASSSVSIASVAVELAKKIFGSLQGRSVYIVGAGKMCELAARHFVAHGVEKIYVANRTYERGVAFAKKFNGEAVPIEHLYETVDKADIVLSSTGAPIAIFRKEHGEKFLSRRKNRPMFFLDIAVPRDVDAKMNELDGIFVYDIDDLQQVVHSHISDRKDEAAHAEAIVNAEVEKFEERLRTLDVVPTIVSLQEHLETVRQAEIDRLRGRLGELSPEQEMAVDALTKGIINKIMHTPITTLKTAAKEPESTTVIELVKRIFNLHEKAKDETVKTGPPQSGPGK

SEQ ID NO: 81591 - protein, 503 aa, Aspergillus oryzae
MDSVKLLFLSPEVNPSNRKAMSIPILNPFDKYGRVYFFSWLGFMVAFLSWYAFPPLLTVTIRKDLKMTQPEVANSNIVALLATLLVRFVAGPLCDRFGPRLVFIGLLLCGSIPTAMAGLVTNAQGLIALRFFVGILGGTFVPCQVWCTGFFDKKIVGTANSLAAGWGNAGGGITYFVMPAIFDSLVHNQSLPAHKAWRVAYIVPFIIIVVIAVAMFFTCEDTPTGKWSERHLWAEETSRFEGNIVNINSGISSSHPSSPPSTTNIVADLEKKGNPSPPESIAPMPGQLESLRTDTVVAPTFKEAMNVLLSLSTAAVAIPYACSFGAELAINSILGDFYAENFPYMGQTKTGQWAAMFGLLNVICRPAGGFIADLLYRHTQSVWSKKILLSFLGVGMGAFQLALGFSNPKSEATMFGLTAGLAFFLEACNGANFAVVPHVHPFANGIVSGAVGGMGNLGGIIFAIIFRYNGSHYARSLWIIGIIAIAANLAVSWIRPVPRRQMV

SEQ ID NO: 81592 - protein, 518 aa, Zea mays
TPKFFHPSSSSANPPRLRYSQGSALLVLRKQQQQASSHHHLKSSPPRSLSLPLPPLPRRPAMAGLLHLQSTLLPSASALRRRAGAPVPCSSRRRCRVEAKIREIFMPALSSTMTEGKIVSWTAAEGDRLSKGDPVVVVESDKADMDVETFHDGFLAAVLVPAGESAPVGSAIALLAESEEEIPVAQSQAASFSSSSPSPPPPQETAQEASPSPPPPPPSAPVAVSAPALPSPATQGGGRVVASPYAKKLAKDLGVDLFSVTGSGPGGRIVAKDVEAALAAPKKAAPVTAARPDVPLGSTVPFTTMQGAVSKNMVESLAVPTFRVGYTITTDALDQLYKKIKSKGVTMTALLAKATAMALVQHPVVNCSCRDGKSFTYNKSINIAVAVAIDGGLITPVLQDADKLDIYSLSRKWKELVDKARAKQLQPHEYNSGTFTLSNLGMFGVDRFDAILPPGTGAIMAVGASEPTVVGTKDGRIGIKSQMQVNVTADHRVIYGADLAAFLQTLAKIIEDPKDLTF

SEQ ID NO: 81593 - protein, 452 aa, Bordetella petrii
MAFDFDLYVIGAGSGGVRAARFAAGYGARVAVAESRYLGGTCVNVGCVPKKLLVYGAHYREDLEHAASYGWTTGQPSFDWATLIANKNREIERLNGIYRNLLTGSGVTLHEGHARLLDPHTVEINGQRHTARHILVATGGWPNVPDIPGKEHAITSNEAFFLKALPRRVLVVGGGYIAVEFASIFNGMGAQTVQVYRRDLFLRGFDGSVREHLRDELIKKGLDLRFNADVARIDKRPDGSLAATLKSGEVVETDCVFYATGRRPMLDNLGLENTGVKLNDDGFIAVDDEYRSSEPSILALGDVIGRIPLTPVALAEGMAVARRLFRPDEYRKVDYNLIPTAVFSLPNIGTVGLTTEAALQAGHRIKRYESRFRPMKLTLTGDQEKTLMKLVVDADTDRVLGCHMVGPDAGEIVQGLAVALKAGATKQVFDETIGIHPTAAEEFVTLRTPVQE

SEQ ID NO: 81594 - protein, 323 aa, Bacillus cereus ATCC 14579
MSNLFTTVKEKVQGKGISIVLPEGTDERILGAAERLAKEELVKPILVGNKEEISAKAASMNLTLAGVDIYDPATYEEMDAMVASFVERRKGKATEEDARKILKDENYFGTMLVYMGKAHGLVSGAAHSTADTVRPALQIIKTKPGVTKTSGVFIMVREEEKYVFADCAINIAPNSQDLAEIGIESAKTAELFGIDPRVAMLSFSTKGSAKSPETEKVVEATRIAKEMAPELTLDGEFQFDAAFVPSVAEKKAPGSTIKGDANVFVFPSLEAGNIGYKIAQRLGNFEAVGPILQGLNMPVNDLSRGCNEEEVYKLALITAAQAL

SEQ ID NO: 81595 - protein, 165 aa, Triticum aestivum
  misc_feature (105)..(105): Xaa can be any naturally occurring amino acid
MELKAVEKAKQDPSRPHSPAPAGRRQAAQSTTTQMATISAAAATTVVARAAIARPQALGLPQLRTRSERVRCTYSKDAKEATPAAAVRGAGASLLAAAGAVTASXGPALALVDERMSTEGTGLSLGLSNNLLGWILLGVFGLIWSLYTVYTSGLDEDEESGGLSL

SEQ ID NO: 81596 - protein, 322 aa, Triticum aestivum
MANRARWVMKFEKGLIDILHENNNSHYRTPNGWRSEGWKKIVKDFNDRHPDAGFTKVQIQEHETQLKKDYKLIKSILQRDGVSWDQNASMIRTTDEIWDEIIDESPKARKYQSKSFPLLQSLEMLLERDIPEGVGNIDEEDNNTSTLRSMSRRLSALVPGSIDEGENNISALQRTLELGSQGLEDVDLLQNHDEEALERPQPGADPKPQQRADEPAQSSSCIEPQKDKRKKRKASDIQQTMEAYLDFRMKQARTKEQTKKDGEQFSISRCIKALQSMTDVSDQVRVLAADVFKDSVNREIFLSYELRLRALWLKREVNRLLC

SEQ ID NO: 81597 - protein, 278 aa, Streptomyces avermitilis MA-4680
MSTKVPPITLNNGVEMPQLGFGVWQVPDDEAERAVATALEAGYRSIDTAAIYGNEEGTGKAIATAGIPRADLFVTTKLWNSDQGYDSTLRAFDVSLEKLGLDYIDLYLIHWPLPTRGQFVETYKAFEKIYADGRAKAIGVSNFLPEHLRTLIDATSVIPAVNQIELHPHLQQHAAREFHAEHGIATEAWSPLGSGKGLLEVPAIVAIARKHERTPAQVVLRWHIQLGNIVIPKSVTPSRIKENIEVFDFSLDDEDIAAISALNEDRRLGPDPATFDMG

SEQ ID NO: 81598 - protein, 408 aa, Oceanicola granulosus HTCC2516
MNRNHSFAPAERVRALELPERADIAPPSVRQADLDILGQLPPDFLDTTHFDTVAFPPPDYARQMFDAAAADGSLAYTGYRGHPGVLAEVARNVSAFLGVEVDPRRNIALLPGTQAALFATLSARVNRGDRIVLMDPDYLFTARILRFLEAEIAYVPLVLTDGRYEPDIDEMARHFADPATKLAVFSHPNNPTGAVYRPEIIARIAELAAEHDVGLVADELYARLVYDGTPFPHIAAEPGAWERTCTLLGPSKTESLSGYRLGVVVGPAPIMEAIENTLSITSLRAPAYAQHVLRGWLGPDRDWLERRLAAFAELRRTTLSILREVPWLKVHPQHGTAYLWADLRSTGLSDIEIGRTLARDAATLISPGYQFGPNSSGHIRICYARDPATWPDDLRRMIDVLERARTRR

SEQ ID NO: 81599 - protein, 448 aa, Oryza sativa
MSEPEFEQARKELVSTLEASSLFTKNPEYKKALEVVSVPERVIQFRVVWENDKGECQVQKGYRVQFNSALGPYKGGLRFHPTVNLSILKFLGFEQIFKNALTGLNMGGGKGGCDFDPKGKSDNEIRKFCVAFMRELNKHIGADTDVPAGDIGVGGREIGYLFGAYRAERNRWEGVLTGKGGSWGGSLIRPEATGYGLVYYVEHMINYASGGKESFAGKRVAISGSGNVAQYAALKIIELGGTVISLSDSKGALIADDDKGFTPEVINEIAALKLQRKALTALENHSFRYVEGARPWKEVKKVDVALPSATQNEVSEDEAKALIESGAKFIAEGSNMGCTQEAIEVFEAHRRENKGSAIWYAPGKAANAGGVAVSGLEMAQNSQRLSWSAEEVDEKLKGIMKDCFENCLSTAKEYFTPSEGEFPSLVGGANVAGFRKVAAAMHDQGDWW

SEQ ID NO: 81600 - protein, 303 aa, Coccidioides immitis RS
MIRRQARERRDYLYRRALLLRDASIAEKRAKLKASLASGKPLDPSIANDKSLRQDFKYDESLQTDSKASASNAKDADQVDIDDEYAVTSGLVDPRPLVTTSRSPSSRLSTFAKEIRLLLPTSIRLNRGTLVLPDLVASANAAALTDMVLLHEHRGTPTAITISHLPHGPTASFSIHNVVLRADIPNAARGTVSESYPHLIFEGFKTKLGMRVVQILKHLFPPREAGKVGSRVVTFKNIDDSIEVRHHVFVKTGYRDVELAEVGPRMTMRLFEIRGGTLEKGAGGDVEWALTQYTRTSRKKDYL

SEQ ID NO: 81601 - protein, 524 aa, Emericella nidulans
MPPNFAGLSGRKLSLTVSTVATMGFLLFGYDQGVMSGIISDVAFNDVFTATKDDATMQALVTAVYELGCLAGAVYALMFGDRMGRRWMILSGAAVMILGVIIQVTSFPGHIPLLQFFIGRVITGIGNGMNTSTIPTYQAECSKTSNRGLLICIEGGIIAIGTAIAYWIDFGSHYGPPDLVWRFPIAFQIIFGIIIIVGMWFLPDSPRHLIAKGRIEEGEYVLAALNGCEVHDHETQIQKQLTLDSLRASGALGKKTSFRDLLTGGPSQHLRRMLVGSSSQVFQQLGGCNAVIYYLPVLLKSNLHQDNDQALLIGGINMIVYAVFATFSWFFIERIGRRKLFLGGSMVQTTAMIITFACLIPGDEQSSKGAVFGLFLYMAAFGATWLPLPWLYPAELSPVRTRAKANAVSTCNNWLFNFAVVMFTPPMVAAIGWGTYLFFAAWNAFFIPVIWFFYPETANRSLEEIDLIFAKGYHEKISYVRASHELPKLSDDEIEAEAAKYQYSPETEAEVEKGHVAHPGSTSE

SEQ ID NO: 81602 - protein, 368 aa, Xanthomonas axonopodis pv. citri str. 306
MKTRAAVAWGPHQPLTIEEVDLQPPRPGEVLVRLVATGICQGDAHALAHGHAGSFPAILGQEGAGVVEDVGIGVTSVRPGDHVIPLYMPECGVCKFCRSGRTNLCQAIRSSQERGLMPDGSSRFSLHGRPILHHMGTSTFSEYTVLPEIAVARIHPEAPLEQACLLGCTVTTGVGAVLNSTHVRPGDCVAVFGLGGIGLSVIQGALLAQAGRIIAVDIDPAKFALARTLGATDCLDPRDYGAPIQQVIVDLTDGGADHSFECVGDVGAMRAALECCHKGWGESVILGMADDTQEISTRPFQLVTGRVWRGSAFGGVKGRSELPGYVERYLHGDIQLAPLITRTLALDDINQALTDLRAARGIKSIVAY

SEQ ID NO: 81603 - protein, 460 aa, Photorhabdus luminescens subsp. laumondii TTO1
MATGKIIQVIGAVVDVEFPQDTVPKVYDALEVQNGEAKLVLEVQQQLGGGVVRCIAMGTSDGLSRGLSVTDLGHPIEVPVGKATLGRIMNVLGEPIDMKGDIGEEERWAIHRPAPSYEELSNSQELLETGIKVMDLICPFAKGGKVGLFGGAGVGKTVNMMELIRNIAIEHSGYSVFAGVGERTREGNDFYHEMTDSNVLDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYNVARGVQSILQRYQELKDIIAILGMDELSEDDKLVVARARKIQRFLSQPFFVAEVFTGSPGKFVSLKDTIRGFKGILDGDYDHLPEQAFYMVGTIEEAVEKAKKL

SEQ ID NO: 81604 - protein, 207 aa, Escherichia coli O157:H7 EDL933
MSYSGERDNFAPHMALVPMVIEQTSRGERSFDIYSRLLKERVIFLTGQVEDHMANLIVAQMLFLEAENPEKDIYLYINSPGGVITAGMSIYDTMQFIKPDVSTICMGQAASMGAFLLTAGAKGKRFCLPNSRVMIHQPLGGYQGQATDIEIHAREILKVKGRMNELMALHTGQSLEQIERDTERDRFLSAPEAVEYGLVDSILTHRN

SEQ ID NO: 81605 - protein, 495 aa, Artemisia annua
MKSILKAMALSLTTSIALATILLFVYKFATRSKSTKKSLPEPWRLPIIGHMHHLIGTTPHRGVRDLARKYGSLMHLQLGEVPTIVVSSPKWAKEVLTTYDITFANRPETLTGEIVLYHNTDVVLAPYGEYWRQLRKICTLELLSVKKVKSFQSLREEECWNLVQEIKASGSGRPVNLSENVFKLIATILSRAAFGKGIKDQKELTEIVKEILRQTGGFDVADIFPSKKFLHHLSGKRARLTSLRKKIDNLIDNLVAEHTVNTSSKTNETLLDVLLRLKDSAEFPLTSDNIKAIILDMFGAGTDTSSSTIEWAIPELIKCPKAMEKVQAELRKALNGKEKIHEEDIQELSYLNMVIKETLRLHPPLPLVLPRECRQPVNLAGYNIPNKTKLIVNVFAINRDPEYWKDAEAFIPERFENSSATVMGAEYEYLPFGAGRRMCPGAALGLANVQLPLANILYHFNWKLPNGVSYDQIDMTESSGATMQRKAELLLVPSF

SEQ ID NO: 81606 - protein, 244 aa, Mycobacterium leprae
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAPANSCQLRSDVRLRCRRTGRHRSR

SEQ ID NO: 81607 - protein, 791 aa, Vibrio angustum S14
MQKYTLWFNTLSMNDVNQVGGKNASLGEMVSNLSNAGVSVPNGFATTSYAFHEFLEYEGLNNRIYDLLGALDVNDVDALRETGATIRNWILDAPFPLELEQSIRRDYLELIDGNQALSVAVRSSATAEDLPDASFAGQQETFLNVKGVDAVLEATKHVYASLFNDRAISYRVHQGFDHKGIALSAGIQRMVRSDKAASGVMFTLDTESGFDQVVFITSSWGLGEMVVQGAVNPDEFYVHKPMLESGHAPIVRKNFGSKLIKMIYSDNQEIGKQVDIVDTTDEEQYQFSINDEEIKELAKQAMIIEKHYQRPMDIEWAKDGIDGKLYIVQARPETVCSQESQNVIERYELNNKADVLLEGRAIGQRIGSGKVRLVDSLDQMSLVQEGDVLVTDMTDPDWEPVMKRASAIITNRGGRTCHAAIIARELGIPAIVGCGNATEVLTDGTTITASCAEGETGYVYQGELNYEVRRSAVDELPILPTKVMMNVGNPERAFDFAQLPNEGVGLARLEFIINKMIGIHPKALLNFDAQSDELKAQIREKIKGYNDPIDFYVSKLTEGISTIAAAFWPKRVIVRMSDFKSNEYSNLIGGKEFEPHEENPMLGFRGASRYISPVFEDCFELETQAIKRVRNEMGLKNVEIMIPFVRTPSEAASVIELLAKNDLRRGDQGLKVIMMCELPSNAVLADDFLKYFDGFSIGSNDMTQLTLGLDRDSGDVAHLFDERNPAVKAMLKMAIDAATKAGKYVGICGQGPSDHDDLAKWLMEQGISSVSLNPDTVIDTWLKLGDVNKNH

SEQ ID NO: 81608 - protein, 444 aa, Haemophilus influenzae 86-028NP
MTNNNKTMEILMKSGDLNKYDLVKNTLVLVLAGGRGSRLHELTDKRAKPALYFGGNRRIIDFALSNCINSGLNRIGVVTQYAAHSLLRHLQTGWSFLPQERGEFVDMLPARQQIDDSTWYRGTADAVYQNMAIIKNHYRPKYILILAGDHIYKQDYSVMLMDHVNSGAKCTIGCIEVPRSEAHEFGVMAVNENLKVKAFVEKPKDPPAMVGKPDVSLTSMGIYVFDADYLYKMLDREVGTPNTSHDFGKDVLPKCLEEGALYAHPFSRSCMGRNTEGEIYWRDVGTLDSFWQSNIDLVSENPQLDIYDQSWPIRGNPVQAYPSKFFYKHSNVHPVDNSLIGGGCVITDASISNSVLFDRIKIDSFSKVDHCVVLPQVKIGKNCVLKNCIIDRECEIPDGMQIGVDMEEDKNRFRISSTGKVILVTPKMLKILEGHEIGEEGHLD

SEQ ID NO: 81609 - protein, 304 aa, Alkalilimnicola ehrlichei MLHE-1
MTDTTINNADKVAPTLVARVLNEALPYIRRFSGKTIVVKFGGNAMVDDALKQSFARDIVLMKLVGFNPVVVHGGGPQIGKLLERIGKHTEFVQGMRVTDAETMDVVEMVLGGLVNKEIVNLINSQGGRAVGLTGKDGGMIRARRLRLSHQDAAEQPPEIIDIGHVGEVEHIDPSVVDMLDHGAFIPVIAPIGVGEDGLSYNINADLVAGKIAEVLEAEKLMLLTNTPGVLSKQGELLTGLNPARVDALIQDGTIAGGMLPKIRCALDAVAGGVNAAHIIDGRVEHACLLELFTDAGVGTLIQRR

SEQ ID NO: 81610 - protein, 617 aa, Chlamydomonas reinhardtii
MLRARRLLAQGAVATWGQCAAAAEATRDLAAIRFDGAAGLSARAITGSSLAEEDDKAGRPTTPWVRQVISGVDLMRHPKYNKGLAFSDAERDRLYLRGLLPPAVLSQEVQLERTLLNIRSKDSDLEKSTYMQSLQERNERLFHRVLVENMEELLPVVYTPTVRLACQKYGLMFKSLPRGLFITLEDRGRVFRILKNWPERNVKLLVVSDGERVGDLGDLGVQAVGVPISKISLYTACGGISPSITMPVMVDVGTDNEELLRSPFYVGVRHKRVRGDPYYELMDEFLTAVKRRFGNTVLVQFEDMAYDNASKLLNMYRTEFPCFNDDMSGTAAAVLAGVLAALPRTGGRLADHRIVFVGEGAVVACIAELFATAVATATNQTVLDARKRMWLVDSQGLVTRERGDSSTLESFKLPFCHSVGSECRDLASAVQLLQPTVLVGLSTTGPAPPWAFSQDVLQAMAASCRHPLIFPLSAASPECSAEDAYRATDGRALVATEQRVAPVTLPSGRTLHPSQCTSTYIFPGVGLGSLIARCTKLRDEQFIAAADAVSRLVGEEDLARGSLYPPLSRIRDVSAAVAKAVAQKAYEGGFATALPKPHNLYEAARQSMYHPQYRRYR

SEQ ID NO: 81611 - protein, 514 aa, Microcystis aeruginosa PCC 7806
MTGKSKGAIAAGHPKTAEAGQLILEMGGNAFDGIVGSILAAFVVEFTLASAGGGGFLLAHTKEKVNTLFDFFCQTPKYKKPLTNIDFYPVAINFGGASQDFHIGRGAIATTGALRGLEIVQKKLGKLPFTVVAEPAIEYARQGYILSQYNGFCLRLLSSILLKDREGVKVYAPQGQLLQTGDRCVMRDFANTLEELSKKSVKDFYEGEIAHQIAKDMQEGGYLTLEDLSHYQVLERKPLKTQYRGYEILTNPPPSSGGILLAFALKLLETVNLSALEPLGAKHLQILTEVMALTNQARVQGYDDFIHQEGIEDKFLSPEFLGKYPNKWGSTTHISVIDGEGNAASATFSNGEGSAYTVPGTGIMLNNMIGEADLNPFGFHNWPVDRRLSSMMSPTMILEEGKPRFVLGSGGSNRIRTAILQVISNLIDFRQSLPDAIGASRIHWENQQLGVEPWEDRENLLENLVLPANTQVSRWQEQNMFFGGVHGVAVNDWGELTAKGDPRRDGVGLVMGDV

SEQ ID NO: 81612 - protein, 385 aa, Aspergillus oryzae
MFATRNFALPARQCLRSTRVSPRIASPLSQLRGYAAATDERVAKFKGQKDTDGKYTVTLIEGDGIGPEISQSVKDIFAAANAPIKWEPVDVTPILKDGKTAIPDEAIESVKRNYVALKGPLATPVGKGHVSLNLTLRRTFNLFANVRPCRSVAGYETPYDNVDTVLIRENTEGEYSGIEHVVVDGVVQSIKLITKEASERVLRFAFQYARSINKKKVRVVHKATIMKMSDGLFLNLARDIAKEFPDIEFDAELLDNSCLKIVTDPTPYNDKVLVMPNLYGDILSDMCAGLIGGLGLTPSGNIGNECSIFEAVHGSAPDIAGKGLANPTALLLSSIMMLQHMNLGEHAARIQKATFDTLAEGKTLTGDLGGKAKTHEYAEAIMKRL

SEQ ID NO: 81613 - protein, 104 aa, Zea mays
MALTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGG

SEQ ID NO: 81614 - protein, 369 aa, Oryza sativa
MMANARFQKQALLPPRSPFPAAVGAAPSPSPHAELGPIARPRDAPHRHGHQRTSSESVLIDEQPSWLDDLLAEPEAPARPHGRPGHRRSSSDSFTLFDGGASAAAAGMYDNVFDGMRGRGGGGQQVGSWGAAPEFFPEQSSYGRPQGQGGRPWDSRLMLRQGGGGGGGMPVPMNGGHHGPPSAFGDHGHGSLPNGVDRKGPGDSAHDQRMGAERKEGAHLRHSQSEADTKRAKQQYAQRSRVRKLQYIAELERRVQALQTEGVKVSAEMDFLGQQNIMLDLENKALKQRRAGLPREHLIKRFQQEMFEREIGRLRSLFQQQQQQQHIPQQQGPTHSRSNSRDLDSQFANMSLKHGDPNSGRDAVPGLRI

SEQ ID NO: 81615 - protein, 106 aa, Zea mays
  misc_feature (26)..(26): Xaa can be any naturally occurring amino acid
  misc_feature (35)..(35): Xaa can be any naturally occurring amino acid
  misc_feature (59)..(59): Xaa can be any naturally occurring amino acid
  misc_feature (87)..(87): Xaa can be any naturally occurring amino acid
VAAQTKAIAAKIKVCINVGVAYYPVXSRVTGKVAXTPAHAQEVHTSLRYWLNANIIPDXAASTIIIFLSSVTTDNCKELSSHSDEDXINARGASLKPDFIDIINAV

SEQ ID NO: 81616 - protein, 212 aa, Tropheryma whipplei str. Twist
MFKVLVIDNHDSFIYTLVNYLQQLGVTTSVVRSDNNCHSVESMLGVHDAALISPGPGTPEESGITLSVIRAAYSTSTPLLGVCLGHQALAVAFGGDIGPSGRIMHGKLVTVRPRPSAIFKDLPTAFTATRYNSLTVTKVPQALRVIARADCGEVMALEHRTAPMYGVQFHPESAVSEWGFRILGNWLYISGFNKAPGISRDLPIVVYNTRVR

SEQ ID NO: 81617 - protein, 308 aa, Physcomitrella patens subsp. patens
MNRQINAFADRPFSGNPAAVCYLPYPRSDKWMQVVAREFNLAETAFLLKAVKSFTPAPADNEFDLRWFTPMTEVDLCGHATLASAHLLFSSGIVDGNTVVFHTKSGILKANKVSGYQEFDGPPPDERDPKPAKRRQPSDKGVVELDFPSSPPTACSDSSLLSEALGGVEIRWVGRSDVGDYLVELQSSEDVENLNPNFEKMVDFPGRGGVIVTALAAANTEYDFISRFFCPKMGINEDPATGSAHCALGPYWSSKLKKTELNAYQQASERGAKFLVRVDEEAGRCYLQGGAFLVMAGTLLGGSLQYSK

SEQ ID NO: 81618 - protein, 321 aa, Calystegia soldanella
KGQNPVFPRILGHEAAGIVESVGEGVTDLKAGDHVLPVFTGECKECRHCKSEDSNMCDLLRINTDRGVMLEDQKSRFSINGKPIYHFVGTSTFSEYTVCHVGSVAKINPLAPLDKVCILSCGISTGLGATLNVAKPPKGSTVAVFGLGAVGLAAAEGARMAGASRIIGVDLVPSRFELAKKFGVTDFVNPKEHSKPVQEVIVEMTDGGVDRSVECTGNVNAMISAFECVHDVWGVAVLVGVPHKDAEFKTHPMNLLNERTLKGTFFGNYKPRYDLQSVVEKYMNKELELEKFITHEVPFAEINKAFDLMLKGEGLRCIITM

SEQ ID NO: 81619 - protein, 570 aa, Bordetella petrii
MIALLEAQRAGLFQRRHWLPNIVSGVIVGVVALPLAMAFAIASGVKPEQGLYTSIVAGLLVAMFGGSRLQIAGPTGAFIVILAGIVAEHGVAGLQIATLMAGVILVLLGVGRMGAVIKFIPAPVIAGFTAGIGVIIWVGQWKDFFGLPGVTGAHFHEKLWQLLQALPHLHAATTGLAVLSLALLIGTARVPYLRRVPGPLVALVVATALQAMFHFDGVATIGSAFGGVPQGLPTWQWPDVTLSRVIELIGPAFAIAMLGAIESLLSAVVADGMAGTRHQSNQELIGQGIANIAAPLFGGIAATGAIARTATNIRNGGTSPLAGMVHAATLLAIVVLLAPLAENVPLAVLAAILFMVAWNMSDVRHVVKMLRRAPRADVVILLVTFLLTVFADLVVAVNIGVILATLHFLRRMASSVGVQPIEGAELRQELAASGIAQLPDDVLVYTVDGPLFFAAVENFEQALASTRTDPRVLVIRLRRVPFMDATGLQMLEDVIGRLHRRGVRVLLAEANARVRGKLHKAGIADLVGEDALFDTLGQALAACGATRAPEPASPGPAHLDHGLEGKAPAA

SEQ ID NO: 81620 - protein, 254 aa, Zea mays
MPVSRIAVGAPGELSHPDTAKAAVAEFISMLIFVFAGSGSGMAFSKLTDGGAATPAGLIAASLAHALALFVAVSVGANISGGHVNPAVTFGAFVGGNISLLKALVYWVAQLLGSVVACLLLKIATGGAALGAFSLSAGVGAMNAVVLEMVMTFGLVYTVYATAVDPKKGDLGVIAPIAIGFIVGANILAGGAFDGASMNPAVSFGPAVVTGVWENHWVYWVGPLAGAAIAALVYDIIFIGQRPHQQLPTTAADY

SEQ ID NO: 81621 - protein, 276 aa, Mycobacterium leprae
MFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCGVALNAFNPGQAFEIVLSVAALGIIAGWGTIVLCQLRLHKMAKAGIMRRPRFRMPLAPYSGYLTLAFLFAVLVVMAFDKPIGTWTVASLIVIVPALIAGWYSIRKRVMTIARERMGYTGPFPAIANPPVQPSERSHSQNP

SEQ ID NO: 81622 - protein, 279 aa, Zea mays
  misc_feature (254)..(255): Xaa can be any naturally occurring amino acid
  misc_feature (261)..(261): Xaa can be any naturally occurring amino acid
  misc_feature (268)..(268): Xaa can be any naturally occurring amino acid
VGEIVRLSFLKRKLFSSLVWQKIACDAYILSNLGFAEPSIFFGFAFLLHGSLQKRELGTLTQRWNLKTIGYMLVFCVPVFFVQALLVFVGPTFVKDENSAQGRRVFAKYFIQTSMPVGDTNVCTYPLFGTIFLGLIDAVLMSYVSYVGSRVLSLVINKALRKRVTWLIMSVLFFLPIRVLLLGFSVMPNPGDKAFEVIVFLSFVMMLSGTTVGILLLVYWPVHDSLALKDAGNREIAEMVPYDDYYYEGSSLVXXQSFREXERNSDTXTKRGFISFRTM

SEQ ID NO: 81623 - protein, 221 aa, Alkalilimnicola ehrlichei MLHE-1
MMSADQGKRMAAEAAMEYVEENTVIGVGTGSTVNFFIDALADMKARIDGTVSSSEASTARLRQYGIPVLDLNEVGTMPIYVDGADESNRFLQLIKGGGGALTREKIVAAAAERFVCVADESKLVDVLGEFPLPVEVIPMARSYVARELVKLGGRPQLRSGFTTDNGNVILDVRGLKIMEPIKLEQQINNIPGVVTNGLFALRPADVLLLGTAEGVRKLTAE

SEQ ID NO: 81624 - protein, 504 aa, Alkalilimnicola ehrlichei MLHE-1
MSRSYLERILTACVYDVAIQTPLDDGATLSERLGNRVLMKREDLQPVFSFKLRGAYNKINRLSEEARQKGVICASAGNHAQGVALSAKKLGIKATIVMPRTTPDIKVNAVKRLGGRVVLHGDSYDEASQHANKLVEERGLTYIHPYDDPDVIAGQGTVGMEILHQHPRDIHAIFIAVGGGGLAAGIGVYIKQLRPDIRIIAVEPDTAPTLARSLEVGRRVKLEQVGLFADGVAVRQVGKTNWPLLRQYVDDVVLVSDDEICAAIKDIFDDTRSIMEPAGALGVAGLKKYVERTGIRDKTLVAVNCGANMNFSRLGHVAERAELGEHREAVFAVTIPERPGSFKQFCEAIGKRGITEFNYRYADPTQAHVYAGIQLSRGDEERELLREELEEAGYPVLDLTEDEMAKVHVRHMVGGRGGGVENEILYRFEFPERPGALLKFLSRMGRRWNISLFHYRNHGAAYGKVLVGMQVPEAERGRCVEYLDKLGYRYAEETDNPAYRLFLS

SEQ ID NO: 81625 - protein, 233 aa, Glycine max
MASSENVASIEPCMLRPPVTDSWLAEFFARDADALTKALQKSLSGTVLPDEENYFSPFLPKSDPAVATPTVSSLSGSDQDSAPRRRAPLPPSGKISKRKSRASKRSQTTFITADPANFRQMVQQVTGVRFGGAGQPIAPAAGVVKPEPQRASGLARFPAGAGCLPTLDTSAFLLDHHQQVVGPSSVNSGPATGLSGPGPLPFAQPLLDASFASAGLDFDTFSSFPTLESWKVM

SEQ ID NO: 81626 - protein, 687 aa, Vibrio fischeri ES114
MKNTSAFAWTKDDEQIAWLTIDVPNEKMNTLQAAFAEQVTQVLDEIEEQQAHIKGLVIQSGKPDNFIAGADINMIANCQNASEAQALAEKGQHLFQRIEDLPFATVAAIHGPCLGGGLELALACDYRVCSDDNKTKLGLPEVQLGLLPGSGGTQRLPRLIGLLPSLDIILTGKQLRPKTALKLGVVDASVPHTILSRIAADFALKKKAKRKLTAKEWGLSRNPLGRNVIFSQAEKQAQKKARGNYPAIAAILDCIEHGLDKGMKKGLQREAEQFARLAMTPESAALRSLFFAMTEMKKEKGSDAEPKSIDYVGVLGGGLMGGGIAHVSIAKAKKKVTIKDINNDGLLNAYQYHYQRLDTLRKRRIISKAQLQQQMLQLTGVTEFDGFKKLDVVVEAVFEDLNLKQEMVKAVQEQGKEDVIFATNTSSLPIGQIAEGAQKPENIVGLHYFSPVEKMPLVEVIPHATTSDETISTVVALAKQQGKTPIVVKDSAGFYVNRILAPYMNEAARLLLAGEPIEVLDEALLDFGFPVGPISLLDEVGVDIGAKIMPILEAELGDRFRSPDVFQTLIDDKRLGKKTKRGFYVYKGKKKEPDQEVYTLLNIKPQSQLSKNEIAMRCVLPMLAEAKRCLDEGIIASERDGDIGAIFGIGFPPFLGGPFTYMNTLGEEKLATLMRNYADKYGDRFIE

SEQ ID NO: 81627 - protein, 342 aa, Zea mays
MALSSLFIILPVPKVPYSNYSRRLLTARASSDAPAASASFDLRRYWTSLIADVESELDAAMPMQPPESIHSAMRYAVLPGAGKEGAAKRAPPVLCVAACELLGAPRAAALPAAAALEMLHAASLVHDDLPCFDAAPTRRGRPSTHAAYGTDMAVLAGDALFPLAYTHVISHTPCPDPVPHAVLLRVLAELARAVGSTGMAAGQFLDLAGATALGEAEVMQVLTKKFGEMAECSAACGAMLGGAGPDEEAALRRYGRTIGVLYELVDDIRSASGNGKMRSNASVLRSLGMDRALGIVEELKAQAKTEADRFSDKYGDRVLPLYSFVDYAVERGFELQDAAATL

SEQ ID NO: 81628 - protein, 753 aa, Yersinia pseudotuberculosis
MGASATNSVTHPAFTLNVRPDNIGIITIDVVGDKVNTLKAEFADQIATILQQAHALPKLQGLVIVSGKPDSFIAGADITMIAACRTAHDARVLAQKGQSILAQIAAFPVPVVAAIHGACLGGGLELALACHSRICSLDDKTVLGLPEVQLGLLPGSGGTQRLPRLVGVSKALDMILTGKQIRPRQALKMGLVDDVVPRDILLDVAIQRAKAGWLNRRALPWQERLLSGPLGKALLFRIVRKKTLAKTRGHYPAAERIIDVVRKGLDQGGPSGYEAEARAFGELAMSPQSAALRSLFFATTSLKKETGSAATARAIHRVGVLGGGLMGGGIANVTATRAGLPVRIKDINPQGINQALKYTWDALGKRVRSKRMRPTEQQRQMMLISGSTDYRGFERVDIVVEAVFEDLSLKQQMVADIERFGAAHTIFASNTSSLPISQIAALAQRPEQVIGLHYFSPVDKMPLVEVIPHEKTSEETIATTVALARKQGKTAIVVADRAGFYVNRILAPYINEAARCLLDGEPIESVDNALVDFGFPVGPMMLLDEVGIDVATKIMPILVEQLGPRFAAPPSFDVILKDGRKGRKNGRGFYLYSNPTLHSNSTKNSSPTKNGNSPAKRNSFKWRKNKVKPVDSSIYTLLGVTPKAHLGAGVITQRCTMLMLNEAVRCLDESIIRNPRDGDIGAVFGIGFPPFLGGPFRYLDSLGADKVVQALRLLVQQYGERFEPCQRLVTMAEQQQQFYPVDANIDEVTDVAS

SEQ ID NO: 81629 - protein, 182 aa, Triticum aestivum
MEEQGERGLQLLLPAAAARVLREAPVSAATDHQQLDLDLSMSIGPRQQQLLQLQLPRPAPPTPPANESKRAAATVAASAATARQLQQQVTVDVRSVKQQTAEQARMASAERAYAERVRDLAKRELELAEREFARARMIWERAREEVERVERMKQIAARRLGSAASAAALEITCHACMQRFHP

SEQ ID NO: 81630 - protein, 273 aa, Chlamydomonas reinhardtii
MAEHLASIFGTEKDRVNCPFYFKIGACRHGDRCSRLHNRPTISPTILMANMYQNPLLNAPLGPDGLPIRVDPRAAQEHFEDFYEDVFEELAAHGELENLNVCDNFADHMVGNVYAKFRDEDAAARALTALQGRYYDGRPIIVEFSPVTDFREATCRQYEENTCNRGGYCNFMHLKPISRELRKKLFGRYKRRERSRSPRRDRGDRGDRGDRRERDRDWDRGDRDRGRGRSRSRSRERGGGDRRRETSEERRAKIAAWNTERDGSAGGGGGGGW

SEQ ID NO: 81631 - protein, 200 aa, Aeromonas hydrophila
MALVGRPAPDFTAAAVLGNGQIVDSFNLASHIKGKAAVLFFYPLDFTFVCPSELIAFDHRLEEFNKRGVEVIGVSIDSEFSHNAWRNTKIEDGGIGPVKYPLVADIKHEICKAYDVEHPEAGVAFRGSFLIDKNGVVRHQVVNDLPLGRNIDEMLRMVDALQFHEEHGEVCPAQWEKGKKGMTASPDGVAKYLSENAASL

SEQ ID NO: 81632 - protein, 515 aa, Oryza sativa Japonica Group
MTPEQRLRAADLDAKAASLRRSIHDLRLRVPPPHVAQRLPHLHAHSLASSAALALQLNAHSSTKEQQSSSCNYSSRAGCYLHPYLKLKTSAATCFGSLPPFRIAADLRFPAISAMTTNMRPNDTFNTISHKALQREITLQEENAAYEKAISNCRQKIQEKQMEVTLLRSNLKEMEISEQDLKAQLDNAQNEQYASQNKASAAASDNTGNALMEAESLINLKSNDLKEKNEELAQAEGLIVDVHAKEKELERLNNLHKNLQSRNNDGSVARNPFRAVHEDSDAKAVRRPYQFGLRTEGLKRLMILRSAFVLYILVLHIVVFIKLSVSKQGDTGGGHCRRANSASPPQGRRQQGLLLPQGRGFGAHDPGQLLGRRQALGEERDGLAAGVEGDGIGSWVDRVAMARRRHWSDALPARSDTLSSGSGLPGAGGQPPVLAATARRRGTAAWWRWHRDAGSGTPRQISPTLSGSGLPGAGGKPRGPAARAWRMRRKRGGSGATVEVGETAGRGYGGDGADI

SEQ ID NO: 81633 - protein, 283 aa, Tropheryma whipplei str. Twist
MVVFVLTYVPSVLLGDGVSIPQFGLGTYELPPNEASSVVQSAIELGYRHIDTASLYANEREVGRAIASSGIKREEFFVTTKLWNSDQPKPREAFERSLDLLSLDYVDLYLIHWPCPPSELYINVWEVLLELKESGRAKSVGVSNFLSEHIDKIKEAGFPLPSVNQIELHPWLQQRELVLSCRNDGIQIESWGPFARFSKDLDAFPELTRPAKQYGKTPAQVILRWHIQKGYVVFPKTVHAERLRQNIDIFDFDLTPDEISGIDSLDAGFRTGPDPSSFRAGLD

SEQ ID NO: 81634 - protein, 128 aa, Oryza sativa Indica Group
MTNEVECKDLQVELSSGKEVADIIPNINEIKKCDGRGVIVTGPAPAGSDYDFFSRFFCPKFGIDEDPVCGSAHCVLAPYWGGKLGKQKLTAFQASPRSGTLYLELDGENRRVRIQGEAVTVMAGTLLA

SEQ ID NO: 81635 - protein, 477 aa, Solanum lycopersicum
NSILSKLATNEEHGENSPYFDGWKAYDSDPFHPLKNPNGVIQMGLAENQLCLDLIEDWIKRNPKGSICSEGIKSFKAIANFQDYHGLPEFRKAIAKFMEKTRGGRVRFDPERVVMAGGATGANETIIFCLADPGDAFLVPSPYYPAFNRDLRWRTGVQLIPIHCESSNNFKITSKAVKEAYENAQKSNIKVKGLILTNPSNPLGTTLDKDTLKSVLSFTNQHNIHLVCDEIYAATVFDTPQFVSIAEILDEQEMTYCNKDLVHIVYSLSKDMGLPGFRVGIIYSFNDDVVNCARKMSSFGLVSTQTQYFLAAMLSDEKFVDNFLRESAMRLGKRHKHFTNGLEVVGIKCLKNNAGLFCWMDLRPLLRESTFDSEMSLWRVIINDVKLNVSPGSSFECQEPGWFRVCFANMDDGTVDIALARIRRFVGVEKSGDKSSSMEKKQQWKKNNLRLSFSKRMYDESVLSPLSSPIPPSPLVR

SEQ ID NO: 81636 - protein, 261 aa, Silicibacter pomeroyi DSS-3
MIGSANLNIMIKAARKAGRSLVKDFREVENLQVSMKGAGDFVSKADIAAEAILKEELRNARPTYGWIAEEGGVEEGEDPTRRWIVDPLDGTTNFLHGLPHWAISIALEHKGKVVAGVIYDAAKDEMFFAEKGEGAWMNDQRIRVSGRHRMIEAVFATGLPFGGRADLPLTLQDLARLMPVCAGVRRWGSAALDMAYVAAGRYEGFWERRLNAWDVAAGIIIVKEAGGLIEALDPEDSILDSGEVICANGNIFDPFAKVIRG

SEQ ID NO: 81637 - protein, 644 aa, Oryza sativa Indica Group
  misc_feature (97)..(97): Xaa can be any naturally occurring amino acid
MASSLLRKSTVVGSPTSPSAMVGFQGARVGGLRLRHRLGGARRVAAEGPLLGRGRRHQLLHHPSQGHLPWEESGHLRPASNRVLHLIKQSSEGNMVXGCNSKNKKGAYTGVCSQAHVPSYKNNIDKLKAKGVDSVICVSVNDPYALNGWAEKLQAKDAGKKVVIFGLPGAYTGVCSQAHVPSYKNNIDKLKAKGVDSVICVSVNDPYALNGWAEKLQAKDAIEFYGDFDGSFHKSLDLEVDLSAALLGRRSHRWSAFVDDGKIKAFNVEVAPSDFKVSGAEVDAFAAEPFKGNPAAVCLLEGEDAAAAADERWMQSVAAEFNLSETAFLIRDPSSSAAAADAAPRFRLRWFTPVAEVASPFPPTLGFLLLVSPVFIRTRRRRCLQVNLCGHATLASAHFLFTTVLAKQQHAAAAMVEFVTRSGILTAKKVPAPPPPANDGGVPGEEKLFIELDFPMIDLVEYDSAETLSIPETLNGARVVSVWKSSTAGDLIIKMEVMNHGNATATIISLRERIANLLRMLILNEELVELSSGKEVADIIPNINEIKKCDGRGVIVTGPAPAGSDYDFFSRFFCPKFGIDEDPVCGSAHCVLAPYWGGKLGKQKLTAFQASPRSGTLYLELDGENRRVRIQGEAVTVMAGTLLA

SEQ ID NO: 81638 - protein, 1151 aa, Coccidioides immitis RS
MAYRSSTESDGRHRSGSKSSSESSQLTPLQDGFTPLSSSAPPGWGFNTSTVASISSIVPSGPLPSSSAVTSPLHTSIDTSTRNVRNDAIDAPFLASPLPLELPESVMGIGTQSTFTDGPLGNVAFNKAPGIMRRLSRGAASKLGRRGSLNSHDKRDHSSGPVIMRRRSDSKTSVSKDSALDSSVEEDDKPDPLKARCGPDRVSFGDEYRLSLDSTAGVAPRVDPLLQCGSLLTKVTKQRKKYKTFFLDVDTAKVYWDLSNPSKRFYIDDIKEIRLGPDARNYREEHQVPIEFESRWFTIIFANPEGSKNRPVKALHLIAPTRFIVELWTTTLEQISRYRIGLMVGLAGSGQSETILKAHWQREIARRFPGSPRTFEDECLDVGAVENLCHSLHVNCSKRVLRGQFARVDADGRGKINFSQFQSFVQHLKDRKDIRKIFDSVVAESRGGLSIEEFFEFLRSAQGEDVDKNRDYWASVFERFVRRSRRSQSLPEALSSSAARMDLDAFSSFLISPANGIYPTHVPPPKFDLPLNDYFISSSHNTYLLGRQVAGASSTEAYIAALQKGCRCVEIDCWDGPDGRPIVSHGRTMTTSVLFADCISVIDRYAFLSSDYPLILSLEVHCNAEQQIAMTNIMKNEFGDKLLLEPLRADWPILPSPEALKGKILIKVKTSDESEEKISGSSKVMGRKRSSSSPFIQSTTQNSFPTNSSFSSPPTIGPIDGLPPVLTQPKRSLTGTSLSSASEESDTAFATMPFPGKRKMPKSRVIKVLADLGVYARGYKWRGFDTPESKQFNHVYSFAERSIETICRDSENKALLEAHNRLYLTRVYPSGYRLRSSNFDPNSFWRRGVQMAALNWQTFDVGMQMNQAMFAAGNDRTGYVLKPESLRVPPSSRHTMDGKPKIDRQLVRFRVDVISAQQLPRSRGMGPDDSINPYIEIEILCADDKKKGMAFGEGGVDASNRNGFSGIGLPHRRRTQIEQKNGFNPIFGDEFKFSLETKYPDLVFVRWIVWNSTDGRSFGGNNSIQLATFTAKLSSLAQGYRYLPLYDSNGDQYLFSTLFCKITKLESAPAAQRRDIEESKSERKGIFRQLGQSMFKRALSTEREKDVARQKSRLTGSIRKSDSLNREKNETSSSSSSSSSLPILSTVPSGQ

SEQ ID NO: 81639 - protein, 473 aa, Tropheryma whipplei str. Twist
MSLVRRLRVSVKKNHKIVVIGGGPGGYSAALSGALLGADVVLIENQAVGGSATLTDVVPSKTLIASAERAVFVAQGADFGIRFQNCVSADIGHINRRIMDLTRAQSADMFSTLTGAGVRVVYGHAALDGPNRVLVSVSGQEKYEFFANTVVVATGSSPRVLPNAIPDGKRILTWKQLYTLEQVPEHIIVVGSGVTGAEFASAFRNLGSEVTLVSSRDRVLPGGDEDAADLIQEVFINSGMKLLNRARAQAAAACNGGVVVTLTDGTEVRGTHCLMAVGSVPNTSGIGLETANIALNPAGRITVNRVACSSVPGVYAAGDCSDFLPLASVAEMQGQVAVYHAMGENANPIELKNLASTVFTTPEIATVGRSEKAIDKARATALKVDLATNSRAKILGIKTGFVKMIVSRETGTVLGGVVVAPNASDLIFPISVAVQNRLSADQLSQSFAVYPSLTISLWHAARASHVRTDSASP

SEQ ID NO: 81640 - protein, 485 aa, Solanum lycopersicum
MGFEIAKTNSILSKLATNEEHGENSPYFDGWKAYDSDPFHPLKNPNGVIQMGLAENQLCLDLIEDWIKRNPKGSICSEGIKSFKAIANFQDYHGLPEFRKAIAKFMEKTRGGRVRFDPERVVMVGGATGANETIIFCLADPGDAFLVPSPYYPAFNRDLRWRTGVQLIPIHCESSNNFKITSKAVKEAYENAQKSNIKVKGLILTNPSNPLGTTLDKDTLKSVLSFTNQHNIHLVCDEIYAATVFDTPQFVSIAEILDEQEMTYCNKDLVHIVYSLSKDMGLPGFRVGIIYSFNDDVVNCARKMSSFGLVSTQTQYFLAAMLSDEKFVDNFLRESAMRLGKRHKHFTNGLEVVGIKCLKNNAGLFCWMDLRPLLRESTFDSEMSLWRVIINDVKLNVSPGSSFECQEPGWFRVCFANMDDGTVDIALARIRRFVGVEKSGDKSSSMEKKQQWKKNNLRLSFSKRMYDESVLSPLSSPIPPSPLVR

SEQ ID NO: 81641 - protein, 726 aa, Candida glabrata CBS 138
MSSAVSDRQTVQWVLVVLKALVFMAIFGAAISSRLFAVINFESIIHEYDPWFNFRATKYLVSHSFHEFLNWFDDRTWYPLGRVTGGTLYPGLMTTSAFVWHMLRKIGLPVDIRNICVLFAPAFAGITAIATYQFTKELKDSSAGLLAAVFMAIVPGYISRSVAGSYDNEAISITLLMITFMFWIKAQKTGSIMHATFAALFYFYMVSAWGGYVFITNLIPLHVFILILMGRYNSRLYTAYSTWYAIGTLASMQIPFVGFLPIRSNDHMAALGVFGFIQIVAFGDFVKARVPAQKFKVISLVSLLVLMAVGILGLFGLTYFGLIAPWTGRFYSLWDTGYAKVHIPIIASVSEHQPVAWPSFFFDQHFLIWLFPAGVFLLFMDLKDEHVFVICYSVLCSYFTGVMIRLMLTLTPIVCVSAAIALSKIFDIYLDFSKRDADGKAVPSLDKPASILAKLVISGSFIFYLYLYVLHCTWVTKTAYSSPSVVLQTRDQVGNNIIIDDFREAYYWLRMNTAEDAKIASWWDYGYQIGGLADRTTLVDNNTWNNTHIAIVGKAMAAPEEVSYKLLKEHDVDYVLVIFGGVLGFGGDDINKFLWMIRISSGIWPDEIQEKNYFSDSGEYRVDAMASRAMRQSVMYKMCYQGFADLFPNGQAVDRVRNQQIDNSHVEPLDYFDEVFTSENWLVRVYKLKDEDPEGRELGDVGLINRHPATFRKNSLKKPELNMRIL

SEQ ID NO: 81642 - protein, 265 aa, Staphylococcus aureus subsp. aureus Mu50
MTDKTLQQIDKLICSWLKQIDNVIPQLIMEMTTETKRHRFDLVTNVDKQIQQQFQQFLATHFPEHQLLAEEKSNEMITNEINHLWIMDPIDGTANLVKQQEDYCIILAYFYEGKPMLSYVYDYPHKKLYKAIRGEGAFCNGIKMEEPPSLKLEDAIISFNAQVMNLDTVQDLFDASFSYRLVGACGLDSMRVAKGQFGAHINTNPKPWDIAAQFLFAELLNLKMTTLDGKAIDHLKGAPFIISNKACHETVLKILNANGGYQKYR

SEQ ID NO: 81643 - protein, 417 aa, Brassica napus
  misc_feature (41)..(41): Xaa can be any naturally occurring amino acid
  misc_feature (113)..(113): Xaa can be any naturally occurring amino acid
KEMIANHMQRLVHMENSGLVTMLLNDKYEDLGRMYNLFRRXVTNGLATVRDVMTSHLREMGKQLVTDPEKSKDPVEFVQRLLDERDKYDKIISTAFGNDKTFQNASNSSFEYXINLNARSPEFISLFVDDKLRKGLKGIADADVEVVLDKVMMLFRYLQEKDVFEKYYKQHLAKRLLSGKTVSDDAEKSLIVKLKTECGYQFTSKLEGMFTDMKTSEDTMRGFYGSHPELSEGPTLIVQVLTTGSWPTQPAVPCNLPAEVSVLCEKFRSYYLGTHTGRRLSWQTNMGTADIKAVFGKGQKHELNVSTFQMCVLMLFNNSDRLSYKEIEQATEIPAPELKRCLQSLACVKGKNVIKKEPMSKDIGEDDLFVVNDKFTSKFYKVKIGTVVAQKETEPEKQETRQRVEEDRKPQIEAAIV

SEQ ID NO: 81644 - protein, 181 aa, Silicibacter sp. TM1040
MFAGQKLPQVTFRTRVRDDSIEGPNPFRWQDMTTADYFAGKRVILFSLPGAFTPTCSTYQLPGFENGFEDFKAEGIDEIYCMSVNDSFVMNKWAEAQGIKNVKVIPDGSGEFTRKVGMLVAKDNLGFGMRSWRYAAIINDGVVEAWFEEPGRDDNHAEDPYGESAPENLLKHLKEKVSEAA

SEQ ID NO: 81645 - protein, 343 aa, Debaryomyces hansenii
MASRIEQPVPSRKQVNTRESKEDHDMIAGNFNNMPLLSPTLTPSQVPASETPQVPPMVSDEVRNALPIHEKLPEVRCMARARIPTTHGPEIFLHLYENNIDNKEHLAIVFGEDVRSESLFAKRPNDTQQDRMTRGAYVGKLFPGRVDADHDSQANKSLKFDADGHLIREPSTTFMKDPCLVRIHSECYTGETAWSARCDCGEQFDEAGRLMGNAGHGCIVYLRQEGRGIGLGEKLKAYNLQDLGADTVQANLILRHPADGRSFSLATAILLDLGLAEINLLTNNPDKILAVEGKNRDVKVLERVPMVPLAWRTDNGIKSKEIEGYLSTKIERMGHLLEKPLKI

SEQ ID NO: 81646 - protein, 459 aa, Staphylococcus aureus subsp. aureus Mu50
MENNELQRGLSARQIQMIALGGTIGVGLFMGATSTIKWTGPSVILAYLIAGIFLFLIMRAMGEMIYLNPTTGSFATFASDYIHPAAGYMTAWSNIFQWIVVGMSEVIAVGEYMKFWFPELPTWIPGVIAILLLMAANLFSVKAFGEFEFWFALIKVVTIILMIIAGFGLIFFGFGNGGHAVGISNLWTNGGFMPNGIVGFFFALSIVIGSYQGVELIGITAGETKDPQKNIVKAVNGVIWRILIFYLGAIFVIVSVYPWNQLGDIGSPFVATFAKIGITFAAGLINFVVLTAAMSGCNSGIFSASRMIYTLAHKGEMPKIFTKIMRNGVPLYTVVAVSLGILIGALLNVILPLYIDGAKSIFVYVYSASILPGMIPWFMILFSHLRFRKLHPEELEGHPFKMPGGAVTNYLTILFLILVLVGMVFNVETRISVLIGVIFLTIVTIYYFIRYNKNNVKAK

SEQ ID NO: 81647 - protein, 521 aa, Methanosarcina mazei Go1
MRISLHMTQARRPLMLMILDGWGYREEKEGNAILAASTPHLDRLQKERPSCFLETSGEAVGLPQGQMGNSEVGHLNIGAGRVVYQDLTKINVSIRNGDFFENPVLLDAISNVKLNNSSLHLMGLVSYGGVHSHMTHLYALIKLAQEKGLKKVYIHVFLDGRDVPPKAALGDVKELDAFCKENQSVKIATVQGRYYAMDRDKRWERTKLAYDALTLGVAPYKTSDAVTAVSEAYERGETDEFIKPTIVTDSEGNPEAVIQDTDSIVFLNFRPDRARQLTWAFVKDDFEGFTREKRPKVHYVCMAQYDETLDLPIAFPPEELTDVLGKVLSDRGLIQLRIAETEKYAHVTFFLNGGQEKCYSGEDRCLIPSPKISTYDLKPEMSAYEVTDEVVKRILSGKYDVIILNFANMDMVGHTGDFEAAVKAVETVDNCVGRIVEALRTAGGAALITADHGNAEQMENSHTGEPHTAHTSNPVKCIYTGNGEVKALENGKLSDLAPTLLDLLEIPKPEKMTGRSLIVRK

SEQ ID NO: 81648 - protein, 521 aa, Silicibacter sp. TM1040
MSALSQTQITRKYVIETAGGVVASQHRQAAEAGAAVLRAGGDAVDAAVATSFVVGVLEPWMSGPAGGGAAVHWRADTGEAVAINFGMRSPKGLDLANYPLSGDGKAGDLFPWERVVDDRNVEGATAIAVPGTVDGIGQAHARWGRMSWAELLAPAIAHAKEGMLVDWYAALMIASTARNLARDPDAAALFLDDGVWPKGSGWTAVPDNRLDQSRMADSLAHIAQHGPRAFYEGDLAQAMARDVQDKGGCLSADDLAGYRAWMGNARPVSYRNAQFHVMPGLTAGPTFARVLEQLESADLSTPASAYVAYARALDRAYAERLGKMGDDGEVPEAPGCTTHFSVVDRDGNMVSHTQTLLSIFGSRVVSPATGFLMNNGIMWFDPEQGRPNSLAPGKACLMNVCPILGETVDTRFAFGASGGRKIVSAVSQLASFVVDGEMDIEAAFHTPRIDMSGGEQIIADETLPPEVLGALNAEKPTVPTRRTVSPYAFACPAGVMRKDGKNSGCTEVMSPWGDAITEGQT

SEQ ID NO: 81649 - protein, 204 aa, Debaryomyces hansenii
MPAKFVSIPEAIEAFKNGEYLIVMDDESRENEGHLIMSAELMTQEKMAFLVRYSSGYVCVPLSTERADALNLHPMLANETDRHGTAYTVTCDYADGTTTGISAHDRALTATKLADPSSKPVDFIRPGHVLPLRAVPGLLKKRRGHTEAGVQLCELAGLQPAAVICEMVRDEDGLMMRLDDCAKFSETHNIKMITIEQLVEHISQ

SEQ ID NO: 81650 - protein, 629 aa, Arabidopsis thaliana
MSLASIRRLAAGAAVIAAASGGAVYLSPSVASSDKGGGPILDSLRRRLGDPTASVPSRSAQESALIAATASDPLDVLVIGGGATGSGVALDAVTRGLRVGLVEREDFSSGTSSRSTKLIHGGVRYLEKAVFNLDYGQLKLVFHALEERKQLIENAPHLCHALPCMTPCFDWFEVIYFWMGLKMYDLVAGPRLLHLSRYYSAKESIELFPTLARKGKDKNLRGTVVYYDGQMNDSRLNVGLACTAALAGAAVLNHAEVVSLITDDATKRIIGARIRNNLTGQEFNSYAKVVVNAAGPFCDSIRKMIDEDTKPMICPSSGVHIVLPDYYSPEGMGLIVPKTKDGRVVFMLPWLGRTVAGTTDSNTSITSLPEPHEDEIQFILDAISDYLNIKVRRTDVLSAWSGIRPLAMDPTAKSTESISRDHVVFEENPGLVTITGGKWTTYRSMAEDAVDAAIKSGQLKPTNECVTQKLQLLGSYGWEPSSFTTLAQQYVRMKKTYGGKVVPGAMDTAAAKHLSHAYGSMADRVATIAQEEGLGKRLAHGHPFLEAEVAYCARHEYCESAVDFIARRCRIAFLDTDAAARALQRVVEILASEHKWDKSRQKQELQKAKEFLETFKSSKNAQFNDGKHN

SEQ ID NO: 81651 - protein, 310 aa, Bordetella pertussis
MIFTGTANTRLAVDVVNHLDMSLGKMTVGRYSDGEVMVEINENVRGKDVFVLQPTCAPTNDNLMEIMVMVDALRRASAGRITAAIPYFGYARQDRRPRSARVAISAKVVANMLQVAGVDRVLTMDLHADQIQGFFDIPVDNIYAGPILLGDIWRRNFSNLVVVSPDIGGVVRARALAKQLEADLAIIDKRRPRANVSEVMNIIGEVDGRTCIIMDDMVDTAGTLCKAAQALKDRGAGAVYAYCTHPVLSGGAIERIETSSLDELVVTDTIPLSEQAQACGKIRQLSCAALLGETILRISNAESVSSLFAD

SEQ ID NO: 81652 - protein, 309 aa, Photorhabdus luminescens subsp. laumondii TTO1
MSTAKLAVLGSINADHILNLKSFPRPGETVIGEQYQVAFGGKGANQAVAAGRSGADITFIACVGEDDIGFRICQQLAKDNINTSGIEVIKGETTGVALIFVNHQGENIIGINAGANAALTPEYFYRYQNIIEEADALLIQLESPLETVQLAATIAKQNNTKVILNPAPARKLSDQLLSLVDIITPNETEAEYLTGIKVENDSDAENAAQILHGKGIETVIITLGSRGVWLSESGQKGKIVPGFKVNVVDTVAAGDTFNGALVTALLERKSMLSAIRFAHSAAAIAVTRQGAQPSVPWRNEIDAFLIEQD

SEQ ID NO: 81653 - protein, 106 aa, Triticum aestivum
  misc_feature (10)..(10): Xaa can be any naturally occurring amino acid
  misc_feature (21)..(21): Xaa can be any naturally occurring amino acid
  misc_feature (52)..(52): Xaa can be any naturally occurring amino acid
  misc_feature (81)..(81): Xaa can be any naturally occurring amino acid
  misc_feature (84)..(84): Xaa can be any naturally occurring amino acid
  misc_feature (93)..(93): Xaa can be any naturally occurring amino acid
HGAGLMAATXLAMVPSYISRXVAGSYDNEAVAIFALIFTFYLYVKTLNTGSXFYATLNALSYFYMVCSWGGYTFIINLIPXHVXLCIVTGRYXSRLYVAYAPLVSR

SEQ ID NO: 81654 - protein, 479 aa, Alkalilimnicola ehrlichei MLHE-1
MNTLHSPADDQPPVHRHAIILAGGSGTRLWPLSRSTMPKQLLALDGDESLLQQTARRLLPLVSADRVTTVTHQDHRFEVMGQLHAVAPALADQVLAEPAGRNTLPAIAWAVAAIVRHDPEAVVGVFSSDHVINRVEDFHRAWRAAEPAAEAGHLVLFGIRPTEPATGYGYIQAARPLMEGVEEVSRFVEKPDRATAERFLEEGGYYWNGGMFVFRADRFMDLLARHQPALAEAVTAMAAAGAPPTAEAYAELPNTSIDYGLVEHADRVAVVPAELGWNDLGSWEALYQQRSKDPDGNVCQGTVLAEDSRNNLLWSDDSGLIAAYGVEDLALVQTRDATLVCPRSRLAELKQMVARVREEHRELTETHLTVARPWGSYTTLEEGHRYKIKRIVVKPGGQLSLQMHYHRSEHWVVIAGTARIVNGEETIYLEENQSTYIPKTRPHRLENPGRIPLQIIEIQTGPYLQEDDIVRFEDTYGRR

SEQ ID NO: 81655 - protein, 260 aa, Thermoplasma acidophilum DSM 1728
MVKESAEILSEIRKNYILSTMKGGKRIDGRLPDEFRELTIIENYIPRANGSAYVALGNTRVVAGVKIEAGEPFPDTPDQGVLTTNVELLPIAFPSFEAGPPNDLAIEVSRVVDRGIRESKMISPEKLVIEQGKKVWIVFLDINVLDYDGNLIDASTIAAVAALRNAVVPASKEGGEDFKLPVSSTPISVTMVKIGDTLVCDPSLEEDQICGGRITVTTTEDGHIRAMQKGEIGAFTVEDVKKAVKMSLEVGKKLREKYFR

SEQ ID NO: 81656 - protein, 808 aa, Cryptococcus neoformans var. neoformans JEC21
MHPAPADAHAQRPPKKIGPDTSIKDTWAKLAAAIREIQNHNASRLSFEEHYRYAYNLVLFKHGDQLYSGVKTLVVEHLDRLAHDRIVPAFPRSGGTRGAGKLGGGAEAIERATEGDRFLKAVKGVWEDHTGSMRKLKDVLKYMASLDKVHAPTAGVPPVYELGLSLFLTHIIRQPTIHTHLISTLLSQVQLEREGFTITRSTVRECIDILLRLRVPEREGGGNVYQQDFEPEFLRRSGEWYEYEAGEELVHGDASLYLSNVSRRLAEEHDRTIHYLSPSTLPHLESLLISSLLTPHLVTVLNMPGSGLVQMVDKDRYGDLKRLYELFGKVPGDQGVAALKHAVAADIDLRGKAVNAGTADVDPNTANPKPTPPLTLALQWVHSILLLFDKYTLILASSFSSSLALQSTINSSFQTVINAHPRAPEFLSLYIDETLKKGKGAKGVGIAGAGKGVTEEEMEEAKEKTIRIFRFLTDKDKFERYYKNHLARRLLSGKSVGGDAEQEMVGRLKKEVGFQFTHRLEGMFTDMRLSDEAANIFGNDPRYNDIPFTLHVSVLTSSNWPPSTLLSLPLTFPAPLLPALEHYQTFYDSRHSGRRLTWQGLLGSADLKVRTRKGQWEVNLSTIGMVVLLAFSDLKPGDVLSYHELKAQTSLPDAELARTLQSLACGKHRLLVKHPKGREVEQGDTFEFNEAFSSPLARIKILQISSSSSAASTSTSSARGVGVENAQEREETERQIEEERKHQVEACIVRIMKDRKTMRHNDLVSEVAHQLAKRFMASVPMIKKRIEGLIDREYLERTEDMGSYRYLA

SEQ ID NO: 81657 - protein, 112 aa, Glycine max
  misc_feature (61)..(61): Xaa can be any naturally occurring amino acid
  misc_feature (71)..(71): Xaa can be any naturally occurring amino acid
  misc_feature (96)..(96): Xaa can be any naturally occurring amino acid
MMEELEQWKALRVHLVYLAMDRVREVPTNQLYAGVAKVMCTTLLLLTIRLFERVKSNANVXPGVSGSGNTXLLYQIRGGSADQGRGTSTELNEGTXILHSEVAGNVKIVPVA

SEQ ID NO: 81658 - protein, 286 aa, Triticum aestivum
  misc_feature (219)..(219): Xaa can be any naturally occurring amino acid
  misc_feature (228)..(228): Xaa can be any naturally occurring amino acid
  misc_feature (241)..(241): Xaa can be any naturally occurring amino acid
  misc_feature (251)..(251): Xaa can be any naturally occurring amino acid
  misc_feature (283)..(283): Xaa can be any naturally occurring amino acid
PAGYRYMEDEAEKLMAESFSKNFIDYEEYPQSADIQNRCVNMIGDLFHAPPGSSVGTSTVGSSEAIMLGVLAMKRRWKNRRIAEGKSTEHPNIVMSSAVQVCWEKATRYFEIDEKLVYCTPDRFVMDPEQAVDLCDENTIGMCAILGTTYTGEYEDIKAINDLLVERNLDVPIHVDAASGGFVAPFVVPDLEWDFRCEKVVSINVSGHKYGLVYPGGGXVIWRSPEFXPQELVFNINYLGXDQSSFTLTFXKGASQVIGQYYQLIRLGKHGYRAIMSNLTRTXDYL

SEQ ID NO: 81659 - protein, 384 aa, Flavobacteria bacterium BBFL7
MTASTAIKKNTSFQLDSIEDAIEDIKNGKVIIVVDDENRENEGDFLASAQSVTPEMINFMATHGRGLICMPITESRCQELELDMMVTNNSDPMETAFTVSVDLRGHGVTTGISASDRAKTIQAMIHKDTRGHDLSKPGHIFPLRARDGGVLRRTGHTEAAIDFARLAGHEPAGVIVEIMNEDGTMARLPQLIEVAKKFDVKLVSIEDLVAYRMKNDSLILKKEDFNLRTRFGEYRLRAYQQTTNQQIHLALTLGDWDEEEEILTRMNSTQVNNDLFSTLTSEADRKLDAMFERLNKEGKGAIVFINQQFQPENMLSRLEQLKELQENGEVKAPRKNLDNRDYGIGAQILHDLKISKLKLLTNSEQSKRIGMIGYGLEITETISY

SEQ ID NO: 81660 - protein, 399 aa, Haemophilus influenzae 86-028NP
MAFDYQTFRQEFPYFQREDSVIYLDNAATALKPQVLIDRTAEFYASAGSVHRSQYDAAQTVQYEQARTQVKEWVHAEDKHAVIWTSGTTHAINLVANGLLPQLNAEDEILISQADHHANFVTWHETAKKCGAKIRVLPILDNWLIDENVLISTLSEKTKLVALNFVSNVTGTEQPIKRLIQLIRKHSHALVLVDAAQAISHIKIDLQDLDADFLAFSAHKIYGPNGLGVLTGKLTALSQLQPLFFGGKMVERVSNNRITFAELPYRLEAGTPNIAGVIGFNAVLDWLQKWDFTAAEQYAISLAESVKVRLKSYENCRLFNSPQASTVVCFVFDGIDCSDLSTLLSEQNIALRVGEHCAQPYLARLGERTTLRLSFAPYNTQKDVEAFFTALDKALDLLQ

SEQ ID NO: 81661 - protein, 525 aa, Tropheryma whipplei str. Twist
MTDNFDESSRGLEKYRQAYEVAVTLREDSAKEKQHSKGKMTARERIDKLLDENSFTEIDQFAMHSASGFGIEKNHPYGDSVVTGFGSIDGRKVAVYSQDFTVFGGSLGEVAGRKIVKTMDLAMSAGIPVIGLLDSGGARIQEGIAALTKYGEIFKRNVAASGIIPQISIVMGPAAGGACYSPALTDFVIMVDQISYMFITGPDVIKAVTGEEVTFEDLGGANMHNATSGVSHYMAHSEDDAIAYARELIGFLPSNNMSDPPTWPQDIHTEESDLELNSIVPENPNKPYDMQFVIERIVDDGNFLEIQSAYAKNVIIGFARISGFSIGIVANQPAHMAGALDINASEKAARFVRFCDAFSIPILTLVDVPGYLPGTEQEWTGIIRRGAKLLYAYSEATVPMVTIILRKAYGGAYIVMGSKALGADINLAWPSAEIAVMGAQGAVNILYRNDIKRLVQAGEDANPMKEKLVKEYTDKFANPFIAAQRGYLDAIIEPAQTRIAIATAFQTIRTKRYKQIDRKHGSIPL

SEQ ID NO: 81662 - protein, 455 aa, Oryza sativa Indica Group
MASPSLAAAAASPLTSLDRATSPDTGSRPDGADAVARRKRPVLLLDQRQHLSSPNLDSSVDVDAAAAAAGVAQAQSETPRRKKPGHTSSSTRPRCQTALSVAAKNAVLLAVLLYVGDLAWRAARPAPPRPVDQAAMAGYDARVADVEASLARAFRMLQVQLEAVDRKIDGEVGAVRGELAALLEEKRLELEGQLKRLDARADDLSDALGALKRMEFLRKDEFDKFWNEVKESLGSGPGTEVDLDQVRALAREITMGEIEKHAADGIGRVDYAVASAGGKVVRHSDAYDAGKRGGFFSSLLSGDTAASPKKILQPSFGEPGQCFPLQGSSGFVEIKLRKGIVPDAITLEHVSKDVAYDMSTAPKDCRVSGWYQEAHNEAYSGHAASAKMYVLTEFTYDLDKKNVQTFDITAPDVGIINMVRLDFTSNHGSSALTCIYRIRVHGHEPVSPGMSVSQS

SEQ ID NO: 81663 - protein, 93 aa, Glycine max
  misc_feature (54)..(54): Xaa can be any naturally occurring amino acid
SLDFPFIQQFMILTSLSLSNSTPYLGGVLLLIVSAWLASAKSLYTQFTSLRKEXELYKEIERASSVKIPIISYTDSVNCFFATVSPLNPFSCY

SEQ ID NO: 81664 - protein, 231 aa, Escherichia coli K12 [sequence omitted]

SEQ ID NO: 81665 - protein, 340 aa, Pseudomonas aeruginosa PAO1
MTEQQPIAVLGGGSFGTAIANLLAENGQAVRQWMRDPEQAEAIRTRRENPRYLKGVKVHPGVDPVTDLERTLADCQLIFVALPSSALRKVLQPHQAALTDKLLVSLTKGIEAHTFKLMSEILEEIAPQARIGVISGPNLAREIAEHELTATVVASEDDELCARVQAALHGRTFRVYASRDRFGVELGGALKNVYAIMAGLAAAMDMGENTRSMLITRALAEMTRFAVKLGANPMTFLGLAGVGDLIVTCSSPKSRNYQVGHALGEGLSLEEAVSRMGETAEGVNTLKVLKEKSDEMQVYMPLVAGLHAILFEGRTLAQVIQLLMRGEPKTDVDFIPTTGF

SEQ ID NO: 81666 - protein, 381 aa, Coccidioides immitis RS
MLSGRFVTSSLRQCSRRAVSTSNSSQIRYYAVPAAEKIAKFPGTKGPDGKYTVTLIEGDGIGPEISQSVKDIFSAAKVPIKWEPVDVTPILKDGKTAIPDEAINSVKKNYVALKGPLATPVGKGHVSLNLTLRRTFNLFANVRPCRSIAGYKTPYDNVNAVLIRENTEGEYSGIEHVVVDGVVQSIKLITREASERVLRFAFQYAQEVGKPKVRAVHKATIMKMSDGLFLRTAKEISKEFPDIEFDAELLDNTCLRMVTDPAPYNDKVLVMPNLYGDILSDMCAGLIGGLGLTPSGNIGNECSIFEAVHGSAPDIAGRALANPTALLLSSIMMLRHMGLNDHAKKIETAIFETLAEGKTLTGDLGGKAKTHEYAGAIIKRL

SEQ ID NO: 81667 - protein, 342 aa, Zea mays
  misc_feature (14)..(14): Xaa can be any naturally occurring amino acid
FTKSNEWTGKFSFXGRSLHHISNTPNPYEQAISIIGRTLSKFDEDNLIPCFAHADASTHDQDVFCFSPDEKPCNGFEEALDRYRELVPHLRLAGPTSFAPIIEMAMTIVEQSGGQYHVLLIIADGQVTRSVDTASGQLSSQEQKTVDAIVKASELPLSIVLVGVGDGPWDMMKEFDDNIPSRAFDNFQFVNFSEIMSKNMAQSRKEAAFALSALMEIPQQYKATVELGILGRRSSKSPNRVPLPPPSASHDAYSYSSKSFSKPTTYPQSSSSSSPYPQYGTPHTATPAAPSATYDNQVCPICLVNPKDMAFGCGHQTCCDCGQILESCPICRTPITTRIKLY

SEQ ID NO: 81668 - protein, 305 aa, Staphylococcus aureus subsp. aureus Mu50
MFQKLSIFATKSFLVWMLVAAVIGFIFPQHVATLGKWVPYLLGIVMLGMGLTITPNDFKMVFKAPRAVIIGVCLQFSIMPTLAFIIAKSFHLPPDIAVGVILVGCCPGGTSSNVMSYLAKANVALSVSITTVSTLLAPFVTPALIYLFANEWLEVSFLSMLWSVVQVVLIPIALGIVLQIINRKIAEKASTALPIISVVAISLILAIVVGGSKHQILTTGLLIFLVVILHNVLGYTIGYWLARLLKLDRQDQKAVSIEVGMQNSGLAVSLAALHFNPIAAVPGAVFSFIHNITGPILAKYWSKKL

SEQ ID NO: 81669 - protein, 882 aa, Arabidopsis thaliana
MERHCVFVTIFVLILHLVQAQNQTGFISVDCGLSPPESPYNAPQTGLTYTSDTGLINTGKTGRIAKDFEPFVDKPALTMRYFPDGIRNCYNLNVTRDTNYLIKATFVYGNYDGLNVDPNFDLYLGPNLWTTVSSNDTTEEIIHVTKFNSLQICLVKTGISIPFINVLEVRPLKKNVYATQSGSLKYLFRMYVSNSSRRIRFPDDVYDRKWYPIFQNSWTQVTTNLNVNISTIYELPQSVMSTAATPLNANATLNITWTIEPPTTPFYSYIHFAELQSLRANDTREFNVTLNGEYTIGPYSPKPLKTETIQDLSPEQCNGGACILQLVETLKSTLPPLLNAIEAFTVIDFPQMETNEDDVTGINDVQNTYGLNRISWQGDPCVPKQYSWDGLNCNNSDISIPPIIISLDLSSSGLNGVITQGIQNLTHLQYLDLSDNNLTGDIPKFLADIQSLLVINLSGNNLTGSVPLSLLQKKGLKLNVEGNPHLLCTDGLCVNKGDGHKKKSIIAPVVASIASIAILIGALVLFFVLKKKTQSKGPPAAYVQASNGRSRRSAEPAIVTKNKRFTYSEVMQMTNNFQRVLGKGGFGIVYHGLVNGTEQVAIKILSHSSSQGYKQFKAEVELLLRVHHKNLVGLVGYCDEGENLALIYEYMANGDLKEHMSGTRNHFILNWGTRLKIVVESAQGLEYLHNGCKPLMVHRDIKTTNILLNEQFDAKLADFGLSRSFPIEGETHVSTAVAGTPGYLDPEYYRTNWLTEKSDVYSFGVVLLEIITNQPVIDPRREKPHIAEWVGEVLTKGDIKNIMDPSLNGDYDSTSVWKAVELAMCCLNPSSARRPNMSQVVIELNECLTSENSRGGAIRDMDSEGSIEVSLTFGTEVTPLAR

SEQ ID NO: 81670 - protein, 391 aa, Silicibacter pomeroyi DSS-3
MVRSCAPHKRKAGRRARLAFGALASHGARENTEVPMRYVLILLLALFGYLLFWPIPVAPVAYHPPETPGFTGDFAENRVLDRAEFVTLPDGEIGPEDLAVMPDGTVYTTSLAGNLYRIDGAVPQLVDRLGGRPLGLKAGPDGALYIADSFRGILRWTAPGEVETVVDQIDGAPVIYANQLDLGRDGTIYFSNSTDRFDPRTLGGTKPTSVMTVWEQSDTGYVARRTPDGRVEKIATGFVYTNGVALSPDEDFLLINETGRARVHRLWLTGDKAGQSEVFLDNLPGYPDNIEAQGDGTYWLAFASPRVPAEALMPYPFLRKVVWRLGPKVRPAPIHRGMLIQFDGTGRILRTVQDPDGRLGITTGGKQVGARFYVMTLDSPGFARMDSADLR

SEQ ID NO: 81671 - protein, 395 aa, Silicibacter sp. TM1040
MKTTSITHRLADLGGAKWDLHTAARDRSDRGEDIVEMTIGEPDVALPEPLARAATRAIEAGRTQYSNGRGENGLRDALAESYSARRGRCFERDNVLCFPGTQTALYAVMQGVAETGDEVLVGDPLYATYEGVIRATGADMVPVPLKAEHGFRMQADDIAQRITERTRAILLNTPHNPTGAILRPAELEAIAEIALKHDLWLISDEVYEDLVFDGNSFTSPLTLEQIADRTIAVSSISKSHAAPGMRSGWAIGPRSFMDALLPVSETMLFGNQPFIADVTEEAVRAGSTVAEGMRQRFAKRAQYLADRLEAETVLRVHRPEAGMFALVDVSPLGMDCDAFAWALLENAGVAVMPGSSFGAHLQNWVRLALTVEDAAMTKAVDRISEFARSVAVAAQ

SEQ ID NO: 81672 - protein, 164 aa, Debaryomyces hansenii
MAVKGLGKVDQQYDGSKLRIGILHARWNKKIIDSLVEGAIKKLQEFNVKPENIVVESVPGSFELPYGTKLFFEKQEKLGEPLDAVIPIGVLIKGSTMHFEYICDSVTHQLMKLNFELNKPVIFGVLTCLTDEQAEARAGLIEGKMHNHGEDWGAAAVEMCTKFN

SEQ ID NO: 81673 - protein, 185 aa, Candidatus Protochlamydia amoebophila UWE25
MNGQIVNDFSLLHFRGQNVILFFYPLDFTFVCPTELHAFQEKLEEFEKRNAQIIGCSVDSCYSHLAWLNTPKSKGGIEGIDYPLISDLNKTIAHDYDVLIPHEGIAFRGLFLIDKEGIVRHQVINDLPLGRSVDEALRILDALLYFEKNGEVCPANWQHGQKAFKPSNEGLEEYFATVPVSRPKI

SEQ ID NO: 81674 - protein, 427 aa, Silicibacter sp. TM1040
MADGQPNQEQICVIGLGYVGLPLAVEFGRSRPVIGFDIDQSRIDELRLGDDRTREIDRDTLQSAQHLALTSDISEIAAASIYIVTVPTPIDATRRPDLRPLLSATRTVAQVLKPGDTVIYESTVYPGATEEDCVPLLEEISGLVFNADFGVGYSPERINPGDKTRRLPDIVKVTSGSSPETAAKVDRLYASIVRAGTYPAPSIRVAEAAKVIENSQRDINIALINELAKIFNRMEIDTEAVLKAAGTKWNFLNFRPGLVGGHCIGVDPYYLTHKAQEVGYHPEILLSGRRLNDGMGAYVAQQMIKAMLRRRVQVVDSRILVMGLTFKENCPDLRNTRVVDVIEALRDFGVTVDVFDPHADPEEAYAEYGLRLIQHPETECYDGTILAVAHQEFKDMGAEVLRSFGKADALLYDLKYVLPAEDADLRL

SEQ ID NO: 81675 - protein, 689 aa, Ustilago maydis 521
MATVVPRAKKQRTLPDQLIGLTPSSLQGVDPISVSSSMLAHQHPIPPSHQQQQPYAYTNTHNPPASSSTMSAASGSRPANPAPGFQRVNEVIGGKVQEVFVIDDDTPPPANALSVQSARGPHLVNNYAHVNGHAAAGAPYSSSLHGYASGSAADPRYDANVHLSKGKRKAHDNGTTERLSAAHLNMLPHDADLIAPAPRSGLHGVTAEAPLPKRRKRSHPVKPDHMLSAGGTYDTSEAATAAAAHLVASGAPGMVPAKRHAPELVQARVPPNYRGGYPAGTGVLDYAARYDPAAASAAFAHTHPPGYEGSASTRDSYASSASYVAAAAANNGPIDDDQGHFIVNEGDYVTSRYKILRLLGQGTFGKVVECYDKRLRKYVAIKIIRAVQKYRDASQIEIRVLRTLRENDPGNDNRCIHLLETFNFKNHVCIVSELLGKSVFDFLKENKFQPFPSLHIWQFAKQLMQSVAFLHRLNLVHTDLKPENILLVSSEHTVVATSRRQNAKRKHVLHNTEIRLIDFGSATFNDEFHSSVVSTRHYRAPEIILSMGWSFPCDVWSIGCILVEFFTGDALFQTHDNLEHLAMMEAVLGKMPDDYRRKAETYKPEYFKHGALKYPLAETSKDSKKYVRQMKKLQDLIAPATSQSQYSKHNMRFLDLLRKLLEFDAGKRIKVSEALKHPYFMLEEKDFPP

SEQ ID NO: 81676 - protein, 225 aa, Arabidopsis thaliana
MVSPKIAPSMLSSDFANLAAEANRMIDLGANWLHMDIMDGHFVPNLTIGAPVIESLRKHTNAYLDCHLMVTNPMDYVAQMAKAGASGFTFHVEVAQDNWQQLVEKIKSTGMRPGVALKPGTPVEQVYPLVEGTTPVEMVLVMTVEPGFGGQKFMPDMMDKVRALRQKYPTLDIQVDGGLGPSTIDTAAAAGANCIVAGSSVFGAPEPGDVISLLRTSVEKAQPTT

SEQ ID NO: 81677 - protein, 338 aa, Haemophilus influenzae 86-028NP
MAILVTGGAGYIGSHTVVELLNAGKEVVVLDNLCNSSPKSLERVKQITGKEAKFYEGDILDRALLQKIFAENEINSVIHFAGLKAVGESVQKPTEYYMNNVAGTLVLIQEMKKAGVWNFVFSSSATVYGDPKIIPITEDCEVGGTTNPYGTSKYMVEQILCDTAKAEPKFSMTILRYFNPVGAHESGLIGEDPNGIPNNLLPYISQVAIGKLAQLSVFGSDYDTHDGTGVRDYIHVVDLAVGHLKALQRHENDAGLHIYNLGTGHGYSVLDMVKAFEKANNITIAYKLVERRAGDIATCYSDPSLAAKELGWVAERGLEKMMQDTWNWQKNNPKGYRD

SEQ ID NO: 81678 - protein, 365 aa, Thermoplasma acidophilum DSM 1728
MNLYEYMGKDIFRQYGIPVPNGYVVSSVDEVRKLTNPVAVKSQILLGGRGKAGGIKFAKTDQELKDAVKALLGAKVRNLTVTKVLIEDMLNIKHEYYVSITLNRSARAPTVIASAMGGVEIETVPDEKIFKRIIDPSLGYSDFIGREASTFMGLSPDLSKQFLDLLKKLYNVYKGEDAELVEINPLVETNDGKLIAADAKVVIDSDAMFRHREFNIQDPEKTPLELKAEGKGYAFVELDGDIGVIANGAGLTMATLDALLLHKGKPRNFLDLGGTDNVDIVVNAFDLVLEAKPKAILVNIFGGVTKCDTVAQGIVDAKKKFDIKIPIVVRLSGIHEEEGRQILKENGIEAFSEMMPAIERVTKVF

SEQ ID NO: 81679 - protein, 275 aa, Staphylococcus aureus subsp. aureus COL
MALYGFAQGLIQEAGIRIKQLMEQNLTIETKSNPNDLVTNVDKATEDFIFDTILETYPNHQVLGEEGHGHDIDTSKGTVWIVDPIDGTLNFVHQQENFAISIGIYIDGKPYAGFVYDVMADVLYHAKVGEGAYRGSQPLKPLNDSNLRQSIIGINPNWLTKPILGEIFKEIVNDSRSARAYGSAALEIVSVATGNLEAYMTPRLQPWDFAGGLVILYEVNGQASNLLGEPLTISGPNSILVGNRGLHQEISNDYLEPHHDALIQLHEQRFKRKSK

SEQ ID NO: 81680 - protein, 183 aa, Escherichia coli O157:H7 EDL933
MTATAQQLEYLKNSIKSIQDYPKPGILFRDVTSLLEDPKAYALSIDLLVERYKNAGINKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 81681 - protein, 643 aa, Escherichia coli O157:H7 EDL933
MSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPEHVKFLLATTDPQKLPVTILSRCLQFHLKALDVEQIRHQLEHILNEEHIAHEPRALQLLARAAEGSLRDALSLTDQAIASGDGQVSTQAVSAMLGTLDDDQALSLVEAMVEANGERVMALINEAAARGIEWEALLVEMLGLLHRIAMVQLSPAALGNDMAAIELRMRELARTIPPTDIQLYYQTLLIGRKELPYAPDRRMGVEMTLLRALAFHPRMPLPEPEVPRQSFAPVAPTAVMTPTQVPPQPQSAPQQAPTVPLPETTSQVLAARQQLQRVQGATKAKKSEPAAATRARPVNNAALERLASVTDRVQARPVPSALEKAPAKKEAYRWKATTPVMQQKEVVATPKALKKALEHEKTPELAAKLAAEAIERDAWAAQVSQLSLPKLVEQVALNAWKEESDNAVCLHLRSSQRHLNNRGAQQKLAEALSMLKGSTVELTIVEDDNPAVRTPLEWRQAIYEEKLAQARESIIADNNIQTLRRFFDAELDEDSIRPI

SEQ ID NO: 81682 - protein, 164 aa, Zea mays
  misc_feature (81)..(81): Xaa can be any naturally occurring amino acid
DVKIKKKGNISSINGGYAKDFAPAINEYIQRKKFPPDNSAPYGARYVGSMVADVPRPLVYGGIFLYPATKKNPFGKLRLLXECNPIAYVMEKAGGLAPTGNEDILDIVPPEIPQKAPVIMGSPEDVQEFLEIYNKDKAKSRPSLPLPQSRARESPVHSFCDELF

SEQ ID NO: 81683 - protein, 288 aa, Beta vulgaris
MTKDVEAVSEQQQPEFSTKDYHDPPPAPLIDMEELKKWSFYRAIIAEFVATLLFLYVTVLTVIGHFRSADLENGGENCTGVGILGIAWAFGGMIFILVYCTAGISGGHINPAVTFGLFLARKVSLIRALAYMVAQCLGAICGVGFVKAFQSAYYDRYGGGANQMAHGYNKGTGLGAEIIGTFVLVYTVFAATDPKRSARDSHVPVLAPLPIGFAVFMVHLATIPITGTGINPARSFGAAVIFNEEKSWNEHWIFWVGPFVGAAIAAFYHQYILRAGAIKALGSFRSSA

SEQ ID NO: 81684 - protein, 393 aa, Flavobacteria bacterium BBFL7
MKQDFFQYQAPTTPFAPALEVSHASGNYIYDIHGNEYLDCVAGVSALPLGHCHPAVTSAIKKQVDLYMHVMVYGEYAQEPAVQLCKKIAQHMPAPLQMTYLVNSGTEAMEAAIKLARRVTGRSELISMQKAYHGNTMGSLSLMDYEERKAPFRPLLPQVKHIKFNCQSQLNIITDKTAAVIIESIQGGAGFIVPHTSWLKALKEKCQQTGALLIIDEIQPGMGRTGSMFYFTQHDIIPDMVITGKGLAGGLPIGAITASSMHLNMFKEAPMLGHITTFGGNPVIASAALATMTELEKGDLINAVKMKELRFRESLINKHIKEIRGVGLMLAVILADEQHTAAIVDECRNRGVLFFLLLFEKKAIRITPPLTISQDEIDKACYILNEVISKFYN

SEQ ID NO: 81685 - protein, 281 aa, Beta vulgaris
MTKEVSEEAQVHQHGKDYVDPPPAPLFDMGELKLWSFWRAVIAEFIATLLFLYITVATVIGYKNETDPCATVGLLGIAWSFGGMIFILVYCTAGISGGHINPAVTFGLFLARKVSLLRAFFYMVGQCAGAICGVGLVKAFMSGAYVRLGGGANSVQPGYNKGTALGAEIIGTFVLVYTVFSATDPKRSARDSHVPILAPLPIGFAVFMVHLATIPITGTGINPARSFGAAVIFNDKKAWDDHWIFWVGPFVGALAAAAYHQYILRAAAIKALGSFRSNPTN

SEQ ID NO: 81686 - protein, 808 aa, Oryza sativa Japonica Group
MPLLRHVLLGIVLLFLHTLASSAATDTVSPSQALAGSNRLVSNNSKFALGFLKPGNESYNNHNSYLGIWFNKVPKLTLLWTANGDNPVVDPTSPELTISGDGNLAILDHATKSIIWSTRANITTNDTIAVLLNNGNLVLRSSSNSSKIFWQSFDYPTDTLFAGAKIGWDKVTGLNRRIVSRKNSIDQAPGMYSLEVGLNGDGHLLWNSTVPYKSSGDWNGRYFGLAPEMIGVALPNFTFVYNDQEAYFTYTLRDDTAIVHTGIDVFGRGFAGTWLEGSQDWLIHYRQPIVHCDVFAICGPFTICDDKKDPNNNPFCDCMKGFSVKSPKDWELDDRTGGCMRNTPLSCGSSKDRSDLTDKFYPMQSIRLPNNAENVQAATSGDQCSQVCLSNCSCTAYSYGEDGCSIWHDELYNVKQLLDAASDGNGVVLYVRLAAKELQISERKKSGTLIGVAIGASTGTLFLITLLLILWRIKGKWIIAHPLEKSEDSIGIIAFRHIDLRRATKNFSEKLGGGSFGSVFKGNLSDSTIAVKRLDGARQGEKQFRAEVNSIGIIQHINLVKLVGFCCEGDNRLLVYEYMPNCSLDVCLFKANDIVLDWTTRYQIAIGVARGLAYLHTSCRDCIIHCDIKPENILLDASYVPKIADFGMAKILGREFSRAMTTMRGTIGYLAPEWISGTVVTSKVDVYSYGMVLFEIISGRRNSSHENFRDGDYSFFFPMQAARKLLDGDVGSLVDASLEGSVNLVEVERACKIACWCIQDNEFDRPTMGEVVQSLEGLLELDMPPLPRLLNAITGGSHPVTPQYFYSL

SEQ ID NO: 81687 - protein, 755 aa, Lotus japonicus
MDYFLFIALTFLLTFHVHNAQGSELPTTTTESTETSSSKIYIIHVTGPEGKMLTESEDLESWYHSFLPPTLMSSEEQPRVIYSYKNVLRGFAASLTQEELSAVEKKNGFISAHPQRVLHRQTTHTPKFLGLQQDTGVWKESNFGKGVIIGVLDSGITPGHPSFSDVGIPPPPPKWKGRCDLNVTACNNKLIGARAFNLAAEAMNGKKAEAPIDEDGHGTHTASTAAGAFVNYAEVLGNAKGTAAGMAPHAHLAIYKVCFGEDCPESDILAALDAAVEDGVDVISISLGLSEPPPFFNDSTAIGAFAAMQKGIFVSCAAGNSGPFNSSIVNAAPWILTVGASTIDRRIVATAKLGNGQEFDGESVFQPSSFTPTLLPLAYAGKNGKEESAFCANGSLDDSAFRGKVVLCERGGGIARIAKGEEVKRAGGAAMILMNDETNAFSLSADVHALPATHVSYAAGIEIKAYINSTATPTATILFKGTVIGNSLAPAVASFSSRGPNLPSPGILKPDIIGPGVNILAAWPFPLSNSTDSKLTFNIESGTSMSCPHLSGIAALLKSSHPHWSPAAIKSAIMTSADTINLGNKLIVDETLQPTDLFATGSGHVNPSRANDPGLVYDIQPDDYIPYLCGLGYSETEVGIIAHRKIKCSASIPEGELNYPSFSVELGSSKTFTRTVTNVGEAHSSYDLIVAAPQGVDVKVQPYKLNFSEVNQKETYSVTFSRTGLGNKTQEYAQGFLKWVSTKHTVRSPISVKFI

SEQ ID NO: 81688 - protein, 286 aa, Beta vulgaris
MEGKDEDVRLGANKFSEKQGLGTVAQDRDYKEPPPAPLFEPGELTSWSFYRAGIAEFIATFLFLYISILTVMGYSRTANKCSTVGIQGIAWAFGGMIFALVYCTAGISGGHINPAVTLGLFLARKLSLTRAVFYMIMQCLGAICGAGVVKGFQPTPYMTAGGGANYVHHGYTKGDGLGAEIIGTFVLVYTVFSATDAKRSARDSHVPILAPLPIGLAVFLVHLATIPITGTGINPARSLGTAIIFNRHHNSWNDHWIFWVGPFIGAALAAVYHTVVIRAIPFKSKS

SEQ ID NO: 81689 - protein, 352 aa, Enterococcus avium
MSKTMKGVSKQAPGYDQMAFIDLSVPEATDDKVLIKVAYTGICGSDIHTFKGEYKNPTTPVVLGHEFSGQVVEVGANVPKVKVGDRVTSETTFYVCGECDYCKEKQYNLCPHRKGIGTQQNGSMANYVLAREESIHLLPDHLSYEGAAMSEPLACCVHAMYQKSHLELKDTIIIMGPGPIGLYLLQIAKEIGAFVIMTGITKDAHRLALAKKLGADVIVDTMKEDLAKVVNEITDGYGVDKVYDASGAVPAVNASLPLIRKQGQFIQVGLFANKMVDLDTESIIQREIEYIGSRSQNPYDWPIAIHLLAKGAINIDEMITKKYPLTEWREAFDKVMEGNEIKVMIESNPEEF

SEQ ID NO: 81690 - protein, 750 aa, Lotus japonicus
MTKVVQFSLLLALILVLSVSLASAASQNLEFTELEDEDQSNLSTYIVHVRKPQVIQSDDLHTFYYSLLPESTKTTNQRIVFTYRNVVNGFAVKLTPEEAKALQQNEEVVSARPEKILSLHTTHTPSFLGLQQGLGLWKGSNSGKGVIIGILDTGISPFHPSFSDEGMPSPPAKWNGICEFTGKRTCNNKIIGARNFVKTKNLTLPFDDVGHGTHTASTAAGRPVQGANVYGNANGTAVGMAPDAHIAMYKVCGLVGCSESAILAGMDTAVDDGVDVLSLSLGGPSGPFFEDPIALGAFGAIQKGIFVSCSAANSGPAYSSLSNEAPWILTVGASSIDRTIMATAKLGNGKEYVGQSVFQPKDFAPSLLPLVYAGANGNNNFSVFCAPESLNRSDVEGKVVLCEDGGFVPRVFKGKAVKDAGGAAMILMNSVLEDFNPIADVHVLPAVHISYEAGLALKEYINSTSTPTATILFEGTVIGNLLAPQVTSFSSRGPSKASPGILKPDIIGPGLNILAAWPVSLDNSTTPPFNIISGTSMSCPHLSGIAALLKNSHPDWSPAAIKSAIMTTASQVNLGGTPILDQRLVPADVFATGAGHVNPVKANDPGLVYDIEPNDYIPYLCGLNYTDREVGVILQQRVRCSEVNHIAEAELNYPSFSILLGNTTQLYTRTVANVGPANSTYTAEIGVPVGVGMSLSPAQLTFTEVGQKLTYSVSFIPFSEDRDNHTFAQGSLKWVSGKYSVRSPISFIFL

SEQ ID NO: 81691 - protein, 750 aa, Lotus japonicus
MEQTKYRMELVLLLGLISMLSFIPASIAAEEGQEHDNLTTYIVHVKKLEIEGPLQSTEELHTWHHSFLPETSNKDRMVFSYRNVASGFAVRLTPEEANALQEKEEVMSIRPERTLSLHTTHTPSFLGLRQGQGLWNDSNLGKGVIIGVIDTGIYPFHLSFNDEGMPPPPAKWKGHCEFTGGSVCNNKLIGARNLVKSAIQEPPYEDFFHGTHTAAEAAGRFVEGASVFGNARGTAAGMAPDAHLAIYKVCSSKVKDECPESAILAAMDIAIEDGVDVLSLSLGLGSLPFFEDPIAIGAFAATQKGIFVSCSAANSGPHYSSLSNEAPWILTVGASTIDRKISASAKLGNGAEYEGETLFQPKDFSSQLLPLVYAAAEKNNSSALCAPGSLRNINVKGKVVVCDLGGGIPFIAKGQEVLDAGGSAMILANIENFGFTTLANAHVLPAVHVSYAASLAIKAYINSTYTPTATVLFQGTIIGDSLAPSVAAFSSRGPSQQSPGILKPDIIGPGVNILAAWAVSVDNKIPAFDIISGTSMSCPHLSGIAALLKSAHPDWSPAAIKSAIMTTANTLNLRGLPILDQRLQPADIFATGAGHVNPVRANDPGLVYDIQPEDYVPYLCGLGYSDREVTIIVQRSVRCFNVKSIAQAELNYPSFSILLGSDSQFYTRTLTNVGPANSTYTVKIDVPLAMGISVSPSQITFTQVNQKVAYFVDFIPQIKENRGNHTFAQGAITWVSDKHVVRTPISVIFK

SEQ ID NO: 81692 - protein, 232 aa, Streptococcus mutans UA159
MTAQKMSAQEIIAFIGNAEKKTNVKVTFEGALAAALPENVVKLGNVLFGDWKDIEPLLANLTENKDYVVEQDGRNSAVPLLDKRNINARIEPGAIIRDQVTIEDNAVVMMGAIINIGAEIGEGTMIDMGAILGGRATVGKNSHIGAGAVLAGVIEPASADPVRIGDNVLVGANAVIIEGVQVGSGSVVAAGAIVTQDVPDNVVVAGVPARVIKEIDEKTQQKTALEDALRNL

SEQ ID NO: 81693 - protein, 206 aa, Brassica napus
MSNIDIEGILKELPNDGRIPKTKIVCTLGPASRTVPMIEKLLRAGMNVARFNFSHGSHEYHQGTLDNLRTAMQNTGILAAVMLDTKGPEIRTGFLKDGNPIQLKEGQEITITTDYETLGDESTISMSYKKLPLDVKPGNTILCADGSISLAVLSCDPESGTVRCRCENTAMLGERKNVNLPGVVVDLPTLTEKDVEDIMGRGVPNS

SEQ ID NO: 81694 - protein, 419 aa, Glycine max
MASHDSISASPTSASDSVFNHLVRAPEDPILGVTVAYNKDPSPVKLNLGVGAYRTEEGKPLVLNVVRRVEQQLINDVSRNKEYIPIVGLADFNKLSAKLIFGADSPAIQDNRVTTVQCLSGTGSLRVGGEFLAKHYHQRTIYLPTPTWGNHPKVFNLAGLSVKTYRYYAPATRGLDFQGLLEDLGSAPSGSIVLLHACAHNPTGVDPTLEQWEQIRQLIRSKALLPFFDSAYQGFASGSLDADAQPVRLFVADGGELLVAQSYAKNLGLYGERVGALSIVCKSADVASRVESQLKLVIRPMYSSPPIHGASIVAAILKDRNLFNDWTIELKAMADRIISMRQELFDALCSRGTPGDWSHIIKQIGMFTFTGLNAEQVSFMTKEFHIYMTSDGRISMAGLSSKTVPLLADAIHAAVTRVV

SEQ ID NO: 81695 - protein, 402 aa, Silicibacter pomeroyi DSS-3
MTGNISLAQGRGYLAIPGPSVMPDAVLRAMHRAAPNIYAGELVDMMPGLMADLRRVVRTAHHATIYICNGHGAWEAALSNVIAPGEVVLVPASGRFAHGWAEMAEGLGAECQVIDFGKSAPWDMDRIAEALKADTAHRIKAVLAVHVDTSSSIRNDIAGLRAVLDALGHPALLMADCIASLGCDVFEMDGWGVDVTVTASQKGLMVPPGVGFVFFNERAAAKRASMPRVSRYWDWVPRANPTDFYQYFDGTAPTHHLYGLRTALDMIHAEGIEHVWARHAVLARAIWAACSVWAEGGDLVLNVADPAHRSHAVTALRLDSGKGTALRQWTETNLGLTLGIGLGMAAPGDPAYDKFFRLGHMGHLNGQMVMGLLGGVEAGLRALDVPCGKGALEAAAEVLAAG

SEQ ID NO: 81696 - protein, 116 aa, Bordetella petrii
MPFQGSCHCGAVRFTVDADLPSSAISCNCSHCRRKGFLLSFFPADVFTLDAGADDLQSYRFNTHKIDHRFCRHCGTEPVAYGANPDGSPVRAVNLRCVPGIDLDALALQKYDGASH

SEQ ID NO: 81697 - protein, 258 aa, Streptococcus mutans UA159
MKRILSLVLVSFVLLVGCENIDRAIKGDKYVNHHIAKQKAKNKLKQLNKADFPQLSKKVAKNEAEVTIATSKGDITVKLFPKYAPLAVENFLTHAKNGYYNNLTFHRIISDFVIQGGDPKGDGSGGESIWKGKDRSKDSGKGFANETSKYLYHLRGALSMANAGPNTNASQFFIVQNKDNQSKQLTTTRYPQKIINGYKDGGTPKLDGNYTVFGQVIKGMKIVDKIAAIKTDQSGKPQEKVTIKAIKIIKDYKFDKKK

SEQ ID NO: 81698 - protein, 249 aa, Bacillus pumilus SAFR-032
MIVKHDHELEALKKVGRIVALAREEMKSQAKPGMSTKELDLIGKKILEEHGANSAPEKEYDFPGTTCISVNDEVAHGIPSEKTILQEGDLINIDISAELDGYYSDTGISFVLGTGDARLEALCQCAEDAFLEGLKHAKAGKRQNQIGRAVYNTAKEQGFTVIKNLTGHGIGKSLHEAPNHILNYYDPFDNALFKNGTVIAFEPFISTNAESIYQADDGWTFKTPDKSLVAQIEHTIVITKDEPIILTKL

SEQ ID NO: 81699 - protein, 528 aa, Candida albicans
MAIVETVIDGINYFLSLSVTQQISILLGVPFVYNLVWQYLYSLRKDRAPLVFYWIPWFGSAASYGQQPYEFFESCRQKYGDVFSFMLLGKIMTVYLGPKGHEFVFNAKLSDVSAEDAYKHLTTPVFGKGVIYDCPNSRLMEQKKFAKFALTTESFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRERGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKVSKGVSSPYLPFGGGRHRCIGEQFAYVQLGTILTTFVYNLRWTIDGYKVPDPDYSSMVVLPTEPAEIIWEKRETCMF

SEQ ID NO: 81700 - protein, 705 aa, Bordetella petrii
MAESAPHGAVASQRHDGILVLTIDHPPVNALSADVRRGLADAIQAAQSDAAIQAIVLVGAGRNFIAGADIREFGKPPQPPALPDVCNAIEASAKPVIAALHGAALGGGLEIALAAHYRVALPGARLGLPEVNLGLLPGAGGTQRTPRLAGAAAALDLMLSGRHAGTDEALSWGLIDRIGAGADAQAAGLDYARELLAQGAGPRRTRDAAGLADRPAAQAAIDAARAQVQSRQRGLFSPAKIVDAVQAALDQPFDEGLRTERALFLQCLDSPQRAALVHAFFAERETAKAPETRQARPRPLERLGVIGGGTMGAGIAVAMLDAGLPVVMVEQNDEALARGRARVEQVYDLLVKKGRLDAAGKAERMARYTGATRYEALADADLIVEAVFEDMDVKLAVFAELDRIAKPGAVLATNTSYLDINRIAAATSRPGDVLGLHFFSPANIMKLLEIVVGANSAPDTVATGFELARRLRKTPVRAGVCDGFIGNRILAVYRQAADLMLEDGASPYQIDDAVRAFGYPMGPYQVADLAGGDIGWATRKRRAATRDPRLRYVQIPDRLCERGWFGQKTGRGYYLYPDGARTGTPDPEVLAIIDAERQRAGVTPRQFTQEDILRRYLAAMVNEAANVLREGIALRPLDIDVVFLSGYGFPRFRGGPLHYADQVGLPRILADIREFAQEDPHFWQPSPLLVELADSGRGFDSLNRA

SEQ ID NO: 81701 - protein, 483 aa, Silicibacter pomeroyi DSS-3
MVSRVIPVNAFDLVLFGATGDLARRKILPGLFHRYEVGQMPEEARIIGSARTELSTEAFRADVRQAIEEFTPETPTRAAVLERFLLKLDYVAVDARGDAGWQALAAMLRPDVVRAFYLSVGPSLFAGIARQLDCHGMATPEARIVVEKPFGRDLETARALNAGLRACFEEHQIYRIDHYLGKETVQNLMALRFANSLFEPLWNATHIDHVQITVAESLGIEGREAYYDQSGAMRDMVQNHLVQLLCLTAMEPPSKFTPNAVRDEKVKVIEALDPVPPGDIARGQYRADKGGDGYLDHVGDAQSRTESFIALKVHVANWRWAGVPFYLRTGKRLRARVSEIVVQFRDPPHSIFPNVGPIHGNKLIIRLQPDEGITLRTTIKDPGPGGFRLAEVPLDMSFAEALGGDVRPQDAYERLVMDVIRGDQTLFMRGDEAEAAWAWVDPIIAEWEKNRDRPYPYDQGSSGPEEALMLLHRDGRRWRQIGG

SEQ ID NO: 81702 - protein, 480 aa, Oryza sativa Japonica Group
MVKICCIGAGYVGGPTMAVIALKCPAIEVVVVDISKPRIDAWNSEQLPIYEPGLDEVVKECRGRNLFFSTDVEKHVAEANIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGKKAVQALKEVYAHWVPEDRIITTNLWSAELSKLAANAFLAQRISSVNAISALCEATGANVAEVAYSVGKDSRIGPKFLNASVGFGGSCFQKDILNLVYICECNGLPEVANYWKQVIKINDYQKSRFVNRVVSSMFNTVSGKKIAVLGFAFKKDTGDTRETPAIDVCHGLLGDKAQISIYDPQVTEDQIQRDLAMSKFDWDHPMHLQPTSPTAFKQVSVVWDAYEATKGAHGVCILTEWDEFKTLDYQKIFDNMQKPAFVFDGRNVVDAEKLREIGFIVYSIGKPLDAWLKDMPAVA

SEQ ID NO: 81703 - protein, 589 aa, Glycine max
MGTTKLSLLLCVGVLLLGCCVGRFVVEKNSLKVTSPKSLKGTYECAIGNFGVPKYGGTLVGSVLYPKVNQKGCTNFSDVNFQSKPGGFPTFLLVDRGDCYFTLKAWNAQNGGAAAILVADDKAETLITMDTPEEGKANDDYVDKISIPSALISKSLGDSIKQALSDGEMVNINLDWRESLPHPDDRVEYELWTNSNDECGPKCDSLINFLKDFKGVAQQLEKRGFTQFTPRYITWFCPEAFLLSRQCKSQCINNGRYCAPDPEQDFSRGYDGKDVVVQNLRQACFYKVANESGKPWQWWDYVTDFAIRCPMKENKYSEECSDQVIKSLGVDLKKIKDCVGDPHADIENPVLKAEQDAQIGKGSRGDVTILPTLVINNRQYRGKLSRPAVLKAICSGFLETTEPSICLTSDLETNECLENNGGCWQDKSSNITACRDTFRGRVCECPIVQNVKFVGDGYTHCEASGSLSCQFNNGGCWKGVQGGRAYSACLDDYRKGCTCPPGFRGDGVQSCEDIDECKEKTACQCPGCKCKNTWGSYECKCKSGLFYSRENDTCFGEYSASVLNIWVIILVLVVAVAGGYAFYKYRIQV

SEQ ID NO: 81704 - protein, 166 aa, Aspergillus oryzae
MALKPGDSFPENVVFQYVPWTEEKGDITACGIPIPYNASKEWADKKVVLFSVPGAFTPTCSVNHVPGYIQNLPQLKEKGVQVVAVVASNDPFVMSAWGKANKVENNDILFLSDPDAKFSDSIGWANNGRTGRYAIVIDHGKVTYAQIETERGVVKVSGAEAVLAHL

SEQ ID NO: 81705 - protein, 412 aa, Silicibacter pomeroyi DSS-3
MPTLVMKFGGTSVANLDRIRRAAKRVGVEVAKGYDVIVIVSAMAGKTNELVGWVNETSPLFDAREYDAVVSSGENITAGLMALTLQEMDIPARSWQGWQVPLMTNSAHSQARIEEIPPHNINQKFAEGMKVAVIAGFQGVSPEGRITTLGRGGSDTTAVAFAAAFEADRCDIYTDVDGVYTTDPRICTKARKLEKISFEEMLELASLGAKVLQTRSVELAMRYKVKLRVLSSFEEQSDTAGTLVVDEEEIMESNVVSGVAYSRDEAKMTVVSVQDRPGVAATIFNALSEGGVNVDMIVQNVSEEGITDMTFSCPTDQVARAEKAMNAVKDAGELEFEDLLVDYDVCKVSVVGIGMRSQSGVAAKMFKILSDEGINIKVITTSEIKISVLIDRKYMELAVQALHDAFELDKAA

SEQ ID NO: 81706 - protein, 267 aa, Synechococcus sp. WH 5701
MQSSMRPAGGDGPGAGFQLIAAVAVALLILLTQTIFIVPAGTVAVVTTLGRVTGGQRSPGPNIKVPLIQATSFFDVRTQVRPEQFSTLTKDLQVIEATATVKYSIKPQEAGRIFETIATENQQIYPRIIQPSLLKALKSVFSQYELVTIATEWNSISELVQDMVAQELSKFDYVKVQGLDLTGLQIAEEYRSAIEQKQIADQRLLRAQTEVKIAEQEAKRYQILNSSLDDQVLFKLFLDKWDGQTSVVPALPGTVGGGTPVIVNGRR

SEQ ID NO: 81707 - protein, 177 aa, Triticum aestivum
  misc_feature (99)..(99): Xaa can be any naturally occurring amino acid
  misc_feature (131)..(131): Xaa can be any naturally occurring amino acid
  misc_feature (139)..(140): Xaa can be any naturally occurring amino acid
  misc_feature (146)..(146): Xaa can be any naturally occurring amino acid
MAPVDLTPKQPRKAYGGDGGAYYEWSPADLPMLGVASIGAAKLSLAAGGLALPSYSDSAKVAYVLQGTGTCGIVLPEATKEKVVAVKEGDALALPFGVXVTWWHNGPAAPTPLTVLFLGDTPRAQAGEITXQLTGATDXXGFQRVXSRAWDFGDLVSAAARISGLSRAGSRGRRGEV

SEQ ID NO: 81708 - protein, 471 aa, Trichodesmium erythraeum IMS101
MKIFFLSVVKILEDINMRVCVIGTGYVGLVTGVCLSYIGHHVICIDNNEEKVKLLKSGQSPIYEPGLSELMQSSTKTGLLEFTSDLKVGVEHGDILFIAVGTPPLPTGESDTRYVEAVAKGIGAHMIKGYKVIVNKSTVPIGSGDWVRRIVLDGVEEHKKEEGGTRTEIEVEFDVVSNPEFLREGSAIFDTFNPDRIVLGSNSQKALDMMQELYRPLVTRKYGDEQSLPPVPVVITDLSSAEMIKYAANSFLATKISFVNEIANICDRVGADVTQVAKGIGLDSRIGNKFLQAGLGWGGSCFPKDISALVHTADDYGCEAHLLKAAVEVNRRQRMIVVDKLQQYLKILKGKTIGLLGLTFKPDTDDMRDAPSLDLIQELNRLGAKVKAYDPIISQSGIRDGLTGVLVETDSERLADTCDALVLVTDWAQFQKLDYGKMVKSMEHNLFVDGRNFCDRKQLEAAGFQYVGIGH

SEQ ID NO: 81709 - protein, 228 aa, Staphylococcus aureus subsp. aureus Mu50
MKDVKALKLMTLNDVLSQINGDMTLGIGTGSTMELLLPQMAQLIKERGYNITGVCTSNKIAFLAKELGIKICEINDVDHIDLAIDGADEVDPSLNIIKGGGGALFREKVIDEMASRFVVVVDETKIVQYLGETFKLPVEVDKFNWYHILRKIESYADIKVERRVNEDVAFITDNGNYILDCKLPKGIDPYKFHEYLIHLTGVFETGYFLDMADQVIVGTQEGVKILEK

SEQ ID NO: 81710 - protein, 367 aa, Zea mays
  misc_feature (233)..(233): Xaa can be any naturally occurring amino acid
MAAAEGQWVLMATGRTPTNIAVIKYWGKRDEALILPINDSISVTLDPDHLSATTTVAVSPSFPSDRMWLNGKEISLLGGRFQSCLREIRKRARDFEDKEKGVKIKKEDWDKLHVHIASYNNFPTAAGLASSAAGLACFVFTLGKLMNAKEDYGELSSIARQGSGSACRSIYGGFVKWCMGEKDDGSDSIAVQLADETHWNDLVIIIAVVSSKQKGTSSTSGMRDSVETRPLLXYRAHGTTVVPGRVLKMEEAIKNRDFESFAKLTCADSNQFHAVCLDTSPPIFYMNDTSHRIISLGEKWNHSKGTPQVAYPFDAGPNAVLIAQNRKTAAHLLQKLLYYFPPQDNDLSSYLVGDKSILGVAGLPKGV

SEQ ID NO: 81711 - protein, 217 aa, Eustoma grandiflorum
MAPPVSVSEVQVESYLFPPTITPPASTKSFLLGGAGVRGLEIGGNFVKFTAIGIYLDETAIPWLAGKWKGKTAEELADSVDFFADIITGPFEKFTQVTLILPLTGQQYSGKVSENCTAQWKAAGVYTPADGKAIEKFLQVFEPQSFSPGDSILFMHSPESLTISFGKAGDIPETSNAVIENKKLSEAVIESVIGEKGVSPAAKKSLATRIAHVLNHF

SEQ ID NO: 81712 - protein, 267 aa, Coccidioides immitis RS
MSLFTIPIAMGGSFECTSPADRVYLLSFDSPPDNRQTTAFIDAFSLALDIIEEKYPIGVVVTTSKIPKFYSNGLDLEHAMGTEDFFAKVYWPFWKKLLTYPMPTVALINGHAYAGGLFVSLLHDYRFQNPTRGYLCLNEVHFGAWLPAPMASIVKQKVANPAAVRDLITAGRRFDAKEALSAGIIDATGGIEVALKFIEDRSLVKLGQTKVYASLKEEIYKETLKTLESHEENEKERLGRLQERDDMEKVRSARVGAWEKTHGGSKL

SEQ ID NO: 81713 - protein, 392 aa, Vibrio parahaemolyticus RIMD 2210633
MTDQPISLEEIRLRLNELDDQLLSLLSERRKLSIEVAKSKVQTSKPVRDAVREQQLLVKLISNGRDKYELDAQYITKLFHTIIEDSVLLQQGYLQNLVNPQQSRKPLARVAFLGAKGSYSHLASREYFSRKNTELIELNCEHFKEVTRTVESGHADYGVLPIENTSSGSINEVYDLLQHTTLYIVGELTQPIEHCLVATKDIRLEDIKTLYSHPQPHQQCSEFLSRMKGVKLESCASTADAMQKVQEMNRDDVAAIGNASSGKLYGLQAIQGNIANQTENHTRFIVVARKPVEVSTQIPAKTTLIMSTSQEAGSLVETLLVLQRYGINMTKLESRPIMGNPWEEMFYVDLEAHLGSTEMQQALQELTKITKHLKVLGCYPSENIKPTQVKLS

SEQ ID NO: 81714 - protein, 368 aa, Croton sublyratus
MSSVNLGSWVHTSSVISQATRSRSKSKPLSFSPVSIPLFYRNSKRSVSYVSAIVTKDEETIQEEQNKNSSSSLGFDFKSYMVQKASAINQALEAAVSLREPLKIHESMRYSLLAGGKRVRPALCLAACELVGGDESMAMPAACAVEMIHTMSLIHDDLPCMDNDDLRRGKPTNHIVFGENVAVLAGDALLAFAFEHIAVSTLNVSPVRIVRGVGELAKAIGAEGLVAGQVVDICSEGLSEVDLEKLEFIHIHKTAKLLEGAVVLGAIMGGGTDEEVEKLRKYARDIGLLFQVVDDILDVTKSSQELGKTAGKDLVADKVTYPKLMGIEKSREFAEKLNKEAQEQLAGFDPEKAAPLIALANYIAYRQN

SEQ ID NO: 81715 - protein, 535 aa, Rubrobacter xylanophilus DSM 9941
MSKLRSMVDPRSDAFRRNREDFERLVAELRERSAEARRGGSERARKRHTERGKLLVRDRIELLLDPGTAFLELSPLAAHGMYGGEVPAAGIVTGVGRVSGVECVIVANDATVKGGTYYPMTVKKHLRAQEIAEQNHLPCIYLVDSGGAYLPLQDEVFPDRDHFGRIFYNQARMSAKGIPQIAAVMGSCTAGGAYVPAMSDEVVIVKEQGTIFLGGPPLVKAATGEAVTAEELGGADVHTRLSGVADHFAENDEHAIALVRQIVSNLNREKRVPWTVEEPEDPLYDPEELYGVVSPDYRQGYDVREVIARVVDASYLHEFKPRYGETLVCGFARIMGHPVGILANNGILFSESALKGAHFIELCCSRGVPLVFLQNITGFMVGKKYENEGIAKHGAKLVTAVACASVPKFTVIIGGSFGAGNYGMCGRAYSPRFLWMWPNARISVMGGQQAANVLLTVQEDNLRREGREMSEEEREEFRRPILEKYEREGNPYYSTARLWDDGIIDPADTRMVLALGLSAAANAPLRETTFGVFRM

SEQ ID NO: 81716 - protein, 145 aa, Oryza sativa
  misc_feature (14)..(14): Xaa can be any naturally occurring amino acid
  misc_feature (47)..(47): Xaa can be any naturally occurring amino acid
  misc_feature (67)..(67): Xaa can be any naturally occurring amino acid
RQNPCGMWGHYHKXYELPEACAACGHRPSTSAGTQAAARAEQAAEPXARLGGPLGQPTGLILLGEMXNAAAASELLKTIRFVQILNTGPLCINVYRIRRANHCFEDDTTPQVDDAGDFVEQCEGDNARVVVHCMARKSGSAPFEI

SEQ ID NO: 81717 - protein, 351 aa, Scoparia dulcis
MSLVNPVSTWPNPTRSSVFRPKPAILNTTHLPISFLFAGKPISAVLTKEYSHQTSSTFDFKKYMLEKASSVNKALESAVSLKEPLKIHESMRYSLLAGGKRVRPMLCLAACELVGGHPSTAMPAACSIEMIHTMSLMHDDLPCMDNDHLRRGHPTNHIVFGEDVAVLAGDALLAYSFEYLATATEGVLPERIVRVIAELAKCIRSEGLLAGQVVDICSEGVSEIGLEHLEYIHLHKTAALLEGSVVLGAILGGGNDEEVERLRKFARCIGLLFQVVDDILDVTKTSVELGKTAGKDLVADKTTYPKLIGIEKSREFAEKLNREAQEQLVGFDSDKAAPLIALANYIAYREN

SEQ ID NO: 81718 - protein, 306 aa, Streptococcus mutans UA159
MPSKKVRKAVIPAAGLGTRFLPATKALAKEMLPIVDKPTIQFIVEEALKSGIEDILVVTGKSKRSIEDHFDSNFELEYNLEQKGKTDLLKLVNDTTAINLHFIRQSHPRGLGDAVLQAKAFVGNEPFVVMLGDDLMDITDDKAIPLTRQLMNDYEETHASTIAVMEVPHEDVSAYGVIAPQGEGVSGLYSVDTFVEKPAPKEAPSNLAIIGRYLLTPEIFTILETQEPGAGNEVQLTDAIDTLNKTQRVFAREFKGKRYDVGDKFGFMKTSIDYALKHPQVKEDLKAYIIELGKKLDQKSTQKNSD

SEQ ID NO: 81719 - protein, 408 aa, Oryza sativa Japonica Group
MSIQANPLIKTLALSPRRRMAPPAPATARRPMAAVRCSAAKRSYNVTLLPGDGIGPEVVAVAKDVLSLAGALEGVEFRFQEKLMGGAAVDAYGVPLPEETLAAAQASDAVLLGAIGGYKWDNNEKHLKPETGLLQIRAGLGVFANLRPAAVLPQLVDASTLKKEVAEGVDIMVVRELTGGIYFGQPRGFGKNDKGEDTGFNTEVYSASEIDRITRVAFEVARKRRGKLCSVDKANVLEASMLWRKRVTSLASEFPDIELSHMYVDNAAMQLIRNPKQFDTIVTNNIFGDILSDEASMLTGSIGMLPSASVGESGPGLFEPIHGSAPDIAGQDKANPLATILSAAMLLRYGLGEENAAKRVEAAVTETLNNGFRTGDIYSPGTTLVGCKRMGEEVLKTVESQSAVALNS

SEQ ID NO: 81720 - protein, 90 aa, Glycine max
MKLVFGTLLLCSLLLSFSFLEPVIAYEDSSYCSNKCADRCSSAGVKDRCVKYCGICCAECKCVPSGTYGNKHECPCYRDKLNKKGKPKCP

SEQ ID NO: 81721 - protein, 339 aa, Streptococcus mutans UA159
MIRQKIAVLGPGSWGTALSQVLNDNGHEVRIWGNIPEQLDEINEHHTNKRYFKDVVLDEKIKAYHDLEDALKDIDAVLFVVPTKVTRLVAKQVSQILDHKAVVMHASKGLEPGTHERLSVILEEEIPNHLRSDIVVVSGPSHAEETIVRDITLITAASKDLEAAKYVQKLFSNNYFRLYTNPDVIGVETAGALKNIIAVGAGALHGMGYGDNAKAAVITRGLAEITRLGVKLGADPLTYSGLSGVGDLIVTGTSIYSRNWRAGDALGRGEKLEDIERNMGMVIEGISTTKVAYELSRELNVYMPITCAIYQSIYEGKNIKEAITSMMSNEFRAENEWSK

SEQ ID NO: 81722 - protein, 251 aa, Methylobacillus flagellatus KT
MNDNQLLRYSRHILLPQISYEGQEQLVNSHALVIGAGGLGSPVALYLAAGGVGTLTICDFDEVDLTNLQRQIIHTTAAVGRNKAVSAAETIATLNPEVTVNPLQQRVDEASLRGLVQAADVVVDCTDNFTVRYAVNQVCVELRKPLVSGAAIGFEGQVTVFDMRHDDSPCYHCLFPDLGGDEGLRCAENGVFAPLVGMIGTTQAAETMKLLLGLGKSLQGRLLLLDTISMEWRTLKLSKDEACPVCNKPSI

SEQ ID NO: 81723 - protein, 328 aa, Arabidopsis thaliana
MESIFSDLQRLVHQKSKSNSSAEQSQTRAGYEKPKIPTQTEAEFQVSKPVKESEELDNRWGMKTESTVPEVATSQPSIAYRLHKRKQSTAAQVDKRQKKGKGKGVAASSTFEETRFVSREAEKRYAYFSHKNIIVEEGLSRKTDDKVREFIYDAGLIRTVTELKPFEEELVFEFWANLPTVKVDSTSVSVMQQMDMAGLLEDEVAQFLTDGKVKLLKRLLLSAFSLPGRELFKLCCTNWSPTSNNSYAQPDRAKLVYMIMHKMPFNFVRLAFDHILQLALKPETKFFLPFPNLVYQLTQIQHPVKITVNPPAPKASTIKKKVKKNSAA

SEQ ID NO: 81724 - protein, 452 aa, Chlamydomonas reinhardtii
MASIRMSDDALTVLTQSYNPVSFTTEGMRKNDGLFYKISEKDIRILKKLGQGASSIVHKGFFIRENKFVAVKKINVFERDTRHQMLNDLKALCDAPNNVPGLVSFYGAYHVPESGQISIVLEYVDGGSLADVQAKVGKIPENVLSKMTAKILRALAYLHREKHMVHRDIKPANILMTISGEPKITDFGISAFIDSTLAQCNTFLGTVTYMSPERINNQAYSFPADIWSLGLALVELATGRYPYDAGEGPLQLMIHVLQEDAPLPPAGEFSEEFRDFVRVSLQKDPHKRPMAEQLLTHPFITKYAADPVSLKAFMQCAFNPHDKLDEIAIVFAFNYYALLNAGVQRLRDLAPLYSPKSTMRYDGEMAVGRDAIIAKLQAVAQMHAGFRVVHEVVDVQCQPLGFDGSALVNVTGQLVSPAASNKPQPFMEVFVLSQIQAGEYYVANQCFRLLKQ

SEQ ID NO: 81725 - protein, 182 aa, Synechococcus sp. WH 7805
MVSPWRSWADRLTLFRAVLGAPVLLALAAEQLSTAWVLLLLGALSDWADGWMARKADGGSSWGARLDPLADKLLISAPLIWLASEQVLPLWSVWLLLARELLISGWRSASQSGAPASWLGKTKTTLQFLSLFLLIWPPSWGAGPVVLGLRQLGWSLYWPALGLALWSGLAYITPPKAGHRHH

SEQ ID NO: 81726 - protein, 107 aa, Glycine max
MAKRSVAANSSFESTSLASLDQKLAMAKRCSHEGAMAGAKAAVAATIATAIPTLASVRMLPWARANLNHTAQALIISTVAGAAYFIVADKTVLATARKNSFNRPSKA

SEQ ID NO: 81727 - protein, 536 aa, Bacillus cereus ATCC 14579
MKEFSIMIQGTISSWTEDTMSLLTVEKLGHTFGDRTLFKDVSMRLLAGEHVGLVGANGVGKSTFMNIITGQLIHDQGRVEWTPGTHYGYLDQHTVLTPGRTIRDVLADAFLPLFEKEKALNEVTEKMGTATPEELEELLEQMAEIQDALEAGGFYLLYMKIEEAARGLGIDAIGLDRDVSALSGGQRTKVLLAKLLLEQPEVLLLDEPTNYLDVEHIHWLTNYLKEYPHAFLLISHDTEFMNKCVDVIFHLEFTKMTRYTATYEKFLELAEINKNQHINAYEKQREFIKKQEDFIAKNKARYSTTGRAKSRQKQLDRMELIDRPETAIKPEFSFKESRASSRFVFEGENVEIGYTHPLLPKLSMTIERGEKIAIVGCNGVGKSTLLKTILGKIKPLSGKTSLGDFLEPAYFEQEVKADNITPIDDVWNTFPGLDQHQIRAMLAKCGLKNEHISRPLSQLSGGEQAKVRLCKLMGEESNWLLFDEPTNHLDVTAKAELKKAMKAYKGTILLVCHEPDFYEDWITKVWDVEEWSQNSK

SEQ ID NO: 81728 - protein, 321 aa, Bacillus cereus ATCC 14579
MAVNEKVELATFAGGCFWCMVSPFEEMEGIIKVVSGYTGGHKENPTYKEVCSETTGHYEAVQITFDANKMPYEELLNIYWRQIDPTDIGGQFHDRGQSYETVIFYHNEEQHKKAEASKEELEQSGRFSKPIATKILPAATFYPAEEYHQGYHKKNTFRYELYRKGSGRDAFIKQHWPKDNAHLKEKLNEMQYYVTQENGTEPPFRNEYWNHKEEGLYVDIVSGEPLFTSLDKFDSGCGWPSFTKPVMSASVKEKMDVSHNMTRTEVRSKEGDSHLGHVFPDGPGPNGLRYCINSAALRFIPKEELEKEGYSDFLILFGNKK

SEQ ID NO: 81729 - protein, 506 aa, Silicibacter sp. TM1040
MNEMTQVAGEYTSPFKARYDNFIGGKFVAPVKGQYFDNITPITGAKVCEVARSSAEDVELALDAAHAAKDSWGKTSPAERANTLLKIADRIEENLELIATAETWDNGKPIRETMAADIPLSVDHFRYFAGVLRAQEGSMSEIDHDTVAYHFHEPLGVVGQIIPWNFSVLMAAWKLAPALAAGNCIVLKPAEQTPAAIHVLIEVIADLLPAGVLNIVNGMGPEVGGPLAESDRIAKIAFTGSTETGRIIMKAATKNLIPVTLELGGKSPNIFFSDVMAQDDAFLDKAVEGFVLFAFNQGEVCTCPSRALIQEDIYEEFIERCIARVKAIKQGDPRDIETMVGAQASQEQQEKIMSYLTIGVEEGAEVLVGGDAARFNGDIANGFYVQPTILKGHNKMRVFQEEIFGPVVSVTTFKDEEEALAIANDTMYGLGAGVWTRDGTRAYRFGRNIEAGRVWVNNYHAYPAHAAFGGYKQSGIGRETHKMMLDHYQQTKNMLVSYNPNKLGFF

SEQ ID NO: 81730 - protein, 528 aa, Issatchenkia orientalis
MSVIKAIAADVQRYVLLAYSHFQTFSLLQQTLLVISIPFLYSALWQLLYSFRKDRVPMVHYWIPWVGSAVVYGMQPYEFFENCRKQHGDVFSFLLLGKVMTVYLGPKGHEFVLNAKLSDVSAEDAYTHLTTPVFGKGVIYDCPNWKLMEQKKFAKVALTKESFIRYVPLIKDEMLKYFNANFRGDSGKTDVLKSQSEMTLFTASRSLFGDALRNRLDASYAEMYSDLDKGFTPLNFVFSYLPLPNYWKRDAAHKNISNTYLDLINTKRAGGEIKNEDLVDALLKNSVYKDGTRMTDEELAHLMIGVLMGGQHTSSATSAWFLLHLGEKPQLQEEIYREIQSVLGENFERELTYDDLQKLDLVNATIKETLRLHMPLHSIFRKVTRDLPVPNTSYIVPKGHYVLISPGYTMLSERYFPNASEFQPHRWDEIKSIDGGISLPAEGENAKETVDYGFGKISKGVASPYLPFGGGRHRCIGEPFAYTQLGTLLVHYIQNFKWTAKVPPIDYTSMVTLPTQPAEIKWEGRQKN

SEQ ID NO: 81731 - protein, 695 aa, Methanosarcina mazei Go1
MEDYLLANVDVILGFAVVILTIFYRFEFPPILGFLVTGMLIGPYGLGILSGGEIDMTSELGVVFLLFTIGVDLSLNDLWKMKKAIMGGGVLQILFTTTLAFIICTWIGFSSSTSIFIGLLISLSSTAIVLKVFQDKNEVDTPHGKTSLAILIFQDLAIVPLILITPILAGSSISFDGAFSNIFFKGSLIIFVFILSSRFLVPWIFYCVGRTGSKQLFLVSVVFICLSAAVFTSSIGLSLALGAFLAGIVISGSQYSHQAMGNILPLKDMFMSFFFVSIGMLLNISYLLDHLPLLALAAVALIIIKSIAGMLITIILGYPLRTTIITGLALSQVGEFSFVLSKLGLEYSLLSKETYQAFLAVSIITMGVTPFLINASYRPAEFFVKKASDSVYGMKLVRGFCSGSFEWKECVEPEIKDHLIMVGFGFSGKTISKAAKAAGIPYIILETNPDIVKQEKTKGERIQYGDATFGAVQEHAGIRNARVLITGISDSVATRKIVEKAKELNPNIYVIAKVRNLQEMKHLHHLGADEIIPEEYETSVEIFVRLLEKYLVPRENIEKMINDLRANGYRRLRKLSVDQDTDNEFSIKDELPGVEIQVLKVGKGSGFDGKTLAEMEFRKKHGVTVLSVRRGSEMIHTPEGDFLLKAKDACVLLGKPESLLNVRKLFESITGEVRPSFQSGSKIELIPKPDSFPHN

SEQ ID NO: 81732 - protein, 302 aa, Pseudomonas aeruginosa PAO1
MQQLLNEILDEVRPLIGRGKVADYIPALAGVEPNQLGIAVYSRDGELFHAGDALRPFSIQSISKVFSLVQAIQHSGEDIWQRLGHEPSGQPFNSLVQLEFERGKPRNPFINAGALVICDINQSRFAAPAQSMRDFVRRLCGNPEVVSDSVVARSEYQHRSRNAAAAYLMKSFGNFHNDVEAVLFSYFHHCALRMSCVDLARAFCFLADKGFCKHSGEQVLNERQTKQVNAIMATSGLYDEAGNFAYRVGLPGKSGVGGGIIAVVPGRFTVCVWSPELNAAGNSLAGIAALEKLSERIGWSIF

SEQ ID NO: 81733 - protein, 318 aa, Thermoplasma acidophilum DSM 1728
MIEIWTEKYRPKSLSEIYGEDENIQKLKSFVEKKEIPHLLFAGSVGTGKTSTAIALAIELFGDSWKENMVEMNASNENGIDVIRNKIKDIARIKPSNPLGFKILFLDEADQLTAEAQAALRRTMEIYSETTRFIFSCNYSSKIIPPIQSRTVVMRFRPVPDEYISRKLQEIAKNEGFQIDEESMHALVEVSAGDMRKAINVLQAVYTSGEISPKKIYEIIGYASPEKIQKMISRAINGLFDEAREIVDGMLIYDGLSGIDIVRSLHSYVRSSMISPKQKIEIIKALADAEFRIVEGSNDRIQLDALIAKLAEIGSRTD

SEQ ID NO: 81734 - protein, 199 aa, Magnetospirillum magnetotacticum MS-1
MVLCYPGLHALMFHRLSNWCWNRGMRVLGRFISHVGKILTGIEIHPAAQLGPRFFIDHGTGVVIGETAVIGADVTLYHGVTLGGTSLHKGKRHPTLEDGVIVGSGAQVLGPITVGKGARIGANAVVLTDVPPGVTMVGIPARMVMRRQDADFCAYDLPVEDLPDPVARAIDSVRSQVSTLMERIKELETELHAILLSLA

SEQ ID NO: 81735 - protein, 242 aa, Triticum aestivum
  misc_feature (230)..(230): Xaa can be any naturally occurring amino acid
MSTTNSGQESEKVNTNIVTLTRFLTEEQAKHPEATGDFTLLCHALQFSFKSIAYYIRRATLVNLTGLAGSSNITGDDQKKLDVISNDLFIEAMRSSGKCALLVSEEEDEIIYFKDASDARYAVACDPIDGSSNLDAGVSVGTIFAIHKLPEGSKGCKEDILKPGTELLAAGFTMYGASAQLVITMRGGTVNGFTLDNGVGEFILSHPNMRLPKSRDIYSCNEGNSLYWGXQTINYFNSLKQA

SEQ ID NO: 81736 - protein, 432 aa, Vibrio angustum S14
MSFLSQGFSQDLVKALTEIGYEKLTPVQQKAIPQARRGADILALAQTGTGKTAAFSLPIIQKLIEKPKSKSRFNVRALILAPTRELAEQIANNINEYAKYTDVNCTAIFGGKKMSTQEKRLEQGVDILVATPGRLIEHMELNNVSLANLEFLVFDEADRMLDMGFIGAIRVILDDIRTKPQTMLFSATSSAQMNSLASDILHKPQRITVTPENSTADTIAHVVYPVDEDRKREMLSELIGKKNWKQVLVFVNYKETANQLVKELKLDGIKAVLCHGDKAQSARRRALEEFKEGKARVMVATEVAARGLDIQNLPYVVNYDMPFLAEDYVHRIGRTGRAGQKGNAISFVSREEELTLVQIERLIGQRIHRVQLIGYEPKSRDALLERMHSKPAFSQREGRKNNPTQDQSAAERRARLRRAINIKATKITTLKK

SEQ ID NO: 81737 - protein, 249 aa, Escherichia coli
  misc_feature (10)..(10): Xaa can be any naturally occurring amino acid
AVTKLVLVRXGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 81738 - protein, 102 aa, Zea mays
KEGSPFRVKFTFFVSNNIVSGLRYTNTVWKTGLKVDRAKEMLGTFSPQLEPYTYVTPEDTTPSGMFARGSYFARTKFLDDDRKCYLEIKYTFDIRREWPWTS

SEQ ID NO: 81739 - protein, 466 aa, Flavobacteria bacterium BBFL7
MKLIKNICCIGAGYVGGPTMTMIAAKCPHIEVNVVDINAERIAAWNDINVDNIPIYEPGLSELVAQTRGKNLFFSTEVDKAIQAADMIFISVNTPTKTYGVGKGMAADLKYIELCARQIAAVATTDKIIVEKSTLPVRTAEALKRILDNTGNGVNFEILSNPEFLAEGTAVADLLSPDRVLIGGEETERGKLAQKALVDVYANWVPKDRILTTNVWSSELSKLTANAFLAQRVSSINAISELCEVTEADVSEVARAIGADSRIGSKFLKASVGFGGSCFQKDILNLVYIAQSYGLHEVADYWEQVIVMNDHQKRRFAKKIVKTLFNTVSGKKIVILGWAFKKDTNDTRESAAIHVVDYLLSEQAEIVIYDPKVSAERIFADLEYLNTRTDKENRDLATVVENPLSAFADSHAAVVLTEWDEFKSYDWKQIYADMLKPAFLFDGRMLLNHNQLVDIGFQTFTIGKGQ

SEQ ID NO: 81740 - protein, 523 aa, Ipomoea batatas
MAAAIGAPKLAPYTCAAERNDGSARRAARFKSLSFASSNLSGDKLASLVSRRCSRSGGKSSERRNAPIIVSPKAVSDSQNSQTCLDPDASRSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTILGLDDQRAKELPFIASMGIYVISKNVMLNLLREKFPGANDFGSEVIPGATSIGMRVQAYLFDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRRLLAAKGSIPIGIGRNSHIKRAIIDKNARIGDNVKIINSDDVQEAARETDGYFIKSGIVTVIKDALIPSGTVI

SEQ ID NO: 81741 - protein, 540 aa, Festuca arundinacea
MGLGLGDPPADYGPIAAVGLFVALMCVCIVVGHLLEENRWMNESTTALLIGLGTGTVILLASSGKHSHILVFSEDLFFIYLLPPIIFNAGFQVKKKQFFRNFMTITLFAVVGTLISFSIISLGALGLISRLNIGALELGDYLALGAIFSATDSVCTLQVLSQDETPFLYSLVFGEGVVNDATSVVLFNAIQNFDLGDLSTLKFFQFIGNFLYLFGASTLLGVATGLLSAYVIKKLYFGRHSTDREVAIMMLMAYLSYMLAELLDLSGILTVFFCGILMSHYTWHNVTESSRVTTKHAFATLSFISETFLFLYVGMDALDIEKWKIVSETYSPMKSIALSSVILALVLVARAAFVFPLSYLSNLTKKTPGEKISIRQQAIIWWSGLMRGAVSIALTYNKFAKSGHTQLPSNAIMITSTIIIVLFSTIVFGLLTKPLIRLLIPTRHLTREVSALSEPSSPKSSLEQVSADGPEADLENAVTIRRPPSLRMLLASPTRSVHHYWRKFDNAFMRPVFGGRGFVPFVPGSPTESSVPLLAPVSEN

SEQ ID NO: 81742 - protein, 425 aa, Flavobacteria bacterium BBFL7
MNKKITVIGLGYVGLPLARLFATKYNVVGFDINKPRVEELNTGVDGTLEVENDVLTAVLKTSQNDGNGLFCTTESDDIADSNVYIVTVPTPVDKNNRPILTPLYKASETVGKVLKKGDIVVYESTVYPGATEEECVPVLEKISGLTFNKDFYVGYSPERINPGDKKHTVEKILKVTSGSTPEIGKVVDQLYNDVITAGTHLAPTIKVAEAAKVIENSQRDINIAFVNELAKIFNRLEINTSDVLAAASTKWNFLPFSPGLVGGHCIGVDPYYLAQKAQEVGYHPEIILAGRRMNDGMGSYVAGEVVKLMLSKDITVKNSNLLMLGITFKENCPDVRNTKVIDVVSNLKEFGINVTIFDPLANPDEVEHEYGVRNLRELGSEKFDSIVLAVSHKEFLELDLETVSNDKVAIYDVKGILGDKADKRL

SEQ ID NO: 81743 - protein, 154 aa, Vibrio vulnificus YJ016
MHKKSSTLIRKREISDVTKESKVVLKSDQQWREQLSEQEYHVCREQGTEPPFSGKLLHNKDSGEYACTCCYAPLFSSVNKYDSGCGWPSFDAPINETAVLYLDDFSHGMKRVEIRCARCDSHLGHVFPDGPKTTGERFCVNSVSLIFNKIETNE

SEQ ID NO: 81744 - protein, 324 aa, Flavobacteria bacterium BBFL7
MTKNTKILITGAAGFIGSNLSEYFVGAGYDVIGLDNLSTGHLSNISHLQEKDNFHFVEGDIRDVETCSSVVIGCDYVLHQAALGSVPRSIKDPITSNDVNVGGFLNMLVASKEAGVKKMVYAASSSTYGDSKALPKVEEHIGKPLSPYAITKYVNELYADVFYKTYGLNTIGLRYFNVFGRKQDPNGAYAAVIPLFTKQLMNKQSPTINGDGTYSRDFTYIDNVIQANEKAMLTDHPEAVNTVFNVAYGDRTDLNLLVDLLKKSLSKYDSEILNVDTIYGPLRAGDVPHSLASIYKAKRLLNYNPQFDLKAGLDEAVDWYWANL

SEQ ID NO: 81745 - protein, 517 aa, Ipomoea batatas
MEFCATLKSSAHLPRETEFFGGRIRGSLNNNVLLSQSRKSLRLDGNKRKIKPGVAFSVLTRENGTETLTVEAPILERRRANPKNVAAIILGGGAGTHLFPLTNRAATPAVPLGGCYRLIDIPMSNCINSGVNKIFVLTQFNSASLNRHISRTYFGNGVSFGDGFVEVLAATQTQGETGMKWFQGTADAVRQFTWVFEDAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADNYETESEIASLLADGKVPIGVGENTKIRNAIIDKNVRIGKDVVITNKDGVQESDRPDEGFYIRSGITIIMEKATIRDGTVI

SEQ ID NO: 81746 - protein, 144 aa, Arabidopsis thaliana
  misc_feature (102)..(102): Xaa can be any naturally occurring amino acid
  misc_feature (114)..(114): Xaa can be any naturally occurring amino acid
MASSMLSSATMAASPAQATMVAPFHGLKPSAAFPATRKVNNDITSITRNGGSVHWMHVWPPIAKKKSGTLSYLHDLTDSELPKEDDYLIRNPRIPCAEFELXIPHSCPVSTVPXPDTMMYGTGQRGSFPCSGAPTSAQVLKRAE

SEQ ID NO: 81747 - protein, 450 aa, Streptococcus pyogenes MGAS8232
MVIPYDYIVIGGGSAGIASANRAAMHGAKVLLAEGKEIGGTCVNLGCVPKKVMWYGAQVADILGTYAKDYGFDFKEKAFDFKQLKANRQAYIDRIHASYERSFEQNGVDRIYDYAVFKDAHTVEIAGQLYTAPHILIATGGHPVFPDIEGAQYGISSDGFFALDEVPKRTAVVGAGYIAVELAGVLHALGSKTDLFIRHDRPLRSFDKAIVDVLVEEMTVGGPCLHPHSEVAKVVKNTDESLTLYLKDGQEVEVDQLIWAIGRKPNLEGFGLDKTGVTLNDKGYIETDAYENTSVKGIYAVGDVNGKLALTPVAVAAGRRLSERLFNNKTDEKLDYQNVATVIFSHPVIGSVGLSEEAAVKQYGQEAVKTYQSRFTSMFTAITNHRQPCLMKLVTVGDTEKIVGLHGIGYGVDEMIQGFAVAIKMGATKADFDNTVAIHPTGSEEFVTMR

SEQ ID NO: 81748 - protein, 180 aa, Synechococcus sp. WH 7805
MSSSGPSSSGEVPTVLVKDSEGRDLLCFLEQLIPLDGQDFALLTPVDTPVCLFKLRDGEDPQLIDSIASSEPILSVADVVLQEHDLTLVRSAVTLTVNGELDEPDPEDNEDEEGDDDSETYELLVSFLVEDQEYGLYIPLDPFFVVARMDDGCAVLVEGEDFDRIQPRIEAELDERDLPE

SEQ ID NO: 81749 - protein, 284 aa, Oryza sativa Indica Group
MEAAAAFSPPRVSPDARAMFATLPASPSPHLTHSHSHSTHALSPASQHPTTAGGGGHQAAVVPFLSVTACHQPPPDLASFLYKYRIVYLGMCLLPSVTELMLAEFLYLQYDDAEKPIYLYINSTGTTKNGEKLGYETEAFAIYDAMRYVKVPIFTLCVGNAWGEAALLLAAGAKVSVVFASKKYEDNDLILLTFNVQPIGRFQGQATDVDIARKEIRNVKIEMIKLLSRHIGKSVEEIAQDIKRPKYFSPSEAVDYGIIDKVLYNEKSQEDGGVVSELKRSNLI

SEQ ID NO: 81750 - protein, 296 aa, Chlamydomonas reinhardtii
MAHDESGTVAATGMRIKNLDTGEEYDLDAFEGGGPSASSTAPLRSGAAQSSQGPEDPNSDPEAKDGPKKKRWGLKGTKKFKEWAKTTYSNVKERIEERQAAKSYLNMQAKVRMIQEVLGHEGVVWVLRFSSDSRLLASGGRDGVVRLWSVYWYPSASCCFHPTDPRRIVTGCADGKIRVWSVPDGTVLCTATVAQDLVTRAVFSLDGRRVVAGTLRGKVRHYDYTGSALDYVTQLDVKTLHRSGRKVTGLLQIYVITSADSRIRMYVGYTQARKFKGHRHSNTQIAASLSPSCQHL

SEQ ID NO: 81751 - protein, 396 aa, Actinobacillus porcitonsillarum
MFSHIQAAPADPILGLGEAFKAETRAGKINLGIGVYMNDEGKTTIVKAVKESERQLLETEMTKNYLTIDGVAAYNAQTQVLLFGENAEVITSGRAKTAQSLGGTGALRIAAEFIKRNTSAKNVWISAPTWPNHNAIMAAVGLNVKDYRYYDPKTNRLDWDNLIADLSQAEAGDVVLFHGCCHNPTGIDPTPEQWETLAALSAEKGWLPLFDFAYQGLGNGLEEDAYGLRAFAKSHKELLVASSYSKNFGLYNERVGAFTLVAENAEVANRAFTQVKSIIRVLYSNPSAHGASTVATVLANPTLKASWIEELTEMRNRIKEMRNQLVQLLKEKGATQDFSFINEQNGMFSFSGLTPEQVDRLREEFAIYAVRSGRINVAGITSSNIEALAEAIVKVL

SEQ ID NO: 81752 - protein, 357 aa, Synechococcus sp. WH 7805
MTHHRVVLLPGDGIGPEITAVTRQLLDVVSERHGFQLDFDEQLIGGAAIDATGEPLPSTTLEACRSADAVLMAAIGSPRFDSLPREKRPESGLLALRSGLKLFANLRPVKIVPALIEASSLKPDVIDGVDLMVVRELTGGIYFGQPKGRVEADGEERGFNTMTYSASEVDRIAKVAFELARERGGRLCSVDKANVLDVSQLWRDRVDAMAPSYGDVEVSHLYVDNAAMQLVRAPRQFDVLLTGNLFGDILSDEAAMLTGSIGMLPSASLGSDGPGLFEPVHGSAPDIAGEDKANPMAMVLSAAMMLRIGLKQKAAADALEQAVDRVLAAGFRTGDLMAEGCTQLGCEAMGEELRKVL

SEQ ID NO: 81753 - protein, 300 aa, Synechococcus sp. WH 7805
MSKRHPVVAVTGSSGAGTSTVKRAFEHIFARESITPAVVEGDSYHRFERMEMKKAMAEALSKGENFSHFGPEANLFDKLEELFKVYGETGGGQKRYYLHSGEEAAEHNARLGVDLNPGQFTPWEDIPGGTDLLFYEGLHGGVVGDSYDVAAQADLLVGVVPITNLEWIQKIHRDNAERGYSAEAIVDTILRSMPDYINHICPQFSRTDINFQRVPTVDTSNPFICRNIPTPDESFVIIHFRKGAREKWGIDFNYLLSMIHDSFMSSPTSIVVNGGKMGFAMELILTPIIHRMIEEKKKLG

SEQ ID NO: 81754 - protein, 354 aa, Bacillus pumilus SAFR-032
MNRLFLVIVAIGVPLSVIGSFLHFPQVVMFAVYCIAIIGLASFMGRATESLAIIAGPRIGGLLNATFGNAVELIISFFALKQGLTAIVLASLTGSVIGNLLLVAGLSFFVGGLKYKRQVFNVHDARHNSGLLMFAIIVAFVIPEVFSVEMAEEKQFVLSIGISIVMILLYVAALYFKLVSHRGVYVAKQESMDGEAETEEIPEWSGKFATLILLLATIAVAYISERLVHTFDTVGEQFGWSELFIGVIIVAIVGNAAEHASAVIMAYKNKMDVAVEIAFGSTLQVAMMVAPILVISSLFFNTQMPLIFSLPELIAMASAVLLTVILSNDGDTNWFEGATLLAAYFIMAIGFFLL

SEQ ID NO: 81755 - protein, 399 aa, Colwellia psychrerythraea 34H
MIVSITLLILAVGVFAIILARFIRIPYTLLLVVLGFFLSLFTVAFGIDTGVRASNFQDLMLFILLPVLIFEAAFALNSKLLFKYLPNVLTLATLGLIISTLVIAVFLYFGIAHSGFPFIAALLTGVVISATDPVAVVGQLKALKAPDDLNVLIEGESLFNDATAIVLFSIILSIALGQSEPDLTSAIITFSKVFFGGIIVGSVFGYIAALLVKIIDTSVPHMVVITLFLAYGTFYIAEHLFHVSGIVAVMFAALLFKKSAQDQLKDVHTGLHNIWESLGFIANIFVFVLLGLVVSLNMFTQMWLAIILAIVGAFIARVIAVYCSVWLNQVIVGQPINRKYPPIMIWGGLRGAVTIALVLSLPTELPYWWTIQSIGFGIVLFTLIVQATTTPLLVKKLNI

SEQ ID NO: 81756 - protein, 338 aa, Bacillus cereus ATCC 14579
MAILVTGGAGYIGSHTCVELLNSGYEVIVVDNLSNSSVESINRVKEITGKQFKFYKEDVLNREALDAIFEENAIEAVIHFAGFKAVGESVAIPLTYYHNNITSTLVLCEVMQKHNVKKIIFSSSATVYGIPETSPITEEFPLSATNPYGQTKLMIEQIMRDVAFADAEWSIALLRYFNPFGAHESGRIGEDPNGIPNNLMPYVTQVAVGKLKELSVFGNDYPTKDGTGVRDYIHVVDLANGHVKALEKVLSRTGVDAYNLGTGMGYSVLEMVEAFEKVSGKKVPYKITERRPGDVAVCFADASKAKRELGWEATRGLEEMCADSWKWQSNNKNGYLKV

SEQ ID NO: 81757 - protein, 370 aa, Bordetella bronchiseptica RB50
MSEQNRLLLIGGDGVGAEVVHEAGRIAQWFAARRGLPLSIGQAAFGVEVLNRTGRIMTDDTLAQIRAADAVLFGAIGGPEYDRLPLEQVREEGLLRIRRELGLYANLRPVRYWPALAELCPFVPERVEKVDMMIVRELAGGIYYASPRGIDQTGDGRRVGTNTQRYDDLEIRRIARVAFELARARGGRVCSVDKSNVLESGLLWREEVQACRDAEYPDVELEHILVDNCALQLCLRPARFDVLLADNLFGDILSDAAGAVAGSLGMLPSASFGAEDGGRRRGFYEPVHGSAPDIAGQGIANPLGAILSLALALRWTFRQPAEADLLERAVERALAGGARTLDLLAGAAAPALSTRAMADAVLQALETLAA

SEQ ID NO: 81758 - protein, 374 aa, Kluyveromyces lactis NRRL Y-1140
MLRLTSARSIVSPLRKGAFGSIRTLATSVPETQKGVIFYENGGKLEYKDIPVPKPKPNEILINVKYSGVCHTDLHAWKGDWPLPTKLPLVGGHEGAGVVVAMGENVKGWNIGDFAGIKWLNGSCMSCEYCELSNESNCPDADLSGYTHDGSFQQYATADAVQAARIPKGTDLAEVAPILCAGVTVYKALKSANLKAGDWVAISGAAGGLGSLAVQYAKAMGYRVVGIDGGEEKGKLVKQLGGEAFVDFTKTKDMVAEIQEITNGGPHGVINVSVSEAAMNASTQFVRPTGTVVLVGLPAGAVIKSEVFSHVVKSINIKGSYVGNRADTREAINFFANGHVHSPIKVVGLSELPKVYELMEQGKILGRYVVDTSN

SEQ ID NO: 81759 - protein, 573 aa, Pseudomonas aeruginosa PAO1
MPLARWVPGLDSLLHYRRAWFRPDVQAGLSVAAIQIPTAIAYAQIAGFPPQVGLYACILPMLIYALIGSSRQLMVGPDAATAAMVAAAITPLAAGDPQRLVDLSMIIAIMVGLFSIVAGLARAGFIASFLSRPILVGYLNGIGLSLLVGQLGKLFGYEAATSGFVAGILALLENLLHIHWPTLILGSLSLLLMVLLPRRFPQLPGALCGVLLASLAAALLGLDRYGVELLGEVPAGLPQLSWPQTSLEELKSLLRDATGITVVSFCSAMLTARSFAARHGYSINANHEFVALGLANIGAGVSQGFAISGADSRTAVNDMVGGKTQLVGVVAALVIAATLLLLNKPLGWVPMPALGAVLLLAGWGLIDVQALKGFWKLSRFEFSLCLLTTVGVLSVGVLPGIFVAVSIAVLRLLYYTYRPSDAVLGWMHGIDGQVELAKYPQATTLPGLVIYRFDAPLLFFNADYFKQRVLAVVDGSERPNAVLLNAEAMTNLDISGLATLHEVQQILKAQGVHLSLARVTGQTLDLLQRSSMLGEIKPPLVFSSVRSGVSAYRYWLRQQERLAAQAAATSGNA

SEQ ID NO: 81760 - protein, 253 aa, Pseudomonas aeruginosa PAO1
MSKLLSGQVALVTGGAAGIGRATALAFAAAGVKVVVADLDSAGGEGTVEAIRQAGGEALFIRCDVTRDAEVKALVEGCAAAYGRLDYAFNNAGIEIEQGKLADGNEAEFDAIMAVNVKGVWLCMKHQIPLMLAQGGGAIVNTASVAGLGAAPKMSIYAASKHAVIGLTKSAAIEYAKKGIRVNAVCPAVIDTDMFRRAYEADPRKAEFAAAMHPLGRVGRVEEIAAAVLYLCCDNAGFTTGIALPVDGGATAI

SEQ ID NO: 81761 - protein, 1115 aa, Gibberella moniliformis
MSATALFTRRSVSTSNPELRPIPGPKPLPLLGNLFDFDFDNLTKSLGELGKIHGPIYSITFGASTEIMVTSREIAQELCDETRFCKLPGGALDVMKAVVGDGLFTAETSNPKWAIAHRIITPLFGAMRIRGMFDDMKDICEQMCLRWARFGPDEPLNVCDNMTKLTLDTIALCTIDYRFNSFYRENGAAHPFAEAVVDVMTESFDQSNLPDFVNNYVRFRAMAKFKRQAAELRRQTEELIAARRQNPVDRDDLLNAMLSAKDPKTGEGLSPESIVDNLLTFLIAGHETTSSLLSFCFYYLLENPHVLRRVQQEVDTVVGSDTITVDHLSSMPYLEAVLRETLRLRDPGPGFYVKPLKDEVVAGKYAVNKDQPLFIVFDSVHRDQSTYGADADEFRPERMLKDGFDKLPPCAWKPFGNGVRACVGRPFAMQQAILAVAMVLHKFDLVKDESYTLKYHVTMTVRPVGFTMKVRLRQGQRATDLAMGLHRGHSQEASAAASPSRASLKRLSSDVNGDDTDHKSQIAVLYASNSGSCEALAYRLAAEATERGFGIRAVDVVNNAIDRIPVGSPVILITASYNGEPADDAQEFVPWLKSLESGRLNGVKFAVFGNGHRDWANTLFAVPRLIDSELARCGAERVSLMGVSDTCDSSDPFSDFERWIDEKLFPELETPHGPGGVKNGDRAVPRQELQVSLGQPPRITMRKGYVRAIVTEARSLSSPGVPEKRHLELLLPKDFNYKAGDHVYILPRNSPRDVVRALSYFGLGEDTLITIRNTARKLSLGLPLDTPITATDLLGAYVELGRTASLKNLWTLVDAAGHGSRAALLSLTEPERFRAEVQDRHVSILDLLERFPDIDLSLSCFLPMLAQIRPRAYSFSSAPDWKPGHATLTYTVVDFATPATQGINGSSKSKAVGDGTAVVQRQGLASSYLSSLGPGTSLYVSLHRASPYFCLQKSTSLPVIMVGAGTGLAPFRAFLQERRMAAEGAKQRFGPALLFFGCRGPRLDSLYSVELEAYETIGLVQVRRAYSRDPSAQDAQGCKYVTDRLGKCRDEVARLWMDGAQVLVCGGKKMANDVLEVLGPMLLEIDQKRGETTAKTVVEWRARLDKSRYVEEVYV

SEQ ID NO: 81762 - protein, 297 aa, Pseudomonas aeruginosa PAO1
MTADPILTLFLPIALGIIMLGLGLSLTPADFLRVVRYPKPVLVGLVCQIVLLPLACFLIVQGFALEAALAVGMMLLAASPGGTTANLYSHLAHGDVALNITLTAVNSVIAILTMPLIVNLSLQYFMGDGQAIPLQFGKVVQVFVIVLGPVAIGMLVRNRLPAVADRLQKPVKILSALLLLVIILLALAKDWQTFVTYAPVVGLAALAFNLLSLAVGYWVPRLLRLPKAQAVAIGMEIGIHNGTLAIALALSPSLLNNSTMAIPPAIYGVLMFFTAAAFGWWVSRGHQATPAPVTAPD

SEQ ID NO: 81763 - protein, 179 aa, Glycine max
VSYVGPPPVPVVEDLVLISDRAYTKGQILEMEKLILNTLQFNMSVPTPYVFMKRFLKAADADKQLELASFFMLELCLVEYQMLDYRPSHLAAAAVYTAQCAINRCQHWTKVCESHSRYTSDQLLECSRMMVDFHQKAGTSKLTGVHRKYSTYKFGCVAKILPAQFLLESGGTPPPSGAN

SEQ ID NO: 81764 - protein, 505 aa, Rubrobacter xylanophilus DSM 9941
MQTQKRSFEVKNLIGGRWEERDGLDTEPVYDPATGEVIAETPLSTREDVDKAVGAASAAFPDWAATPVVERARVLFRFKMLLEERFEELAALVTLENGKDTKDAAGEVRRGIEVVEFACGMPTLLMGETVRDVARGIDNVSWRYPLGVVAAITPFNFPFMVPLWTAPIAIGAGNTYILKPSERTPLSAQRIGELLAEAGLPEGVFNIVNGAREVVDALCSHPEIKAVSFVGSQPVARHVYELGCAHGKRVQALAGAKNSMIAMPDAVLEKAVPNIISSAYGNAGERCLAGSVLVAVGTEEEQDRLVAAVKEAAARMRVGPGYEEGSELTPLIRDSHRERVRSYVDLAEEEGAEVVLDGREPPREEGFFFGPTILDKVTGEMRVAREEIFGPVLSVVRVGTLEEAIEFTNASPFGNACSIYTESGAAVRHWRERIEAGMLGVNIGVAAPMAFFPFNGIKNSFYGDLHATGKDGVRFFTENKVEIVRFYSDPDDVSAAASYPTEAGA

SEQ ID NO: 81765 - protein, 775 aa, Triticum aestivum
MVAAAILPELATQLVVPVAAAVGIAFAVLQWVLVSKVKVAPEPRGEGGSAAGGGAGAGAKDGASEYLIEEEEGLNDHNIVLKCAEIQTAISEGATSFLFTEYKYAGGFMTVFAVLIFVFLGSIEGFSTKSQPCHYSVGKTCKPALANAAFSTIAFVLGAVTSLVSGFLGMKIATYANARTTLEARKGVGKAFIVAFRSGAVMGFLLAASGLFVLYVAINLFGLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINREFTPMMYPLLISSVGIIACLITTLFATDFFEVKEVDQIEPALKKQLIISTAVMTVGIALVSWLGLPYTFTIFNFGAQKTVHSWQLFLCVAVGLWAGLVIGFITEYYTSNAYSPVQDVADSCRTGAATNVIFGLALGYKSVIIPIFAIAFSIFLSFSLPAMYGVAVAALGMLSTIATGLAIDAYGPISDNAGGIAEMAGMSHRIRERTDALDAAGNTTAAIGKGFAIGSAALVSLALFGAFVSRAGITTVDVLTPNVFIGLLVGAMLPYWFSAMTMKSVGSAALKMVEEVRRQFNTIPGLMEGTAKPDYATCVKISTDTSIKEMIPPGALVMLTPLIVGTFFGVETLSGVLAGALVSGVQIAISASNTGGAWDNAKKYIEAGASEHAKSLGPKGSDCHKAAVIGDTIGDPLKDTSGPSLNILIKLMAVESLVFAPFFATYGGILFKYL

SEQ ID NO: 81766 - protein, 522 aa, Lolium perenne
MVRGGGNGEVELSVGARGGGGGAGGLVEPPVPISLGRLVLAGMVAGGVQYGWALQLSLLTPYVQTLGLSHALTSFMWLCGPIAGLVVQPCVGLYSDKCTSRWGRRRPFIMIGCILICIAVVIVGFSADIGAALGDSKEECSLYHGPRWHAAIVYVLGFWLLDFSNNTVQGPARALMADLSGKYGPSAANSIFCSWMALGNILGYSSGSTDKWHKWFPFLRTKACCEACANLKGAFLVAVLFLCMCLVVTLIFAKEVPYKRIAPLPTKANGQVEVEPSGPLAVFQGFRNLPSGMPSVLLVTGLTWLSWFPFILYDTDWMGREIYHGDPKGTPAQMSAFQDGVRAGAFGLLLNSIILGFSSFLIEPMCKRLGPRVVWVSSNFLVCIAMAATAIISWWSTKEFHEYVQHAITASKDIKIVCMLLFAFLGVPLAILYSVPFAVTAQLAASKGGGQGLCTGVLNISIVIPQVIIALGAGPWDQLFGKGNIPAFAAASAFALIGGIVGIFLLPKISRRSFRAVSTGGH

SEQ ID NO: 81767 - protein, 515 aa, Ipomoea batatas
MDAYCATLKSTTHLPRESELWGKRMLKNRVLVKQFGKSLKLERNGRKIKPGVAFSVLTRETGKETLTVEAPRLERVRANPKNVAAIILGGGAGTQLFPLTNRAATPAVPVGGCYRMIDIPMSNCINSGINKIFVLTQFNSASLNRHIARTYFGNGVSFGDGFVEVLAATQTSGETGMKWFQGPADAVRKFTWVFEDAKNKDIENILILSGDQLYRMDYMDLVQNHLDRNSDITLSCAPVGDSRAVDFGLVKIDHRGKVVQFQEKPKGADLEAMQVDTTRLGLSPEDAKRNPYIASMGLYVFRRDLLLNLLRWIYPTANDFGSEIIPAVITEHNVQAYFFKDYWEDIGTIKTFYNANLALAEEFPKFEFYDPKTPFYTSPRFLPPTKIDNCKIKDAIISHGCFLRECIVEHSIVGERSRLDFGVELKDTLMMGADYYETESEIASLLADGKVPIGIGHNTKISNCIIDKNVRIGKDVIIANKDGVEEADRPEEGFYIRSGIPVIMEKAVIKDGTVI

SEQ ID NO: 81768 - protein, 258 aa, Agrobacterium tumefaciens str. C58
MTDARTTAEGGMETSYGFHKVDEGKKQGLVNEVFHKVAKRYDIMNDVMSAGLHRLWKDAMVSALSPRKDPSYKILDVAGGTGDVAFRIIEASNRLAHATVLDINGSMLAVGEERAAKKKLSDNLTFVEANAEELPFEANTFDAYTVAFGIRNVPRIDVALKEAYRVLKRGGRLLVLEFSEVDMPLLDRVYDAWSFNAIPQFGKMITGDAEPYQYLVESIRKFPNQEDFATMIRTAGFSRVTYTNYTGGIAALHSGWKL

SEQ ID NO: 81769 - protein, 518 aa, Ipomoea batatas
MDALCASMRAHPVPVSKGFGYGDSGLWGEKIRGCSRIKTERHEGMPKKVNLGVACSILTHDINQEHLSFETQHFEEHSQGDPRNVASIVLGGGAGTRLFPLTRSRAKPAVPIGGCYRLIDVPMSNCINSGIRKIFILTQFNSFSLNRHLARAYGIGNGVNFGDGFVEVLAATQTPGEAGKMWFQGTADAVRQFIWVFEDAKNKNIDNILILSGDHLYRMDYMDFVQRHIDTNADITVSCVPMDDSRASDYGLMKIDGSGRIVHFAEKPKGPALKTMQVDTSLLGLSENEAKKYPYIASMGVYVFRTEVLLNLLRSQYPSCNDFGSEIIPAAVKDHNVQAYLFSDYWEDIGTVKSFFDANLALTEQPPMFDFNDPKTPFYTSPRFLPPTKVDKCKIVDAIISHGCFLRECSVKHSIVGIRSRLDYGVELEDTMVMGADYYQTESEIASLLATGKVPIGIGTNTKIRNCIIDKNARIGKDVVIANKDGVDEADRADEGFYIRSGITIVLKNATIRDGTVI

SEQ ID NO: 81770 - protein, 525 aa, Ipomoea batatas
MAVTADGRIALLAARQLREGAAMTVSSCRLSVKFCNGEFMGKKIKLRKFQQRNGTKYNVVARPRVSMSLTTDVAGEAKLKDYGMEKTDPRTVVAIILGGGAGTRLFPLTKRRAKPAVPIGGAYRLIDVPMSNCINSGINKVYILTQFNSASLNRHLARAYNFGSGVTFGDGYVEVLAATQTPGEAGKRWFQGTADAVRQFHWLFEDPRSKDIEDVLILSGDHLYRMDYMDFVQSHRQSGADITISSLPIDDRRASDFGLMKIDDKGRVLFFSEKPKGDDLKAMAVDTSVLGLSPEEAKQKPYIASMGVYVFKKEILLNLLRWRFPTANDFGSEIIPASAREFYIQAYLFNDYWEDIGTIRSFFEANLALTEHPPRFSFYDATKPIYTSRRNLPPSAITNSKIVDSIISHGSFLSDCFVEHSVVGIRSRINSNVHLKDTVMLGADFYETGSEIASLLTEGGVPIGIGENSRIKECIIDKNARIGKNVVIANSEGIQEADRTSEGFYIRSGVTVIFKNSTIPDGLVI

SEQ ID NO: 81771 - protein, 619 aa, Candida tropicalis
MSEQNQGQPDQQHSGDHQHHHHHHHHHHHSQQPAQPIPIDPNVNPANRIGRYQIIKTLGEGSFGKVKLAQHVGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYAAPEVISGKLYAGPEVDVWSSGVILYVMLCGRLPFDDEFIPALFKKISNGVYTLPNYLSPGAKHLLTRMLVVNPLNRITIHEIMEDEWFKQDMPDYLLPPDLSKIKTSKIDIDEDVISALSVTMGYDRDEIISVIEKANREAAAGGATPTNQSKSTNEVLDAYLLMKENHTLVKDLKKSKSENIESFLSLSPPPSSSFPNPGSTSSAPGVQQSLTYQTLATVPDLSTLPNSTIAILPTSLPSIHRAYMMETKVNDPQQQIPAPQPTKKLKTRWHFGIRSRSYPLDVMGEIYRALKNLGAEWAKPTEEELWTIRVRWKYDSTPQLRVWQRTNLMKMQIQLFQLEPNNYLVDFKFDGWEQTSDESKNDASLDYKQQDLDEVGSFSAYPFLHLATRLIMELAVNSQSG

SEQ ID NO: 81772 - protein, 265 aa, Methylobacillus flagellatus KT
MRVVLHGAEGIAKARQAGQMAAQVLAMIKEYVVPGVTTEELDRICHEYIVHELKVVPANLGYSGFPKTICTSVNHVVCHGIPSEKQVLRDGDILNIDVAIIKDGWYGDTSRMYAVGTLLPEASRLVQAAYDAMRDGILQVKPGNTLGDVGHAIQKTANAQGFSVVREYCGHGVGQVYHDEPQVLNYGQPGKGLRLKPGMIFTVEPMVNAGKAGTRTLQDGWTVVTQDKGWSAQWEHMVVVTDEGFELLTEWPDGMGSYQEIAPGG

SEQ ID NO: 81773 - protein, 403 aa, uncultured marine bacterium 313
MKRLVVKFGGSSVGTIEKIKKVANIIKILSESNEIIVVVSAMSGVTDELKVKSDLISKNFDDKEQDVLLSSGEQISCSLLSGALIDLGVKARSWLGWQIPIITNDNHTSSQIIKIKTDEILNFISEKGVAVIAGFQGISKEIRITTLGRGGSDLSAVAFAKFFKADSCEIYTDVEGVLTTDPTIHEKAKKIDKISYEEILEMSSLGSKVLQSSAVQTAMIDNIPVHVRSTFSEKSGTKIIADSEIDYKKVVTGIAYSRGNAKVSIVGVEDKPGIAADIFEPIGKNNINIDMVIQNTSLDGKKANITFTIKREDLQKTLNLIEKNKQKLNYEKITHDDKLGKVSIIGAGMQAAPAVTYKMFRSLANEKINILAISTSEIKISVLIREDLTQKAVKALHKSFGLD

SEQ ID NO: 81774 - protein, 536 aa, Escherichia coli
MVSAPVDGAISGLSVQNGIAIGPVKWFTCERPEITQRTVDSPQEELSRIESAIDIVVCELADKAAGPEGDIFAAHKMMLEDPEINRQLQQRLAKGKQAEFAWLEVMQALAEQYCQAETLYLREREADIRDLTRQVLNQLCGVSEQHFITTAPCILLANDLLPSQITSLNKAHILGICLHNGGTTSHTAILARAMGIPAIVKAAITPQNVRDNDTVILDGETGRLWLQPDEVTRLDLLQRAEAWRQQRDRQLADAMLPAVTQGGRKISVLANIGDLQDIEAALSHGAEGVGLLRTEFLFHESATLPDEEEQFRVYCSVAQAFGDKPVTIRTLDIGGDKPLPSYPLPAEDNPFLGLRGIRLCLAHPQIFIPQLRALLRAGKEYPTLQIMLPMVSTLEEVNAVKTLIQTQAKLLGLTAENLPALGIMIEVPAAVMVAEKLASEVDFFSIGTNDLTQYIMAADRGNSTVAKLVDYRNDAVINAIAMVCQAGRNNEIPVSMCGEMAGDTQQTARLLTMGIDKLSASPSRLPALKAAIRASH

SEQ ID NO: 81775 - protein, 219 aa, Streptococcus mutans UA159
MLLNQIAPSILAADYANFESELKRIEETGVKYVHIDIMDGQFVPSISFGAGVVASMRKHSKLVFDCHLMVVNPERYVDDFSQAGADIMTVHVEATHHIHGALQKIKDAGMKAGIVINPGTPVADLESVLSLADQILIMTVNPGFGGQAFIPEMLEKVRTVAKLREEKGLSFDIEVDGGIDNETIKLAKQAGANIFVAGSYLFKENLAAQVETLKAALND

SEQ ID NO: 81776 - protein, 544 aa, Silicibacter pomeroyi DSS-3
MPRAFLASVANRLAIPDLRWMPDEPLTASRLRIELLSGLTVALALVPEAVAFAFVAGVHPLVGLYAAFLVGLITALIGGRPGMISGATGALAVVMVALVAQHGVEYLFATVVLMGLLQLVAGVMQWGKFIRLVPHPVMLGFVNGLAIVIFLAQMGQFKVPGSMENTGHGLGGGQWLSGGPLMLMLALVALTMVVIWIMPRVTRAIPAPLAGIAVVAALVIGAGLEVPRVGDMASIEGGLPQFHIPMVPLNWETLEIILPYSVILAAIGLIESLLTLNLVGDITGKRGGASQECIAQGAANVVTGFFGGMGGCAMIGQSMINVKSGGRTRVAGIAAALFLLVFILVGAPLIEQIPLAALVGVMFMVVIGTFAWNSLMILRKVPLTDAFVTVLVTVVTVMEDLAVAVVVGVIVSALAYAWNNAKRIHAVTRESHTAKGAKVYEIQGPLFFGSTDGFVELFEVEKDPDTVIVDFKESRVVDQSALQAIEAVALKYEDAGKQVMLRHLSRDCHQLLNKAGHLMVDSDDDPDYGLAVDYSVRTGILGGH

SEQ ID NO: 81777 - protein, 329 aa, Zea mays
  misc_feature (90)..(90): Xaa can be any naturally occurring amino acid
ASLAAAAAAAQASPTHPRPSLSPPILPQHAPPDAPPPFPPSSPRRPPAHLPRAALYRRTWAAWPSGPREDDDARGMPLRRQSGSESGGDXVERPWKLSDARLVLEDGSVWNAKSFGASGTQVGEVVFNTSLTGYQEILTDPSYAGQFVLMTNPHIGNTGVNSGDEESIKCFLGGLIIRNLSICTSNWRCTETLDEYLRKRNIMGIYDVDTRAITRRLREDGSLIGVLSTDQSLKDEELLEMAKNWKIVGVDLISDVTCDAPYEWVDKTGSGWEFNDNQSSETFHVVVYDFGVKHNILRRLASYGCKITVVPASWPASDVLKLKPDGVLF

SEQ ID NO: 81778 - protein, 159 aa, Bacillus cereus ATCC 14579
MNISIISIGKLKEKYLKQGIAEYLKRLSAYAKVEVIELPDEKAPENLSEAEMLIVKEKEGIRILDKISDDTHVIALAIEGKQKSSEEFAISLDRLATYGKSKVAFVIGGSLGLSSEVMKRSNESLSFSKMTLPHQLMRLVLLEQVYRAFRINRGEPYHK

SEQ ID NO: 81779 - protein, 622 aa, Picea sitchensis
MNDVPARWKGQCQEGAAFNSSLCNRKLIGARYFSKGYTAQFGPVDSIRYYDSARDFLGHGSHTSSTAAGNYVHNVDYFGYAKGTARGVVPRARVAMYKIGWSGGIVGSDVLAGMEHAISDGVDVMSVSLTVSSQRFHRDAIALGAFAAAEKGVFVSCSAGNSGPDMFTVANGAPWMLTVGASTIDRSFVAKVKLGNGKLIQGTSLFVERQVISGVPVIYGTGGNQSSLACTPDSLDPKTVAGKILLCINNNNSMQLDPSIQILEANRTGAAAVIIASEDSYLLVPRDYWMPAVLVTSDQGQLIANYVTSASRATAGIKFVITEVGSRPAPAVAYFSSRGPNPLSPGILKPDVIAPGKNIVAAWLPYGVVKYVGSVPLEADYAMDSGTSMSSPHAVGVAALVKAVHPDWSPAAIRSALMTTAYTLDNTGYLITDEAHPVFGHGATPLDFGAGHLNANKAADPGLVYDSGVEDYLDYLCALNYTNEEIRMVSRREYSCPGHTSIGDLNYPSFLANFTMSAENQVKTFKRILTNLADDNDNRSYVYRAIVKAPQGIAVQVEPESLVFSERKEKLGFSLIMEVDGPIASTSKCAGLRGCVKAGYLSWVDGRGHVVTSPLVATFDPL

SEQ ID NO: 81780 - protein, 364 aa, Candida glabrata CBS 138
MVKAVERRLVPQGVVTNFYNRVKEDGTIVQSLQRGGGSRRSRAVNYSEVDAFEDFEESDDERQGSNNRSASTEAVVDDKLPENVVLPDLEDIITGESDPSLNVLKFRKVRDTFFGGRIAIRYKLELDQNEVRSSSLAVPIIVPITLKLEDTADGISITDSLLWNINDTSVTPEQFSLVYCRDLGILGNNYIQQQIATLIRDQIENYRTLSGHLLQANENMRSYPDFHVHLNIACNLNSRYYEDNFQWNINDESLTPEKFATIVVKDLGLTRDFLPSISQVLHEQLLQIKKEWIKGEFNHELIHPDENNRMVRIEANQGELDRAWSPRVEVLSMDEIQKREVERERQLRRMKRDSDRLGRRGRRK

SEQ ID NO: 81781 - protein, 179 aa, Silicibacter pomeroyi DSS-3
MSRTKSVQDYIRTIVDFPHEGILFRDVTTLFADPRGFRIAIDQMLHPYAGERIDKVVGLEARGFILGGAIAHQLSVGFVPIRKKGKLPGTTISQDYKLEYGEAIVEIHDDAIQPGEKILLVDDLLATGGTAAAGIKLVERLGGEIVSCAFIIDLPDLGGRKVLESMGMDVHALCAFDGL

SEQ ID NO: 81782 - protein, 359 aa, Ustilago maydis 521
MSSFTAVSSSTRPFCLVKSSINIDETFLVPHIVRPGETISSSELVSRPGGKGANVSAAIALAGASVSFSGAVGKDAPWPLDELKARHVMIDGAEILDNTPTGRAFIQIAEDGENSIVLLKGANFATHSRSADPVKSWTSQITHLVLQNEIPLPTTIAFLQHAKSKKVEGHVTTIFNPSPMLTQSQVEQFPWTSIDVLVVNEGESIELLRVLQPDAAKSLESLPEGEDRSTRVLQALSSVEQLQETAWLVLTRGGEGVMANVILSESQTKRSFFNVAPFKPRQVKDTTGAGDTFAGNLVAALMGHNVDADRGLVKSARPTEAKFVEDALKWASKAASLACEKEGAMQSIPSAEEVKARSA

SEQ ID NO: 81783 - protein, 636 aa, Hyphomonas neptunium ATCC 15444
MKYALLTGAACALALAACAQTPEPAPQALEPAPVTAAPETTPAARENAAFPMTGQRPESGRPIATRSAVVAPNGAAATAHPLATQTALDVLKAGGTAVDAAIAANAMLGLVEPTGNGIGGDLYAIVWDPETEQLYGYNGSGRSAMDATLEDAQAKADQFKDGKSLPSYGAITVTVPGTVDGWFALHEKFGQRPMADNLAPAVKYAREGAPIPEMIAWYWSRGPLRFEPAFERGELEEFANAKKTYFDPTPVAGSLFKNPDLANTLETIGKKGRDEFYKGVMAKDMAAYFSRIGGKLDYDDFNAHTGDWVEPICVEYRSEVKVCELGPNTQGVAALQMLEMLERFDLKSMGFGSPDAVTAMVEAKRLAFADRALGYADPAFSGIDPSIFVAPGYNAKRAEAIDVTRAMPEVAPGTEITDAALRDGDTTYLTVTDKDGMMVSLIQSNYRGMGSGLVADGMGFMFQDRGELFSLDANHPNVFAPGKRPFHTIIPAFAFRKDLPGCQTAATAPDLACPYEPWLSFGLMGGATQPQGHVQIITNLIDFDMGLQEAGDAARWEHDGGCEPTNALGDDCDTGTGTVMLERGLAGIADELESRGYDVACCEANYGGYQAIMRDFRSGAWIAATEMRKDGNADGY

SEQ ID NO: 81784 - protein, 422 aa, Ustilago maydis 521
MGSISEQSSALAVWSAVPQAPEDAIFKLTSSYKSDTYDKKVNLGVGAYRDNNGKPYVLPSVKKAQADLIADESVDHEYLSITGLAEFTSAAAKLILGDDSPAIAEKRVASVQTISGTGANHLGAVFLQRFYQYQAYGVDRQIYISNPTWANHKAIFNTVGIKPIDYPYYDAKTIALDFDGFTNTLRQAKNQSVFLLHACAHNPTGVDPTQEQWKQIADIFVEKGHFAFFDCAYQGFASGDLDRDAWAVRHFVSRKSIPLLICQSFAKNAGLYGERVGALHVVSATPAQSAAVFSQLAAIQRSEISNPPAFGARVVKMILTDPALFQQWQADVKEMAGRIITMRQSLFDLLTKKFQTPGNWDHILKQIGMFTFLGLDTNQCNRLLEEGHIYLTANSRISMAGLTTNNVEYVASWIDKVVREKK

SEQ ID NO: 81785 - protein, 203 aa, Vibrio parahaemolyticus RIMD 2210633
MVLVGRQAPDFTAAAVLGNGEIVENFNFAEFTKGKKAVVFFYPLDFTFVCPSELIAFDNRLADFQAKGVEVIGVSIDSQFSHNAWRNTAIEDGGIGQVKYPLVADVKHEICKAYDVEHPEAGVAFRGSFLIDEEGVVRHQVVNDLPLGRNIDEMLRMVDALNFHQKHGEVCPAQWEEGKAGMDASPKGVAAFLSEHAADLGKK

SEQ ID NO: 81786 - protein, 490 aa, Xanthomonas axonopodis pv. citri str. 306
MPRFPDQLLYIGGRYVPARGGHTLEVVNPATGEVLANVHNAGVDDLDAAVDSAKAGQQRWAALTTVERSRILLRAVALLRERNDALAQLETLNTGKPLSETRSVDVVTGADVLEYYAGVAQALQGAQVPLREGSFFYTRHEPLGVVGAIGAWNYPIQIALWKAAPALAAGNAMIFKPSEVTPLTALKLAEIFTEAGLPDGVFNVLPGDGASVGTALTEHPQIEKISFTGGTATGRKVMASASSSSLKEVTMELGGKSPLIVCADADLDVAADIAMMANFYSSGQVCTNGTRVFVPRALRHAFEARLLARVQRIHIGDPLDERTTFGPLASAAHMQRVLEHIEQGKAEGARLLCGGERLQDGALVQGYYVAPTIFSDCTDVMTIVREEIFGPVLSLLTYDDEDEAVTRANATTYGLAAGVVTPDLARAHRLIHRLEAGICWVNTWGESPAPMPVGGYKQSGVGRENGLATLQAYTRTKSVQIELERYASVF

SEQ ID NO: 81787 - protein, 289 aa, Magnetospirillum magnetotacticum MS-1
MVLGSIARDDVIHLDQRLREGTHLQGSPPATRLGGGGANAAIALSHAGHEVSLVAAVGTDSLADELLAELSRYGVDVGPVTRLSGSSTHSLVLLDPEGERTIVNLTRARETRPPRRLLDLAADCVYVRSHGQDLEKLLRTKSALCPIIAQIQPLHEGRLPVQVLVGSHGDLDPDILSNPLAAGRALAGDTLRWVVITHGAEGAEAFSVHGERLRATAPDVDVVDTTGAGDAFAAGLAHALSLGMEMDHALPLAVRWGSAKVTRKGSFLDRDCVREILREWTARSSPNRP

SEQ ID NO: 81788 - protein, 724 aa, Picea sitchensis
METIEMPLPVPVHRLGNDIQQLNIDFSNVDLDSIQLPPGEDFGIKSEDEEEEEDSLEFETGFGNIVVVDNLPVVPPEKFEKLEGVVRKIFGQIGTIRERGLWMPIHPETQKTQGYCFIEYNTPQEAQTAKDQTNGYKLDKSHVFAVNMFDDFDKYMKVPNEWIPPETKAYTPGENLQQWLTDEKGRDQYVIRSNTDTEVYWNDPRQLKPELVYRRGYWTESFVQWSSLGTYLATVHRQGAAIWGGGTTFNRLMRFAHPQVKLIDFSPGENFLVTYSSHEPSNPRDTQRVTLNIFEVRTGKVLREFKGSADDFATGGTGGVAGVSWPVFRWAGGRDDKYFARIGKNAISVYETDTMTLLDKKSLKVDNVMDFSWSPTDPILALFVPEGGGGNQPAKVSLVQIPGREELRQKNLFSVSDCKMYWQSNGDYLAVKVDRYTKTKKSTYTGFELFRIKERDIPIEVLELENKNDKIIAFAWEPKGHRFAIIHGDGPRPDVSFYSMRSPNNVGRVSKLATIKGKQANSLYWSPIGRFIILAGLKALNGQLEFFNVDELETMATGEHFMATDIEWDPTGRYAATSVTVVHEMENGFNIWSFNGKLLYRIPRDHFYQLLWRPRPPSLLSPEKEEEISKNLRKYSKKYEAEDQDVSLLLSEQDREKRKRLQEDWQGWVNEWKRLHEEEKLFRQDLRDGEPSDEEEEYEAEEVEVEELIDVTEEIASFGFEQLD

SEQ ID NO: 81789 - protein, 365 aa, Gibberella zeae PH-1
MKQIKPPYRGSQWSQWSLHSSGLYYYRARYISLEDISSIRPTGRDWFVPNVRGGYIHYESRAANEAATQSPSIQAPDLSTCSIATTPTTSSDKPAPLPAPSGQMNNEVVATKTLPEGSMLMSGALQSEADRTGTVVVISSPTKLKRSSTTSKKQKEKKKHGKKMEVDKRKQLKPNRPSKLSQDLSHAKSLRSTQCSALLLQPGRINSFSTSTRPFVRSTTKASPIFSIHQAPAQPRPFTRDKLDIHAAAIMTSTIGIPIKLLNEAQGHIVTLEITSGQTYRGKLLDAEDNMNVQLKDITVTARDGRVSHLDQVYIRGSHVRFFIVPDMLRNAPMFRSRNVRGRGVGLARGRATVSRARAGGRGGR

SEQ ID NO: 81790 - protein, 340 aa, Zea mays
  misc_feature (217)..(217): Xaa can be any naturally occurring amino acid
MTSASTFLSLRLPTPSHATSSLSFPPSLLRQARGGVASSTLVARAAGPTGAAGAPSPLFNPRGDPFLSTLAAASPEDLAAAAGGERRGEDHLPFLEIFQNTKLMASPAQVERSSSSYSQHRPRRPPPDLPSLLLHGRIVYIGMPLVPAVTELIVAQLMYLEWMNSKEPVYIYINSTGTARDDGEPVGMESEGFAIYDAMMRMKTEIHTLCIGAAAGXHACLVLAAGKKGKRYMFPHAKAMIQQPRIPSYGMMQASDVVIRAKEVVHNRNTLVKLLARHTGNPPEKIDKVMRGPFYMDSLKAKEFGVIDKILWRGQEKYMADMLSPDEWDKVAGVRHPDLM

SEQ ID NO: 81791 - protein, 363 aa, Haemophilus influenzae 86-028NP
MGFKCGIVGLPNVGKSTLFNALTKAGIEAANYPFCTIEPNTGVVPMPDPRLDALAEIVKPERILPTTMEFVDIAGLVAGASKGEGLGNKFLANIRETDAIGHVVRCFENDDIVHVAGKIDPLDDIETINTELALADLDSCERAIQRLQKRAKGGDKEAKFELSVMEKILPVLENAGMIRSVGLDKEELQAIKSYNFLTLKPTMYIANVNEDGFENNPYLDCVREIAEKEGAVVVPVCAAIESEIAELDDEEKVEFLQDLGIEEPGLNRVIRAGYALLNLQTYFTAGVKEVRAWTVSVGATAPKAAAVIHTDFEKGFIRAEVIAYEDFIQFNGENGAKEAGKWRLEGKDYIVQDGDVMHFRFNV

SEQ ID NO: 81792 - protein, 162 aa, Moraxella catarrhalis
MYAEDTKNIVEIKDIIAREILDSRGNPTIEADVILANGIRGRAAAPSGASTGSREALELRDGDTSRYLGKGVKKAVANANSQIRTVLLDKDVTQQTQIDNILIELDGTENKGNMGANAMLAVSLAVAKAAAIAQSLPLHQYIANLRGQTSLTMPVPMMNILN

SEQ ID NO: 81793 - protein, 457 aa, Kineococcus radiotolerans SRS30216
MTLTLAMIAGAIIVRSLLARVLDRWLAGPATAMLVMGALAPLLTSGSAVEALNTTVAQHVVEVVLALLLFSDATMVRGGRLFGSHPRLLARVLLLAMPLSIGLTVALGVPLLGGPGAQGGLTWPVLLVIACIVVPTDFAAAERLLKHTRLSSRVRTTLNLESGYNDALISPLFLFAIALAVGPRGQEDPLGGLATALPYALKALVVGVVVGAALAGGLHAAAARGWVDASARRMLVLMAPLLTYAVTLAWNGNGFVASFVAGAVFANVHRVVAALAARTRPDGERQQLLLTREEDFRFLHDVTGLAVMAVWFLVGSACVLAFAGGVPWPVLLFTLVALTLVRLLPVWVGTARSGMPGRERVLLGVLGARGTTSIVFGLLAYNSLTGVVADTVLLITVLTLLGSVLLHGPLANPLIQRLTRAPRPASPAASPAASPAASEAAAQDGPSQDGPSQDPRH

SEQ ID NO: 81794 - protein, 214 aa, Xanthomonas axonopodis pv. citri str. 306
MSLLIEQARYHLSAHNARQLPDDGGYEVAFAGRSNAGKSSALNALTRQNALARVSKTPGRTQQLVFFQIQPERYLVDLPGYGYAKVPQDLQAHWQAFIDRYFRTREALRGLVVVMDIRHPLKDYDLQMLGYAAERGLPAHGLLTKADKLGRGQQMQTLQKVKKEVTSRFGDSVTVQTYSGESRQGVDELRGIVGGWLGLDGAPPAAEGEPGQAP

SEQ ID NO: 81795 - protein, 543 aa, Rubrobacter xylanophilus DSM 9941
MGIPLKLSGVAASEGVAVGPAYVYAPRGPRPAGNVPEGAVEEEISRFRRAVEAVRERLSETAARLREAGSGEEAAIFEAHAEIAGDPELAAEVERRVREGREGAGAAVLAVGEEYARSFAAMDDEYMAARADDVRDVAAQIATELVGGPSSGIEGLDRPSVILARNLLPSDTARLPREKVLGFVTAEGSRTSHVAIMARSLGIPAVVGVGEELEKAFGASVVALDGGEGYAVADPDPGTLELFERRRRRSDAEAALLKEYRHIEGRTRDGRRIEVSANLGSPEEAEEALSWGAEGVGLFRTEFLFMERDELPSEEEQYAAYRRVVEVFGERPVIVRTLDVGGDKDLPGIDRPAEENPFLGWRGIRMSLDLPDLFRTQLRAVLRAAAHGNLKVMFPMVTGVEEVRAAREHLEECRRELEEEGTPCGPLEAGVMIETPAAAILAGELAREVSFFSIGTNDLIQYTLAADRGNERLRRLYRADHPAVLELIRHTCEAAREAGIWVGACGEAAGDPGMIPYLVRLGVTELSMSPPSIPRAKKILSEL

SEQ ID NO: 81796 - protein, 622 aa, Xanthobacter autotrophicus Py2
MSEDTHAHQDDDGPNPGLGLDLGAPSAPARPAPPPEAPAAYRVLARKYRPQNFTDLIGQEAMVRTLRNAFSSGRIAQAYILTGVRGVGKTTTARILARALNYEPMDGSAGGPSLDLSVMGKQCRDIIESRHVDVMEMDAASNTSINDIREIIESARYRPVMARYKVYIIDEVHMLSTAAFNGLLKTLEEPPEHVKFIFATTEIRKVPVTVLSRCQRFDLRRVEAGELAAHLAGICAKEGVTIEPEALAIVARAAEGSVRDSLSLLDQAIAHGGGAVGAEEVRRLLGLADKGRVIDLFEALMKGEMARALAEFRDQYDAGADPAVILTDLAEFTHLVTRLKIMPDAAQDAALVEAERVRGLEMAQGLSMRVLARAWQMLTKGIGEVQQAPKPAQAAEMALVRLGYATDLPTPDEALRRLKGQPVTDAPAPPSAPSGGGGGGGGGGARLSLAPRPVEARPQMRPAPVAAVAAPAAGPRLASLADVAQYVAAKRDLALKHAVETSLRPVHVEEGRIEVALVPGAPASVIQDLSRKLSDWTGRRWLVSVSSQAGGPTLAEENAAVKAEREEGIKAHPLVAAVLARFPGAEVVDVRTREEAPIDTEVLAPSEEDLYAGPGADDELEY

SEQ ID NO: 81797 - protein, 600 aa, Glycine max
MTSKQTYSVCFCWRRRFKLALAEAPSEIKTLFNEYSENELMTPSHLKRFLVDVQRQEKATEEDAQAIIDSFRHFHRRGAGLNLETFFKYLFSDDNPPLLPSHGVHHDMTLPLSHYFIYTGHNSYLTGNQLSSDCSDVPIINALKKGVRVIELDIWPNASKDSIDVLHGRTLTTPVELIRCLRSIKDHAFVASEYPVVITLEDHLTPDLQAKVAEMVTQTFGDILFTPNSESVKEFPSPESLKKRIIISTKPPKEYLEAKEKEKGDDSQHEKEKGDDSEHGKASGEDEAWGKEVPSLKGGTIEDYKDNNVDEDLNDEEEFDESDKSHHNEAPEYRHLIAIHAGKPKGGLVECLKVDPEKVRRLSLSEQQLEKAAINYGQQIVRFTQRNILRVYPKGTRIDSSNYNPLIGWMHGAQMVAFNMQGYGRSLWLMHGMFRANGGCGYVKKPNFLLETGPDDEVFNPKAKLPVKTTLKVTVYMGEGWYYDFKHTHFDQYSPPDFYTRVGIAGVPNDTIMKRTKAIEDNWLPTWNEAFEFPLTVPELALLRIEVHEYDMSEKDDFGGQTCLPIWELRSGIRAIPLHSQKGDKYNTVKLLMRFEFINN

SEQ ID NO: 81798 - protein, 337 aa, Streptococcus mutans UA159
MVVKVGINGFGRIGRLAFRRIQNVEGVEVTRINDLTDPNMLAHLLKYDSTQGRFDGNVEVKEGGFEVNGKFVKVSAERDPEQIDWAADGVEIVLEATGFFASKAAAEKHLHANGGAKKVVITAPGGNDIKTIVFNTNHDVLDGTETVISGASCTTNCLAPMAKALHDNFSIKEGLMTTIHAYTGDQMVLDGPHRKGDLRRARAAAANIVPNSTGAAKAIGLVIPELNGKLDGAAQRVPVPTGSVTELVAVLDKKVTVDEVNAAMKAAANESYGYTEDPIVSSDIVGMSFGSLFDATQTKVLDVDGKQLVKVVSWYDNEMSYTSQLVRTLEYFAKIAK

SEQ ID NO: 81799 - protein, 398 aa, Streptococcus mutans UA159
MAKLTVKDVDLKGKKVLVRVDFNVPVKDGVITNDNRITAALPTIKYIIEHGGRAVLFSHLGRVKEEADKKGKSLAPVAADLAKKLVQEVVFPGVTRGEQLEAAINALKNGEVLLVENTRFEDVDGKKESKNDPELGKYWASLGDGIFVNDAFGTAHRAHASNVGISANVDKAVAGFLLENEIAYIQEAVDNPVRPFIAILGGSKVSDKIGVIENLLKKADKVLIGGGMTYTFLKAQGIEIGDSLVEEDKLDIAKDLLAKANGKLILPVDSKEANAFADYTEVKDTEGAAVDPGFLGLDIGPKSIAKFDDELTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 81800 - protein, 269 aa, Salmonella typhimurium LT2
MEKKIGFIGCGNMGKAILGGLIASGQVLPGQIWVYTPSPDKVAALHDQYGINAAQSAQEVAQVADIVFGAVKPGIMVKVLSEISSSLNKDSLVVSIAAGVTLDQLARALGHDRKIIRAMPNTPSLVNAGMTSVTPNALVTPEDTADVLNIFRCFGGAEVIAEPMIHPVVGVSGSSPAYVFMFIEAMADAAVLGGMPRAQAYKFAAQAVMGSAKMVLETGKHPGELKDMVCSPGGTTIEAVRVLEERGFRAAVIEAMTKCMEKSEALSKS

SEQ ID NO: 81801 - protein, 362 aa, Zea mays
LTDSTAPPKKMAAAPEELLCAAAKSGEEGEVAKLLASGADATHFDADGLTPLMHASAGGHAAVARLLLDCGAPWNALSPSGLSAGDLASDPDTYDLLLDHAIRSELVLGTVARRQAAPANGPPAESYLESRVSFSEERVMDAESKAVMMAWERPLMEAHARAVCQGGGKVLNVGFGMGLVDEAIQRYGPEEHTIVEAHPEVYERMLKLGWGDKKNVRIVFGRWQDVMPQLGSYDGIREYGEVGQKLKVTKFLEYVSGIFFDTYGEYYEDMREFHQHLPKLLKPGGIYSYFNGLCGDNAFFHAVYCQLVALELANLGYSTQFIPLPVKDCLAEEVWKGVKRKYWQLDTYYLPACQSESESTIS

SEQ ID NO: 81802 - protein, 196 aa, Streptococcus mutans UA159
MIPVVIEQTSRGERSYDIYSRLLKDRIIMLTGPVEDNMANSIIAQLLFLDAQDNTKDIYLYINSPGGSVSAGLAIVDTMNFIKSDVQTIVMGIAASMGTIIASSGAKGKRFMLPNAEYLIHQPMGGTGGGTQQSDMAIAAEQLLKTRKKLEKILSDNSGKTIKQIHKDAERDYWMDAKETLKYGFIDEIMENNELK

SEQ ID NO: 81803 - protein, 771 aa, Thellungiella salsuginea
MVASAFLPELWTEILVPVCAVIGIAFSLFQWFIVSRVRVTADQGASSSSGGSNNGKNGYGDYLIEEEEGLNEQSVVAKCAEIQTAISEGATSFLFTEYKYVGVFMVFFAAIIFVFLGSVEGFSTKNKPCTYDDTKTCKPALATAAFSTVAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMLYPLLISSMGILVCLITTLFATDFFEIKAVKEIEPALKNQLIISTVIMTVGIAIVSWVGLPSSFTIFNFGTQKVVKNWQLFLCVCVGLWAGLIIGFVTEYYTSNAYSPVQDVADSCRTGAATNVIFGLALGYKSVIIPIFAIAASIFVSFSFAAMYGVAVAALGMLSTIATGLAIDAYGPISDNAGGIAEMAGMSHRIRERTDALDAAGNTTAAIGKGFAIGSAALVSLALFGAFVSRAGVHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYL

SEQ ID NO: 81804 - protein, 426 aa, Ustilago maydis 521
MTYSESTAPVPLIIDTDPGVDDVLAILLALASPDEVAVKAITLTFGNTTLDHAYANVLRLAAVLQRHLADPATPDVVKQRYRAFSADAEPLIVASGSTQPLEGKRFTASYFHGRDGLSGVNWLPNDPFPVPTEIVAPLAPTDKSAADVILDTIRQHPPHTVRIAALGPLTNLAAAFRKDPETFAKVGGISVMGGAFDVPGNTSPVAEFNWYADPYSVRVLIDEAPRHAALARRKLPIQVLALDITCGHTVPYSSLVKATYETPRDTPERASHLARFIGTFLTHPRAFTNNMVAPEEFHPDRHDLFEAHDPLAVAHAIFAPMPATGSIDGNGWKHTPRRFQIETSGDLTRGFCVVDRRFTGKGSSRKTGGNRAEDAERKLHTIESPDVPVHRKVEEVDESQVGLVDEVTGTPGAEWFSKMFLERIGL

SEQ ID NO: 81805 - protein, 595 aa, Oryza sativa Japonica Group
MASAAVIPSSAPGAAAAGAAAVESAGWVVDERDGFISWLRGEFAAANAIIDLLLLHLRSVGEPGEFEHVAAAVQQRRHHWAPVIHMQQFFPVGDVAYALQQAGWRRRAPPHHQQQGPGASPSPPPPPPRGRPSFSASHSHHRHGGHHHRSDSVRGGGTGATAGSDKDEGEKTPRPQAVAEGSSKVVPTPVEYTVNDIIDGKTVNAVEGLKVYEGLVNENEKNKILSLLNETKASFRRGGLEAGQTVIIGKRPMKGHGREIIQLGIPIVEGPPEDDYPRETKVEAVPGLLHDLFDRLCQKEIIPTKPDYCVIDYYNEDQMIFFPQGDYSHPHQSPPWSLLVLHGKSADVAKRAIPAACKQRILLSFGKSLSRKQVPSESVSRFTTPLTPPPMPWGPPRPANMARHSSSPKHFGYAPNSGVLPAPAIGAHHIPPSDGMQPLFVAPAPVAAAAMPFPSPVPLPNSTTAWMAEAAPRSAPQRLPVPGTGVFLPPGSGHALPHQMMTASQSPAEPISSTDSSAYVHNKSTSTMGEMANGDVSPKSSPAKQSDAVEQKPECNGSSNGGSSLVDKKSAVSKEQQNGGMKKVGSNKVQPNAAK

SEQ ID NO: 81806 - protein, 215 aa, Ustilago maydis 521
MALHIGTLLALLLIILHLWLAVISGFYDDYPKKGIRFCDILPVLRDPLAFELLLTNIVSHIFTHTIPSLDDDTPAPAAPTPLEPGAKSYGNRKIDAVVGLDARGFLLGPAIAQRLGCGFVPVRKVGKLPGECVQASYQKEYGEDVFEMQKEALAPNSRVLVIDDLIATGGSAKAAGELVNKCGSKVVEYVFVVAIPFLKGADQLDAPSYHLVEVD

SEQ ID NO: 81807 - protein, 326 aa, Colwellia psychrerythraea 34H
MSKIFEDNTTAIGNTPLVKLNRVIDSENGANVYAKIEARNPSFSVKCRIGASMVWDAEEKGLLTPGKEIVEPTSGNTGIALAFVAAARGYGITLTMPSTMSLERRKLLSALGAKVELTDGAKGMGGAIAKAQELKDSDPEKYVLLGQFDNPANPKIHEETTGPEIWNDTDGNVDIFVAGVGTGGTLTGTSRYLKLTKGKAITTVAVEPTDSPVITQALAGEELTPGPHKIQGIGAGFIPGNLDLDMVDAVELVSNEDAFAMAHRLMKEEGILAGISSGAAVIAAKRLAERPENKGKNIVVILPSSAERYLSSALFTETFSDKELVQ

SEQ ID NO: 81808 - protein, 366 aa, Bacillus cereus ATCC 14579
MGLTAGIVGLPNVGKSTLFNAITQAGAESANYPFCTIDPNVGIVEVPDERLNKLTELVEPKKTVPTVFEFTDIAGIVKGASKGEGLGNKFLSHIRQVDAICQVVRCFEDENITHVSGKVDPIDDIETINLELILADLESVDKRIERVAKLARQKDKEAVYEHEILVRLKEAFEEGKPARTVEFTEEQMKIVKGLHLLTTKEMLYVANVSEDDIIDPSENKYVQMVKEFAANENSQVIVVCAKIESEIAELDEEEKKVFLEELGIEESGLDQLIRAAYDLLGLATYFTAGVQEVRAWTFKQGMKAPQCAGVIHTDFERGFIRAETVSYDDLMTNGSMTAAKEAGKVRLEGKEYIVKDGDVMHFRFNV

SEQ ID NO: 81809 - protein, 362 aa, Oryza sativa Indica Group
MALRRLLQGSVLPRMAGRAAAAPFSTASGETVRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQASLRVAEYAFHYAKTNGRERVSAIHKANIMRKTDGLFLKCCREVAEKYPEIVYEEVIIDNCCMTLVKNPGLFDVLVMPNLYGDIISDLCAGLIGGLGLTPSCNIGEGGICLAEAVHGSAPDIAGKNLANPTALMLSAVMMLRHLQFNNQADRSTTPSSRPSPRGNSGLLISAERRRLQTSRRQCCDHI

SEQ ID NO: 81810 - protein, 291 aa, Magnetospirillum magnetotacticum MS-1
MSSYYEASARERIVGLLDGGSFREILPPGERILSPHLLQLDTPAAFDDGIVVGEGALGGRKVLIAAQEGGFMGGAVGEVHGAKLVGLLERALDQRPAGVLLLVESGGVRLHEANAGLIGVSEIMRAVLKLRGAGIPVIVLDGGQFGCFGGMGIVSRLCDAVIISEEGRLGLSGPEVIETTCGVEEFDSRDRALVWRTVGGKHRYLLGEAAHLVADDIAAFRAQAIAALDLRPDLSLEALEREHAVLGQRLDRFGTCRDGIDIWRNLGIDQPERLPLLEAEAFIAITAGKRA

SEQ ID NO: 81811 - protein, 267 aa, Vibrio parahaemolyticus RIMD 2210633
MHPMLNIAIRAARKAGNHIAKSLENTDKVESTLKGTNDFVTNVDKEAEYIIIDTIKQSYPEHCIVAEEQGLIEGKDKDVQWIIDPLDGTTNFVKGYPHFAVSIAVRIKGKTEVACVYDPMQNELFTAQRGAGAQLNSARIRVTPLKDLQGTVLATGFPFKQKQHSESYIKIVGSLFTECADFRRSGSAALDLCYVAAGRVDGYFELGLKPWDMAAGELIAREAGAILTDFAGGTEYMKSGNIVASSARGVKSMLKHIRENGNSAILK

SEQ ID NO: 81812 - protein, 461 aa, Microcystis aeruginosa
MRVCVIGTGYVGLVTGVCLAHIGHHVICIDNNEEKVKLMKSGQSPIYEPGLSELMQSSAASGNLEFSADLEAGVKHGEILFIAVGTPALPTGESDTRYVEAVARGIGAHLNGGYKVIVNKSTVPIGSGDWVRMIVLDGVAERQKNLVAAGGGISTLERIEAEFDVVSNPEFLREGSAVYDTFNPDRIVLGSNNPKAIEMMKELYAPLVKRQFAEDTSLPPVPVVVTDLSSAEMIKYAANAFLATKISFINEVANICDRVGADVTQVAKGIGLDSRIGSKFLSAGIGWGGSCFPKDVSALVHTAKDYGYETELLNAAINANKRQRTIAIEKLQQELKILKGKTVGLLGLTFKPDTDDMRDAPALTMIEQLNRLGAKVKAYDPIVSQSGLSHGLSGVIIESDPERLADGCDALVVVTEWQEFLRLDYGKMAKTMREPVLIDGRNFLDPAVVTAAGFRYLGIGR

SEQ ID NO: 81813 - protein, 182 aa, Neptuniibacter caesariensis
MKIRTYQGMTPKLGERVFVDPSAVVLGDVELGDDVSVWPLTVIRGDMHRIRIGARTSVQDGSVLHITHAGPFNPDGFPLIIGEDVTIGHQAMLHGCTIGNRILIGMGAMVMDGAVIEDEVIVGAGALVPPGKTLESGYLYVGRPAKQQRPLTDKEREFFSYTAGNYVKLKDQHLEEEYAQID

SEQ ID NO: 81814 - protein, 377 aa, Kineococcus radiotolerans SRS30216
MSTASTATTTATTPAAPAVGSKQYSLAVLHGDGIGPEIVPASVKILDAAVAAAGATPIAWTELPLGRSAIDEYGEHTPTKTLDALDEVDGWLLGPHDSAAYPEPYRSQLNPSGTIRKHFGLFANIRPAKAFRGGNAIVEGTDLVIVRENTEGFYADRNTFAGTGEMMPTPDVAIMHGIITRAATERIAHEAFQLARTRDKRVTIVHKANVLKMTTGLFRDVCREVGKQYPDVAINDFHIDAATVHLVRRADKFDVIVTENMFGDILSDLAGEVAGSLGIAPSINSSATHAMAQASHGSAPDIAGRDIANPIAMILSSAMLLRWLAAKFDDEKIARAADIVEAAVDLTVAEGATTPDMGGTSSCSGFADAVVAATARV

SEQ ID NO: 81815 - protein, 238 aa, Gibberella zeae PH-1
MVAEEPRQRKDPAVSGKENSKQQRRRTAENLAPPFFALLFALLAFYILFSPPSSSLSPPVPVCHSTISSSVSSSQVIPDKNIAKMSSSEQTFIAIKPDGVQRGLVGPIISRFENRGFKLAAIKLMTPGKEHLEKHYADLAGKPFFAGLIEYMNSGPICAMVWEGRDAVKTGRSILGATNPLASSPGTIRGDYAIDVGRNVCHGSDSVENAQKEIALWFKEGEVVSWKSAQFNWVYEKA

SEQ ID NO: 81816 - protein, 505 aa, Oryza sativa Indica Group
MGHELWVLWATLAVSLLCYLYLTSHRLGSRRRRWPPGPRPLPLLGNLLDLRGGNLHHTLARLARAHGAPVMRLQLGLSPAVVISSPGAAREAFTAHDRRLAARAVPDANHALGFCDRSMIWLPSADPMWRTLRGVVAAHAFSPRALAAARAVHERKVRDLVAYLRGRAGREVDVKDAVYGGVLNLVSSALFSADVVDVGGESAQGFRELVEELIESIAKPNVSDLFPFLRPFDLQGWRRWTSGHLAKIYKVLDDIIDRRSAEDDAAMDKRGDFLDVLLELMSTGKIAREYLTNILFDVFTAGSDTMSLTVVWAMAELLRNPGVMAKARAEIDAALGGREAVEEADVARMPYVQAVLKEAMRLHPVAPVMLPRKAAEDGVEIGGFEVPRGCAVIFNTWAIMRDPAAWERPDEFVPERFVGRSRATEEMDFRGKDFGFLPFGSGRRLCPGVPMAERVLPLIMASLLHAFEWRLPDGMSAEQLDVSEKFTTANVLAVPLKAVPVVIAC

SEQ ID NO: 81817 - protein, 399 aa, Thermus thermophilus HB27
MEGIASVKELLEELKAGRPVILVDDEDRENEGDLIMAAEHVTPEWVNFMLKECRGLLCVALTEERAKALDLPLMVERNQDPQGTRFTVSVDARGTTTGISAFERAATIRLLADPEVTAQDFRRPGHVFPLVARPGGVLRRAGHTEATVDLLRLAGLTPVGSLIEILKEDGTMARLPDLLAFARRHGLKVGTIADLIRYRLEKGDLYVRREAEALLPTRFGEFRILGYRDTLTGEEHAALVMGSWAPEEPVLVRMHSECLTGDALHSLRCDCGFQRDLALQRIAEEGKGVLVYLRQEGRGIGLVNKIKAYHLQDQGLDTVEANLALGFPPDLRDYGVGAQILYDLGVRKMRLLTNNPRKVRALSGFGIEIVERIPLRAGDNPHNERYLQAKKEKLGHWMD

SEQ ID NO: 81818 - protein, 290 aa, uncultured marine bacterium 313
MLPAENLDNKIKEFWPKNGPPTEEVEKYVKKYSKEKIVIKCGGRVLLDADLFNSFIEDVVTLKKLGLTPLLVHGGGLGIKKKLDELNIKSKFIMGLRVTDEKMIKIVEEVMIEFNKEIVSALEKKSCKAKSITIKENNAIYVQQKNKELGYVGSPTRIDNKLIKNFIDKDFVPIVTPMGLDEKMRAYNINADTVAGALAVSLKSRRLLLMTDVEGVYNENNKLISEIKPTEAEKLIYNQTIHGGMIPKIRTCINAVNNSVRGVVIIDGRRPHSILFELFSDQGAGTLIRK

SEQ ID NO: 81819 - protein, 497 aa, Vibrio angustum S14
MSFASLGLSAPILEAVAKQGYEKPSPIQEQAIPAILAGKDVMAAAQTGTGKTAGFTLPLLERLANGRPARSNHVRALVLTPTRELAAQVGESVATYGKNLRLSSAVVFGGVKVNPQMLRMRKGADVLVATPGRLMDLHSQNAVKFRDVEILVLDEADRMLDMGFIRDIRKILALLPKERQNLLFSATFSDEIRELAKGLVNNPVEIDVNPRNQTARTVKQWICPVDQKKKPNLLTKLLNERNWKQVLVFTKTKHGANKLATHLESRGVSAAAIHGNKSQGARTKALANFKSGDVRVLVATDIAARGLDIDQLPQVVNFDLPHVAEDYVHRIGRTGRAGCVGEAISLVSAEEAKDLAAIERLTQQVFDREIIEGFKPTNALPQSKLDTRPIKPKKPKKQKTFVAREGAATGEKRSTNNNNGGAKRKPASRRPQGQSTDAANNEKRSEQGARPARKPRNTDAKPQSNGDKPRRRFNDEKPKSDGRRRSPQRSRAPKATA

SEQ ID NO: 81820 - protein, 478 aa, Streptococcus mutans UA159
MADPFGFLKYERKDNPYRPVNERIKDFEELQTTLSVEERQKQAARCMNCGIPFCHEGTFYGGGRAVSGCPNDNLIPEWNDLIYKGDFRRAFERLTRTNPLPEMTGRVCPAPCEKACTEGLNGSGVTIHDNERFIIDNAFEEGWVADSGRPIERTGFKVAVVGSGPAGLSAAWRLNQLGHSVTVFERSDRFGGLLMYGIPNMKLDKKIVQRRIDTMASIGINFVANTEIGRDITAEELLEKFDRVILATGASVPRDLDIPGRDLKGIRFAVDFLTETTKNLLDSDTHELPPLLEGKHVLVIGGGDTGNDCIGTAVRLGAASVRQLEITPQLPEKRLPTNPWPQYPMINRTGYGQEEADFVQQTDLTDYITSTVEFLGENGQVTAVKTIKVGPGFKAIEGTEEVIKADLVLLAMGFTGAEKALFDQFRVECVYDDYSTRNEKVFVAGDARRGPSLVIWGIREGRKTAEKIDQNLRMMVTE

SEQ ID NO: 81821 - protein, 605 aa, Mucor racemosus
MADFTDSLIKNIGVHSSSPVMTSVNMGQLGEKLRQARTTTLASLSQALSKKPEAAAAAATAPNAVNESTTTPTTMQLPASEKATSQLEINVVEARNLTIADARKADTYCIVHYEGNTTSTLDKVDDGILPSTPLVIKSQVASGAFKAFEIMMSASSPKWMHRVNFDVTAGNKEITVFVYDRGNKLPNGEDRFLGMSSIVPNLVNKKTVELIFPLHGRPDDDQEVTGDVRLQVTFIDPKKANLKPEDFRIVRMIGQGSVGKVYEVIKRDSGRTYAMKVLSKRLLLAENEVDTAFNERNVLVQSLSSPFIANLKYSFQTTNHLFLVMDYFPGGELFDFLERERCLSEKRCQFFAAEIVCAFDNIHARNIVYRNLKPESILLDAHGHIALTDFGLCKQLKNKMDLIQGVPQVITQEYLAPEMVMQKPYGMAADWWSLGVLMFELLTGSPPFHSVEQGELFRQILEAPIKFPAGGCITEEAKDFICQLLERDPAKRLGSHGDVAQVKAHPFFKDLNWDVVYKKQMQLPFVPEVEEQLREEAIAAAAAISIPVTNSKTESTNANVMPVADQSKFKGFSYIREDVMAKKGEHRLGVNPEDEDPEVDFWFRQ

SEQ ID NO: 81822 - protein, 416 aa, Arabidopsis thaliana
MTRKYIYIYIYIILKVRARVGANNKTLINNQSHLIEMRNTLMLSDLPGDLLEEILCRVPATSLKQLRSTCKQWNNLFNNGRFTRKHLDKAPKDFQNLMLSDSRVFSMSVSFHGIPSVEATCELSLIDSFSSFEDKFEISQVFHCDGLLLCTDADNTRIVVWNPCTGKTRWIEPNNRCYYYAFGSYLDKSYGNSYKILSYSGYGYENQELAIYEINSQSWRFLDVTRDCILERYTDYGVSLKGHTYWFASDEKEKNLSVFLVSFDYTTERFRRLRLPYQCPDYNTASLSVVREEKLAVLLQRENTSRTEIWVTSRIGETKVVSWSMVLAVDFPSELFILSGISFLVDAEKKFVVCCDNYFGEDEYDTKNLVHIVGENNKVREVNFGVSESSWPFLFNYVPSLIQIWEGVGGKRKRVE

SEQ ID NO: 81823 - protein, 314 aa, Agrobacterium tumefaciens str. C58
MAERRKIIIDTDPGQDDAAAIMLAFGSPEEIDILGLCAVAGNVPLKLTSRNIRIICELCGRTDIPVYEGAEKPLVRKPITAEHVHGSTGLNGPVLDEPTMEAQKQHAVDFIIETLMREPAGTVTLCTLGALTNVALALLKAPEIADRVKELVMMGGGFFEGGNITPAAEFNIYVDPQAADIVFRSGMPVVMMPLDVTHKLLTTKARVNRIRDIGTRPAIAMAEMLEFFERFDIEKYGSDGGPLHDPSVIAYLLKPELFEGRECNVEIEVISELTMGMTVVDWWRVTDRPANARVMRNVDADGFFELLTERFARL

SEQ ID NO: 81824 - protein, 122 aa, Triticum aestivum
MAARLAQLRTKAAQAAEFASKHGGAYYKEAMEKNKQYVVQPPSVEKCQEHSKQLFYTRLASLPGRYEALWKEVDGVKQLWKNRKELRVEDLGIATLFGVELYAWFCIGEIAGRGFTLTGYKV

SEQ ID NO: 81825 - protein, 405 aa, Methanopyrus kandleri
MHDQRSAGGKALGLDEIVNGFPLKEEWVYLDNAATSLKHERVISAMERVLREFGVNVGRGAHPPGECATEEFERARDIVASFLGVEPECLAFTLNTTHSIHYVLASIRWKKGDAVVTTALEHHSNLAPWLRFSEVLGFEVEVVGFDRETGEVDMAELESVVDDNTRLIAITHESNALGSLQPVDEILELAEEVGAYVLLDAAQSLGHMDHDWSRYHFLAAPGHKGLLGPHGTGILYVREDVMEELELRLLGGGSTDYVTRDLEVVPREPPLSFESGTPNLPGVIGLAEGVKILEEVGLNRVERRIRKVTRRILNGLEELEGVEILAPEAERKTIVPFLVDGVDYAEVGKKLGERNICVRTGRHCASLVFERLGLDGCVRASVAFYNDIEEAERFLEVVEEIARGS

SEQ ID NO: 81826 - protein, 503 aa, Methylobacillus flagellatus KT
MKIDYLQKIKSARVYDVASKTPLDLLPNLSRRIHNQVLLKREDMQPVFSFKLRGAYNKMAQLSAEALSRGVITASAGNHAQGVALAAKNAGCRAVIVMPVTTPDIKVDAVRHRGAEVVLAGESYTDSYNHAMKLMEEQQLTFVHPFDDPDVIAGQGTVAMEILQDNPGPIEAIFCPVGGGGLIAGVAAYIKAVRPEIKVIGVEVNDANAMTVSLQQGARVTLDQVGLFADGKAVKLVGEETFRLCQQYVDEMILVDNDAICAAIKDVFEDTRAILEPTGALSLAGLKAYAQQHNLQGKTLIAVASGANMSFDRLRFVAERAEIGEKREAVLAVTIPETPGSFKKFCRLIGHRNITEFNYRYADATAAHIYVGIAIQDPSESGKLVTRLQEHGLPALDLSENEVAKLHLRHLVGGHAPQAKHEQVYRFEFPEKPGALMNFLDNMRHDWNISLFHYRNHGADFGRVLVGMQVPPGEEQEFTDFLQNLGYPYWDESNNPAYKLFLG

SEQ ID NO: 81827 - protein, 219 aa, Methylobacillus flagellatus KT
MATQDELKQQVAKAAIEYVKGGIIGVGTGSTANFFIDELAKVKDRIDGAVASSEATAQRLRGHGIKVFDLNDVDGMEIYVDGADEITEKLHMLKGGGGALTREKIVAACAKDFICICDQTKLVPVLGKFPLPVEVIPMAREYVARELVKLGGQPKLRDFTTDNGNVILDVHGLTITDPVALESRINEIVGVVTNGLFASRPANVLLLATADGVKTLTAR

SEQ ID NO: 81828 - protein, 203 aa, Zymomonas mobilis subsp. mobilis ZM4
MLLMIDNYDSFVVNLARYCERLGRKVSLFRHDKITLEEIEVMSPKAIILSPGPCSPEEAGISLDVLRQFSGKIPILGVCLGHQAIGVAFGGVIARASYPLHGRAVEISHVGKRLFKDIPNPFKAARYNSLIIQKTEEMEQHLTVDALSPEGEIMALSHKSHPTYGIQFHPESVLTEYGDALLSRFFDLEEAFYADMAERCISQ

SEQ ID NO: 81829 - protein, 530 aa, Zea mays
  misc_feature (221)..(221): Xaa can be any naturally occurring amino acid
MEAAPPTSPPSLVLLLLLLLLIISPPSSAFLSPKGVNPEVQALMTIKSMLKDPRGVLKNWDQDSVDPCSWTTVSCSPENFVTGLEVPGQNLSGLLSPSIGNLTNLETVLMQNNNITGPIPAEIGKLTKLKTLDLSSNHLYGGIPASVGHLESLQYLRLNNNTLSGPFPSASANLSQLVFLDLSYNNLSGPIPGSLARTFNIVGNPLICGTNTEEDCYGTAXPMPMSYKLNSSQGAPPQAKSKSHKFVAVAFGAAIGCISILSLAAGFLFWWRHRRNRQILFDVDDQHMENVGLGNVKRFQFRELQAATDKFSGKNLLGKGGFGFVYRGQLPDGTLVAVKRLKDGNVAGGEAQFQTEVEMISLALHRNLLRLYGFCTTATERLLVYPYMSNGSVASRLRERQASEPPFKWETKRRIALGSARGLSYLHDHCDPKIIHRDVKAENILLDEEFEAAVGDFRLAKLMDYKDTHVTTAVRGTIGHIAPEYLSTGKSSEKTDVFGYGIMLLELITGQRAFDLARLANDDDVMLLDW

SEQ ID NO: 81830 - protein, 106 aa, Zea mays
IIPNIHEIEKCSGRGIIVTGPAPAGFGYDFFTRFFSPKFGIKGDPLCGCAPWFLAPFWGGKGGEHKQIAFQASPRSGITHLELGDTSRRVRIQGEAGSGKPGPLLA

SEQ ID NO: 81831 - protein, 750 aa, Oryza sativa Japonica Group
MALLARRARKAVMAKAPAPLLQKRGGGAAAELAIPAHFRCPISLDLMRDPVTAPTGITYDREGIEAWLDTGRAVCPVTHAPLRHEDLVPNHAIRRVIQDWPPSCCSTSRSRRRGAAPPGRAAGAVARVRALARDSERNRRCFVSVGTGRVLAAAFESLAAAGEAGVLEDVLAALVCMMPLDEEAARVLASSSSMGSLVAIAKHGSLAGRLNAVLAIKEAVSRDGAFVDLADDKVDKVVDALVVIIKAPICPQATKAAMVATYHLASSDERVAARVASTGLVPTLIEALVDADKSVSEKALAVLDAMLASEEGRASARGHALAMPALVKKMFRVSDVATELAVSAMWRLGCKASSGDEEAAATGCLVEALRVGAFQKLLLLLQVGCRDATKEKATELLKMLNKHKGLGEGREGKGREGRKVRADMSAAPIPREWVGLQQFPAATQTKLHELLGKLKEENVSTLTILVMGKGGVGKSSTVNSIVGERVATVSAFQSEGLRPMMCSRTRAGFTLNIIDTPGLIEGGYINEQAVEIIKRFLLGKTIDVLLYVDRLDAYRMDTLDDQVIRAVTNSFGKAIWRRTLVVLTHAQLSPPDGLDYNDFFTKRSESLLRYIRAGAGVSKRELGDFPLPIALVENSGRCKTNENGEKVLPDGTPWIPNLMKEITTVVSNGSKSIHVDQKLIDGPNPNNRWKMFIPLILMVEYFLVVKGIRRAIHADISNGKLDDWEQRYRDLVGSKDPVDQKGSSSGNRKA

SEQ ID NO: 81832 - protein, 329 aa, Oryza sativa Indica Group
MAEEAAAGGLYYCHMCASTVSTVAAAEGEVEIKCPYCHSGFVEEIESARGVATGGGGAISSVWAPIIDGMVGGGGGDAVRRHRRSRRLADAAGADDGYYRDLALLDFSESRRRTAALLLLMQEFRERQLQRLESATATISAAAAEAGAVVGTSRDAEGVALADYFLGPGLDALMQRVGDGDAGRQGTLPAKKEAVESMPTVEVAAGGDCDSACAVCLEDYAAGERATEMPCRHRFHAKCIVPWLKMHSSCPVCRFQLPTDDDDDSSKSARGGAAHSGGGRRLSQPVPRVDGGGLGRLPAVMQELRSILSQPSPASTSGSSSHAQQHSDE

SEQ ID NO: 81833 - protein, 447 aa, Kluyveromyces lactis NRRL Y-1140
MSVFGFDNIPTWLWWLLAIYLATPFVLYVVQPYLFYEGKSTKTRILIVVLGDLGHSPRILYHARSFSKAGFQVELSGYVDSDIPTDILDDDNIEIHGLKKYGSEKGLLVKALKQGLQLCSMFWKLRAVDYILLQNPPTIPILPIAVVVKTFSRAKLIIDWHNLGYTILQMKFKDQFLHPLVLLAYLIEWIFAKFANYHLTVTKAMKTYLVEKFGIDGKKIAVLYDRPGKQFSPLKEADDREALLKQEFIAKYIPKEFDISKDKIFVTSTSFTPDEDISVLIGSFKIYENSFQKFDQTLPRILCFITGKGPLQEKIVKQVQDFKWDRVQVEFLWLSSEDYPKLLRLCDYGVSLHTSSSGLDLPMKILDMFGSGLPVICMNYPVLDELVQQNVNGLKFADRRELHEALIFSVKDEQVHQEIKRGALRESKNRWNESWESALSELKIIHK

SEQ ID NO: 81834 - protein, 273 aa, Hyphomonas neptunium ATCC 15444
MNDTNLLLPMRTGEIRIHDAEGFEGMRRAGRLVAECLDMLVPEVKPGVTTEHLDNLVREFVQDHGAVSATIGYRGYRHASCISVNHVICHGIPGGKALKEGDIANIDVTLIIDGWHGDHSRMYGVGEVKRKAERLMEVTYEAMMAGIAAVKPGGRFGDIGGAISEIARLNRYSVVDDFCGHGLGRLFHDEPNVVHSAKAGTGPELKPGMFFTIEPMLNLGRRDAAILPDGWTAVTRDRQLSAQFEHSVGVTETGVEIFSASPKGWHEPYKVKL

SEQ ID NO: 81835 - protein, 444 aa, Coccidioides immitis RS
MAEAQKPTGMGANPNAAAEKDVQDVLAELKAEEAGKQEKEEEAPASTEPEKTESPANGAQADAEAEEEARIIAAANKLGQESAPEGKSKQEKGGRGGSRSGPGGEKKRVNYRDNIKSDVTTLEQTSDPEQIRKQVEFYFSDSNLPMDKFLLSKVGGSENNPVELSLLHSFKRMRRFQPFSAIVDALKDSQTLELTNDNTCVRRKVPLPESATESGKESVAKVFEDKAMHRSIYAKGFGKEEPSTQFDIEAFFAPYGPTNAVRLRRTNEKIFKGSVFVEFDSEESQKKFLALDPKPKWKGTTELLIKSKKEYCDEKLKEIEAGRLKPSKNRGPFRGRGRGRGRGDNRDWKDRRADDQKRGFGKGRSGHRGRGNRDRDGGRPEVLKDARGVPIVQVSEGLKSKEATTTAGQKRAREEDAPANGNHAASSNIENGDRPTKKVATKEG

SEQ ID NO: 81836 - protein, 127 aa, Vibrio parahaemolyticus RIMD 2210633
MAYSEKVIDHYENPRNVGSFDKEDPSVGSGMVGAPACGDVMKLQIKVTPEGIIEDAKFKTYGCGSAIASSSLVTEWVKGKSIDEAAAIKNSEIAEELELPPVKVHCSILAEDAIKAAVADYKKKHQE

SEQ ID NO: 81837 - protein, 261 aa, Candida albicans SC5314
MGVHKLIILRHGESQWNHENKFCGWIDIPLSQKGKQEAIYAGELIKKNHLDPDILYTSKLMRSIETGLTILEVLHKPWIDHIKTWRLNERHYGQYQGRDKHEVFVELGKDKEKFQYIRRDYHGLPPLIEYGQDKSIDEKYKDVLNKDILPRGESLSMVMDRLIPFFKYEILDNQMIQLNKTVLIVTHGSIVRSLIKYLNHVSDDDISKINVPTGIPLVFELNDRGELIKPYYYLDQEKAEKGIAKVKMEGLERKGQTDEKL

SEQ ID NO: 81838 - protein, 260 aa, Picea sitchensis
MAELDGHIAMDKNLYNRALKAMLAMAVATFIPTSFIKVPYGRHSRPGWGPSISPRLAWFLMESPTLWMSALLFPHGRMSSNPTSLILLMPFLAHYIHRCCIYPLRIRSGSKPLPISIAAMAFLFNTYNTYLQIRWISHYGNYTAGWLGSPMFIAGLLVFITGMIINLWADSVLLSLRRENEGYKIPRGGLFEYVSCPNYFGEIVEWLGWALMTWSLAGLSFFLYTAANLGPRAAVHHDWYHEQFPERYPKSRKALIPFVY

SEQ ID NO: 81839 - protein, 408 aa, Bordetella bronchiseptica RB50
MSSNEQTRRGFLADRVLGAKPSATKEMTRLANQLRQEGRDVIALSQGEPDFPTPEHVREAAKAAIDQGESRYTEVAGTLALREAVARKFERDNGLAYSPEQIQVGCGAKQILYNALQATINPGDEVVVPTPAWVSYPEMVLLAGGQPVIVRCGASSGFKLSPRQLEESITPRTKWLMLNSPSNPSGAVYSAEELAALAEVLARHPQVWVMADDIYEKIRYDDTPFATPAAIAPELAARTLTINGVSKAYAMTGWRVGFGAGPAALIKAMNLVQSQSTSHTSSISQAASIAALDGPMDFLPAFVAAFRRRRDSVVARLNAIEGLACDLPPGAFYAFPGCQALLGRRDPSGTLVSTDLDFALYLLREAGVAIVPGSAFGLSGHFRVSYAASDEQLAQAMARIAAACARLS

SEQ ID NO: 81840 - protein, 243 aa, Triticum aestivum
MLAWCGMQAVGFQGDVRNQKDAARVLASTVEHFGKLDILVNGAAGNFLASPEDLTPKGFRTVLEIDTVGTYTMCYEALRYLKKGGPGRGPSTGGLIINISATLHYTASWYQIHVSAAKAGVDSITRTLALEWGTDYEIRVNGIAPGPIGGTPGLRKLAPDEMGKGKREMMPLFKLGETRDIAMAALYLASDAGKYVNGTTLVVDGGLWLSHPRHIPKEEVKELSKVIEKKVRASGVGVPSSKL

SEQ ID NO: 81841 - protein, 491 aa, Salmonella enterica subsp. arizonae serovar 62:z4,z23:--
MNTQYNSRYIFSITLVATLGGLLFGYDTAVISGTVESLNTVFVAPQQLSESAANSLLGFCVASALIGCIIGGAIGGYCSNRFGRRDSLKIAALLFFISGVGSAWPELGFTTINPDNAVPVYLAGYVPEFVIYRIIGGIGVGLASMLSPMYIAELAPAHIRGKLVSFNQFAIIFGQLLVYCVNYFIAKSGDATWLNSNGWRYMFASECIPALLFLLLLYTVPESPRWLMARGRNDQAENILRKIMGTSLAALAVQEINLSLQHGRKTGGRLLMFGAGVIAIGVMLSVFQQFVGINVVLYYAPEVFKTLGASTDVALLQTIIVGVINLSFTVLAIMTVDKFGRKPLQIIGALGMALGMFSLGTAFYTQAPGIVALLSMLFYVAAFAMSWGPVCWVLLAEIFPNAIRGKALAIAVAAQWLANYFVSWTFPMMDKNSWLVAHFHNGFSYWIYGVMGVLAAVFMWKFVPETKGKTLEELEELWTPAEEKAPKAAIQ

SEQ ID NO: 81842 - protein, 319 aa, Citrus sinensis
MENFPVISLENINGAERAAILEKINEACEKWGFFELVNHGIEPEFMDTVERLTKAHYRKCMEQRFKELVASRALEGIQTEVNDMDWESTFYVRHLPQSTINEVPDLDEEYRKVMKEFALKLEKLAEELLDLLCENLGIEKGYLKKVFHGANGPTFGTKVSNYPPCPKPDLIKGLRAHTDAGGIILLFQDDKVSGLQLLKDGQWIDVPPLRHSIVVNLGDQIEVITNGKYKSVEHRVVSQTDGEGRMSLASFYNPGSDAVIYPAPALLEKEAEKKQVYPKFVFEDYMKLYVPLKFQAKEPRFEAMKAVETNVNLGPIATA

SEQ ID NO: 81843 - protein, 374 aa, Kineococcus radiotolerans SRS30216
MKRTLTIRGAVLEEVGRARPFADSRPVTISELDLDPPGPGEVLVRIEAAGLCHSDLSVVDGNRVRPVPMLLGHEAAGIIEALGAGVEDVELGQRVVMTFLPRCGRCAGCRTEGKLPCLPGSAANGAGELLGGGLRLRRDGQPVKHHLGISAFATHAVVDRRSIVPVEADVPPAVAALLGCAVLTGGGAVLNAGRPQEGDDVIVVGLGGVGMAAVMTAASLGTGRVIGVDTVAAKLTAARAAGASQALTPQEALAEGLRAPVVVEAAGNVRAFETAVQLTAPGGTTVTVGLPAPGARAQIEPLGLTAEARTIVGSYLGSAVPARDIPTYVQLWRQGRLPVEQLVSATIRLEDVNEAMDTLADGLAVRQLIVPEPG

SEQ ID NO: 81844 - protein, 141 aa, Vibrio parahaemolyticus RIMD 2210633
MALERTFSIVKPDAVERNLIGEIYNRIEKAGLRIIAAKMVHLTEEQASGFYAEHEGKEFFQPLKEFMTSGPIMVQVLEGENAIARYRELMGKTNPEEAAAGTLRADYALSMRHNSVHGSDSPESAAREIEFFFPESEICPR

SEQ ID NO: 81845 - protein, 481 aa, Rubrobacter xylanophilus DSM 9941
MAQLLVGGERVSARGGGEMPVVNPATEEVVDTVPKGTAEDVEAAVAAAKGALAEWSGKDPDERAAIMRAGIGAVKERGREIAELLVREQGKPLSEAMGELHHFIHGMDFYADLASKVRGAYAPLPSSLGKSYGMVIKRPVGVCAAIVPFNFPLTLMGTKVGPALAGGNTVVVKPAETTPLATLRVAELFAEAGLPAGVFNVVTGEGPEVGEALVAHPDVRRVAFTGSTEVGRRIMELAGPQFKRVSVELGGSDPVIVCPDADVDAAVKGVNIGRFFNAGQACLAAKRVYVFDEVYDEFMEGLIKRVSRYELGDGLTKAEKPKIRMGPMNSARYRDQVASQLEEALGRGARVVYQGEWGGEKGYFFPPAVIEGAPHDSRVVREETFGPLLPVFRVGDLDEALRLANDSRYGLGSSIWTRNIRWIHRAAQEIEAGMTWVNQLHYGYDELPFGGVKDSGVGREHGPEALEYYLESKSVVIGGLD

SEQ ID NO: 81846 - protein, 183 aa, Rubrobacter xylanophilus DSM 9941
MAHLYPFEGKEPRVAPGAFVAPTAVLIGDVVVEEEASVWFGAVLRADFNRIVIGRGSAVQDNCVIHTAEDRPTLVGAGATVGHMAMLEGCTVEEGALVGMGAVVLRRARVGARAMLAAGTVVREGQEIPAGVLAAGVPARVKKELGGSSGDWVEGAAREYRALRLRYMRELGALAGEPGKGGM

SEQ ID NO: 81847 - protein, 193 aa, Oryza sativa
  misc_feature (71)..(71): Xaa can be any naturally occurring amino acid
  misc_feature (85)..(85): Xaa can be any naturally occurring amino acid
  misc_feature (107)..(107): Xaa can be any naturally occurring amino acid
CSGGDVYGARASRTSTATSRRTPPRKHWICIEDKFRAAGDYVSQKSSSVFGKKKVEPMVKDAAAPGKGGRXSGGSRISVKGARIXHNQLETSVNPLRYSMVEFLELXDLIDQLKMESSNAQPQDSAYSVPKNPSMTCCRKRTDGATFLEDLKDHIEEFIHASMDEHKTCFKHHPKDVWDVKGCRGAFGGCQGS

SEQ ID NO: 81848 - protein, 312 aa, Streptomyces venezuelae
MHGSHYVRSLLDGAYGGDGTDTVTVLDKLTYAGNRDNLPASHERLTFVRGDICDLPLLLDLLPGHDAVVHFAAESHVDRSLESAAEFVRTNVLGTQTVLEAALRTGVQRLVHVSTDEVYGTIDEGSWTEDFPLLPNSPYAASKASSDLVARSYWRTHGLDLSITRCSNNYGPYQHPEKLIPRFVTNLLEGHPVPVYGDGRNVREWLHVDDHCRAIHLVLPPAGRARRTTSASGNELTNLDLTERILDLCGADRSMIRYVEDRKGHDLRYSLSDAKIREELGYTPRTSFEDGLRRTVDWYRDNPQWWKAGKEK

SEQ ID NO: 81849 - protein, 192 aa, Arabidopsis thaliana
MFAVENGLQGDPRLKAISDAIRVIPHFPKTGIMFQDITTMLLDPVAFKHVVDIFVDRYKHMNISLVAGVEARGFIFGPPIALAIGAKFVPLRKPGKLPGRVISEEYELEYGRDCLEMSVEAVKSEERALIIDDLVATGGTLSASINLLERAGAEVVECACVVGLPKFKGQCKLKGKPLYVLVEPNQFDELTL

SEQ ID NO: 81850 - protein, 362 aa, Brassica napus
LPIGIGLALFLCCSVYMMVSIVIVGLVPYYAMDPDTPISSAFASHDMQWAVYLITLGAVMALCSALMGALLPQPRILMAMARDGLLPSLFSDVNRRTQVPVKATIATGLCAATLAFFMDVSQLAGMVSVGTLLAFTMVAISVLILRYVPPDELPLPASLQDRIDSVSFIPGETKSSHHVGTSDDSNKQPLIGDNDDSVQFPVIEKQEALGCWVLSEKKRRIVAGWSIMLTCIGAFLLSYSASSLNFPGFIRYPLCGVSGSLLLAGLIALSSIDQDDARHTFGHSVDPRVRPVPRPRVLCILINMYLLVNLGSATWARVSVWLVIGVLVYVFYGRKHSSLANAVYVTTAHAEEIYREHEASLA

SEQ ID NO: 81851 - protein, 456 aa, Salmonella typhimurium LT2
MESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKVFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRILVFYVGTLFVIMSIYPWNQVGTNGSPFVLTFQHMGITFAASILNFVVLTASLSAINSDVFGVGRMLHGMAEQGSAPKVFAKTSRRGIPWVTVLVMTIALLFAVYLNYIMPENVFLVIASLATFATVWVWIMILLSQIAFRRRLPPEEVKALKFKVPGGVVTTIAGLIFLVFIIALIGYHPDTRISLYVGFAWIVLLLIGWIFKRRRDRQLAQA

SEQ ID NO: 81852 - protein, 200 aa, Zea mays
  misc_feature (173)..(173): Xaa can be any naturally occurring amino acid
MASHLDFRYLDEGLGGERGKRKRREEEADAADSMDLDADAPRSSKLRAVASQSDPSKPAAFGSPTYDGVIAGRVSGRTWKEPRTRRSSALMVSRKPVPLEQRARDKSLKKAYQARVAELKDEIRQNKVAKRKQKEEREKRKKENVLRTGSKLQKVTNPKTIQKIAKSKNRGQXSGVVSDDIFGGKKSEAARRMQVPGLEN

SEQ ID NO: 81853 - protein, 710 aa, Oryza sativa Japonica Group
MEAAALSTVLCVLALVVADADHHVVHVQGRRHRQCQPFSCGHLSNITHPFRRRGDPRRCGVSSYELDCSSDDGKATIRINTGKYYVSSIDYTASIFWVVDANLQDDANSSCPLPRSDQLPYVGLGIPGSHDSWDLGLDDMITWVGFVNCSQELITNSSSKYQPMNCLTTTSSYVYYMLPSFGAPSIQDIEPSCGYLAMTPIGGGSNGNSINLSEYEDVVKSMRGGFAVKFPTYGGPWTTWYGLIKDCLNESVSLADSHDNPLPRVGIKDRIIDILSIDLRFWGCMIGISRRYYLDMRLSISDMIRGVDHSLYHKLFIIYTLCLVKWIAVLCRFVFAPLVVMIFLTRKYWKTRIAIDAVEKFLRMQDMLGPKRYAYTDIIAITSHFRDKLGQGGYGSVYKGVFLPGDVHVAIKMLDGNSNCNGEDFISEVATIGRIHHINVVRLVGFCSEEMRRALVYEYMPRGSLNKYIFSSERSFSWDKLNEIALGIARGINYLHQGCEMQILHFDIKPDNILLDDNFVPKVADFGLAKLYPREKSFVSDRALRGTVGYMAPEMVSRSFGVISDKSDVYSFGMLLLEMAGGRRNADPNANSNASRAYYPAWVYDQLIADQQVDEISNVADMHELERKLCLVGLWCIQMKSHDRLTMSEAIEMLEGGVDALQVPPRPFFCDGDGIGNGMPPPQVMDSYFHSSELTAISEEDDGISELASS

SEQ ID NO: 81854 - protein, 885 aa, Vibrio vulnificus YJ016
MLSLIEQIRTGTLWDFPGGVHPAENKRQSNQQPLVHAALANEIVLPLKQHIGKPGNILVNVGDHVLKGQLLTQSNAGFTLPIHASTSGTITAIETRTVAHPSGLSEMCVVITPDGQDTWCEKQPVIDYSQQSSDYLLDVIRMAGISGMGGAGFPTAKKIQSGLGRTEILIVNAAECEPYITADDKLLQEHAEEVLQGIEIVEHILQPKLTIIGIEDNKPEAIKALESAAQNRDIVIRVIPTKYPSGGEKQLIKVLTNKEVPAGGIPADIGILVQNVGSLYAIKRAVMDGEPMVNRVVTLTGNTFETPRNVWVPLGTPVHALLEQFGYQADKKLPRLIMGGPMMGFSLPHANVPITKTSNCILAPTRKEISPAGYEMECIRCGACAEACPASLLPQQLQWHAKAEEFDKCEELNLKDCIECGACAFVCPSEIPLVSYYRQAKAEIRTRAQEADAAERAKLRFEEKKARMEREKEERENRFKKAAEDRRKEMKSTGGDDAIAAAIARVKAQKTQDSEQAPSVKPAVAAAIAKAKAKQAAAADSGSSEPDNSEMVKLREERKRLARERKAEKEQSKTPNSEEQGDKKSAVAAAIARAKAKKAQQTDESAPEQNREESQAAEDDPKKAAVAAAIARAKARKAQQTSEPAPEQNREESQPAEDDPKKAAVAAAIARAKARKAQQTDESAPEQNREESQPADDDPKKAAVAAAIARAKARKAQQTDEPAPEQNREELQPTEDDPKKAAVAAAIARAKARKAQQTDEPAPEQNREELQPTEDDPKKAAVAAAIARAKARKAQQTSEPAPEQNREESQPAEDDPKKAAVAAAIARAKARKAQQTDEPAPEQNREESQPAEDDPKKAAVAAAIARAKARKAQQAEQKQNTEENE

SEQ ID NO: 81855 - protein, 498 aa, Xanthobacter autotrophicus Py2
MREIGHFIGGKHVPGTSGRYADVYQPMTGEVIAHVALASTDELNAAVANAKAAQPAWAATNPQRRARVLMKFLELVQRDYDKLADLLAREHGKTVPDARGDIQRGLEVVEFAVGIPHLMKGDYSDGAGPGIDIYSMRQALGVVAGITPFNFPAMIPMWKFGPAIACGNAFILKPSERDPGVPMMLAELMLEAGLPPGILNVVNGDKESVDGILDHPDIQAIGFVGSTAIAQYIYARGAANGKRVQGFGGAKNHMIIMPDADMDQAVDALIGAGYGSAGERCMAISVAVPVGEDAAERLLEKLVPRVENLKIGPSTDGAADFGPLVTREAVDRVKNYVDIGLQEGAKLLVDGRGFKMQGYENGFYMGGCLFDHVTADMRIYKEEIFGPVLSVVRAPDYKEALRLPTEHEYGNGVAIFTRDGDAARDFASKVNVGMVGINVPIPVPLAYHTFGGWKRSGFGDLNQHGPDGVRFYTKTKTVTSRWPSGIKDGADFVIPTMG

SEQ ID NO: 81856 - protein, 172 aa, Glycine max
  misc_feature (111)..(111): Xaa can be any naturally occurring amino acid
  misc_feature (119)..(119): Xaa can be any naturally occurring amino acid
  misc_feature (130)..(130): Xaa can be any naturally occurring amino acid
  misc_feature (140)..(140): Xaa can be any naturally occurring amino acid
  misc_feature (155)..(155): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLTKGWIPCLEFEFGAPVFVYREXHNRSPRYXMDAYWNLWKAXPMLGATESSXGVKGTSEAKNAYPNXGFIRIIGFETVAQGEGI

SEQ ID NO: 81857 - protein, 378 aa, Oryza sativa
  misc_feature (366)..(366): Xaa can be any naturally occurring amino acid
MATGKVIKCKAAVAWEAGEALSIEEVEVAPPQRMEVRVKILYTALCHTDVYFWEAKGQTPVFPRILGHEAGGIVESVGEGVTELAAGDHVLPVFTGECKECDHCKSEESNMCDLLRINVDRGVMIGDGKSRFTIKGKPIFHFVGTSTFSEYTVIHVGCLAKINPEAPLDKVCILSCGFSSRFGATVNVAKPKKGQTVAIFGLGAVGLAAMEGARLSGASRIIGVDLNPAKFEQAKKFGCTDFVNPKDHSKPVQVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKXGESLRCVMRMDE

SEQ ID NO: 81858 - protein, 466 aa, Zea mays
MASAAAGAPKRCYYEVLGLSRDCSPTDIKLAFRRLALSLHPDKQPPGSDLALATAAFQELQHAHSVLSDPQERAYYDSHRSQIIFSHPASAGAKSASTVPDLFAFFSSSAFSGFSDTGRGFYKVYGDVFDRVFAQELAYARRMGVPEPAAPPVIGNLDSPYAQVTAFYSYWLGFGSGMDFGWAAAWDAARGESRRVRRLMEEDNKKAMRKARREYNDAVRGLAAFCKKRDKRVVDMVLKKKLEEEKRKAEEKERRKEEDKRKKERAMAYQEHEWARAEEGLYDEDEEEEMRAKKELLYCAACNKKFKSDKQWKNHEQSKKHRNKIAELRKTFREEESLKKAEEGEGDWNEVDMGFDFKPTQESDDASAFSDAAEELAEEFESNYAGNGHHGKCEVQPEGSVHVNDVDDIMEGPSSSNVNNGAVIMVLQLPSPLPVLCCSRRNKLFSHLEETGHAMLKSLVGSAWFS

SEQ ID NO: 81859 - protein, 850 aa, Candida glabrata CBS 138
MKVSDGSKEVVCRERKLSSESRTSSESFSFLRRSNSSRSLLDDILSSSSSTSVKKNLKSVKKMAPFLNYKDLGESIGAITYPYSMAPWVPNLLEVDNSGIKLDSDLERVMGVMREGVVLKKVTRKKQREYMFKLEKNKYITWKDGLKKLNLDSIKSIRPGELGSNYREEYNVDASYSKYWVTIIYKVSNKLKALHVIARDESDYNVFCSLVFGLVRTRRELMESLAVPDHDKFADIHWNRALSRNPDEKAEEVLGFEDVRQMCQRFHIYCSAGYLRRFFDAADTNNSGTLSFEEFQVFVKLLKARKEIDDVWQEAVGLHEDKLTFDTFYKFLTEIQRERMDEDEARHLYERYETAGGGINKQGFEKYLTTSPYMLPNNEDYSRPMNQYYIASSHNTYLTGKQIGGAPSVEGYIQALQQGCRSVEIDMWDGESSPVVCHGVLTSALPLSSVTQIIRKYAFITSPYPLIISMEVRCNSKNQRIAASIFKDTFGDLLYTCEDRSELPSPLELRHRILLKIKKTKTVIGDCHSDKSMNVVVSSSSSSRSSYDESTAMTKTGSRIRRLSFSKRQVAIVDELYELAGLRGVKFRNFSLPESKTLYHCFSLDERRLDKMLGDAQVAAAVDKHNRRHMMRVYPHALRYRSTNFEDPVRFWRLGVQMVATNWQTNDVGHQLNVAMFQLNTRNQQQMPSGYVLKPGWLARPPSKRRRERCGAVLRVTFEVISAQLLPNLSESTETKSQAASIGAAETEDPYYTQVTCEMFSCGSTVEKSSKCHENGFSPVWRSALSQDVRRDEYPFVFVRVVVRRCEEVVATTCVRVCQLREGYRHIPLCSPDGEQYVFSTLFVRYRVTV

SEQ ID NO: 81860 - protein, 549 aa, Salmonella enterica subsp. arizonae serovar 62:z4,z23:--
MKNINPTQTSAWQALQKHYDEMKDVTIAELFAKDSDRFAKFSATFDDLMLVDFSKNRITEETLAKLQDLAKETDLAGAIKSMFSGEKINRTEDRAVLHVALRNRSNTPIIVDDKDVMPEVNAVLEKMKTFSEAIISGQWKGYTGKAITDVVNIGIGGSDLGPFMVTEALRPYKNHLNMHFVSNVDGTHIAEVLKKVNPETTLFLVASKTFTTQETMTNAHSARDWFLKTAGDEKHVAKHFAALSTNAKAVGEFGIDTANMFEFWDWVGGRYSLWSAIGLSIILSVGFDNFVELLSGAHAMDKHFSTTPAEKNLPVLLALIGIWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHQKLLSNFFAQTEALAFGKSREVVEQEYRDQGKDPAQLEHVVPFKVFEGNRPTNSILLREITPYSLGALIALYEHKIFTQGAILNIFTFDQWGVELGKQLANRILPELGDDKAISSHDSSTNGLINRYKAWRA

SEQ ID NO: 81861 - protein, 449 aa, Salmonella enterica subsp. arizonae serovar 62:z4,z23:--
MTEIVVSKFGGTSVADFDAMNRSADIVLSDANVRLVVLSASAGITNLLVALAEGLEPSERFATLDAIRKIQFDIIERLRHPNVIREEIERLLENITILAEAASLATSAALTDELVSHGELMSTLLFVEILRERDVQAHWFDVRKVMRTSDRFGRAEPDVAALAELAAQQLLPRLNETLVITQGFIGGESKGRTTTLGRGGSDYTAALLAEALHAARVDIWTDVPGIYTTDPRVVSVAQRIAEIDFEEAAEMATFGAKVLHPATLLPAVRSDIPVFVGSSKDPKAGGTLVCNKTQNPPLFRALALRRNQTLLTLHSLNMLHSRGFLAEVFGILARHNISVDLITTSEVSIALTLDTTGSTSTGDTLLTQSLLMELSALCRVEVEEGLALIALIGNNLSKACGVGKEVFGVLEPFNIRMICYGASSHNLCFLVPGEDAEQVVQKLHHNLFE

SEQ ID NO: 81862 - protein, 368 aa, Rubrobacter xylanophilus DSM 9941
MRITAAVAREKERPFSVEELELEGPRAGEVLVRVVATGMCHTDLICRDQWYPVPLPCVLGHEGAGVVEEVGEGVTKVEPGDRVVLTFASCGKCATCLRGKPSYCLNFFALNFGGARLDGSSPISADGASVHGHFFGQSSFATHALATERNVVKVPGDAPLEILGPLGCGVQTGAGAVLNTLHPEAGSSIVVFGTGAVGLSAIMAARIAGCTTIVGVDVRPGRLELARELGATHALNGAETDAVKAVKEITGGGADFSLETTAVPAVLRQAIDALGPLGTCGVIGAARLGTEAAFDMNDVLVPGKTIRGIVEGDSVPDVFIPRLVKLHAQGRFPLDRLVRFYDLGDINEAARDAEEGGAVKPVLRVGRG

SEQ ID NO: 81863 - protein, 410 aa, Streptococcus agalactiae NEM316
MTLLDSYKLKQDFPILNQLVNDEPLIYLDNAATTQKPNQVLETLRAYYQNDNANVHRGVHTLAERATAQYETAREKARQFLNAKSSKEILFTRGTTTGLNWVAKFAESILERGDEVLISIMEHHSNIIPWQQACERTGAKLVYAYLKDGSLDLEDFYNKLSSKTKFVSLAHISNVLGCITPVKAIAERVHQVGAYMVVDGAQSAPHMAIDVQDLDCDFFALSGHKMLGPTGIGVLYGKESILDKMPPVEFGGEMIDFVYEQSATWKELPWKFEAGTPNIAGAIAFGEALDYLTDVGMDEIHQYEQSLVSYVLPKLQAIDGLTIYGPSDAESHVGVIAFNLEGLHPHDVATAMDYEGVAVRAGHHCAQPLINHLGIHSAVRASFYFYNTKEDCDKLVDAIQKTKEFFNGTL

SEQ ID NO: 81864 - protein, 326 aa, Kineococcus radiotolerans SRS30216
MPRTRPDINVPALVGRHAVVTGASDGVGLALATRLAAAGADLTLPVRNQVKGRAALAAIRRAVPGARVVMADLDLSSLASVAAFGARMQEEGKAIHLLVNNAGVMTPPQRQSTVDGFELQFGTNHLGHVALVAHLLPLLRAGRARVTSQVSVAARSGRVNFEDPNWRDAYHGMKAYSSSMIAFGLFGLELERRSRAQGWGITSNLSHPGIAPTSLLAARPEVGRSADTTQVRRIRTLSRWGLVGTVETALLPALMAATSQESEGGKLYGPRGPGHLSGGPSEQKLYRPLRSTADAAHVWEISEALTGVSFPRSAADVLLAGQEKAS

SEQ ID NO: 81865 - protein, 461 aa, Rubrobacter xylanophilus DSM 9941
MVDPATGEEVDSVPVCGEAEVDAAVRGAAGAFPGWSGTPASRRGELLARAAEAVLGARDELAGLLTAEQGKPLREARLEIRRFVHTLEHYAGLAKNIRGGYVPDLDEGAYGLILRRPVGVVGAIVPWNFPTTLLANKLGPALVAGNVVVAKPAETTPLTTLRIAEIMHGAGLPAGVFNVVTGDGPTTGQALAGHPSVRKVAFTGSTPVGKKLAALAAGDLKRVTLELGGSDPMIVCDDADLDRAASAASVGRFFNCGQACLAVKRLYVFESVAEEFVEKLVGKAKRLRVGPGRAEGTIIGPLHTPEGRELLEGQVRDAVESGARVLAGGRRPEGEVFERGNFYEPTLLLEPSHESRVATEEVFGPALPIWRVGDLEEAIERANGSIYGLGSSVWTADLDRATEAAERIEAGYTWINSPQVIYDELPFGGWKQSGYGKEHGMEAIEYYTETKSVVVRRAYQG

SEQ ID NO: 81866 - protein, 345 aa, Cryptococcus neoformans var. neoformans JEC21
MSTPAYLTKLESIPKEKFLFGPSPISYLPNLTAVLGGKVKLYAKREDCNSGLAYGGNKVRKLEYLVADAKAKGCNTLVSVGGVQSNHTRAVTAVAVASGLKAVTVQEKWVPIDPPLYSETGNILLSRLMGGDVRLNQETFDIRHKKATEDAFKDVEAKGGKPYYIPAGASDHPLGGLGFTNWVVELAKQEKELGVFFDVVIVCSVTGSSHAGTVVGAVAEGRKRKIIGIDASGKPEATRNQVLKIARNTAALLDERLEIKEEDVILDDRFHAGIYGIPDDETIAAMKLAAQTDAFITDPVYEGKSMAGMIRLVKEGAIKEGSNVLYIHLGGQPALNAYSSYFPHA

SEQ ID NO: 81867 - protein, 308 aa, Agrobacterium tumefaciens str. C58
MILCCGEALIDMLPRQTTLGEAGFAPYAGGAVFNTAIALGRLGVPSAFFTGLSDDMMGDILRETLRASKVDFSYCATLSRPTTIAFVKLVDGHATYAFYDENTAGRMITEAELPALGADCEALHFGAISLIPEPCGSTYEALMTREHETRVISLDPNIRPGFIQNKQSHMARIRRMAAMSDIVKFSDEDLAWFGLEGDEDTLARHWLHHGAKLVVVTRGAKGAVGYSANLKVEVASERVEVVDTVGAGDTFDAGILASLKMQGLLTKAQVASLSEEQIRKALALGAKAAAVTVSRAGANPPFAHEIGL

SEQ ID NO: 81868 - protein, 448 aa, Rubrobacter xylanophilus DSM 9941
MAERFDAVVLGMGPGGEVAASRLISGGKRVAVVEKELIGGECAYWACIPSKTLLRPPEVRGEARRAFGTGVPELEMEAIFDYRDYMIRNLDDAAQVEGYERQGATVVKGAGKIVGPGKVEADGETIEAGHIVVATGSAPNVPPVEGLDEITVWTNREVTTSREVPRRALIVGGGPNGIEAAQWLSRFGSEVTIVQSADRLIDREDPRVGELIRGALEGEGIRVLTGRKAARARRDGEGAVVELDDGAEVGTDVVVIAAGRRPRTEGLGLETVGIEPDGGAIPVDDRCRAAEGVWAIGDATGVALFTHVAKYQGRVAADNILGRERRADYRGIPRVVFSDPEIAACGLTEEQARREGMATATATLDLSRAIARPYTYEEDPRGTLSLVADRKRGVLVGAWAVAPLAGEWIHEAALAIRAEVPIEKLLDSVAQFPTYSEAYLYCLERLDL

SEQ ID NO: 81869 - protein, 156 aa, Photobacterium leiognathi
MNIIEGAITAPHANVAIIVSRFNSFINDSLLSGALDALQRQGLVKESNITVVRCPGAYELPLLAQQLAKKGSYDAIIALGSVIRGGTPHFEYVAGECNKGLAQIALEHQIPVAFGVLTVDSIEQAIERAGTKMGNKGAEAALSALEMINVLAEIEP

SEQ ID NO: 81870 - protein, 326 aa, Lactococcus lactis
MTVLVLGGAGYVGSHAVDMLLKRGYDVAVVDNLVTGHRESVPANVRFYEGDVRDHAFLASVFEKENIEGIMHFCAYSLVGESMQKPLMYFNNNVGGAQVILETMEEFGVKHIVFSSTAATFGIPEKSPISEKTPQKPINPYGESKLIMEKMMKWQSQATDMTYVALRYFNVAGAKDDGSIGEAHKNETHLIPIILQTALGQREFITIYGDDYHTPDGTCIRDYIDMEDLIEAHIKALEYLKAGGQSDQFNLGSSKGYSNLEVLETARKVTGKEIPSQMGERRAGDPDELVADSTKAGEILGWKAQNDLEHIITNAWKWHQSHPKGY

SEQ ID NO: 81871 - protein, 286 aa, Triticum aestivum
PDVRGLIHAALRLGYRHLDCAADYQNEAEVGDALAEAFQTGLVKREDLFITTKLWNSDHGHVLEACKDSLKKLQLDYLDLYLIHFPVATRHTGVGTTSSALGDDGVLDIDTTISLETTWHAMEELVSMGLVRSIGISNYDIFLTRDCLAYAKIKPAVNQIEVHPYFQRDSLVKFCQKHGICVTAHTPLGGSTANTEWFGSVSCLDDPVIKSLAEKYGKTPAQLVLRWGLQRNTVVIPKTSKLERLQENFEVFDFDISGEDMEKMKAVDRKYRTNQPAKFWGIDLFA

SEQ ID NO: 81872 - protein, 267 aa, Escherichia coli
MHPMLNIAVRAARKAGNLIAKNYETPDAVEASQKGSNDFVTNVDKAAEAVIIDTIRKSYPQHTIITEESGELEGTDQDVQWVIDPLDGTTNFIKRLPHFAVSIAVRIKGRTEVAVVYDPMRNELFTATRGQGAQLNGYRLRGSTARDLDGTILATGFPFKAKQYATTYINIVGKLFNECADFRATGSAALDLAYVAAGRVDGFFEIGLRPWDFAAGELLVREAGGIVSDFTGGHNYMLTGNIVAGNPRVVKAMLANMRDELSDALKR

SEQ ID NO: 81873 - protein, 570 aa, Oryza sativa Japonica Group
MELFYELLLTAAASLLVAFLLARLLASAATASDPRRRAPDHAAVIAEEEAVVVEEERIIEVDEVEVKSARARECVVSEGWVEVGRASSAEGKLECLPEEEEAPAKAARELVLDAVLEEREEEGQVGEERCDLAAAVAEVVGVKPHELGVEAAPGEVSDVTLEEGKVQDVGVEQHDLVAEAAPREALDTGLEKQGVPIIEAVEIKRQDDLGAEVAPSDVPEVEFEQQGVRIIEAIDVNQHHRVALAAPAEVVDAGLEERVQAIEAGSSGLTSETVPEEVLDELSEKQEEQVIEEKEHQLAAATAPVAIPGVALAETEELKEEQSSEKAVNVHEEVQSKDEAKCKLHLVDQQEGSASKVELVGRNTDNVEISHGSSSGDKMIAELTEEELTLQGVPADETQTDMEFGEWEGIERTEIEKRFGVAAAFASSDAGMAALSKLDSDVQLQLQGLLKVAIDGPCYDSTQPLTLRPSSRAKWAAWQKLGNMYPETAMERYMNLLSEAIPGWMGDNISGTKEHEAGDDAVGSVLTMTSNTINQHDSQGNEDNTGMYEGHLTSSPNPEKGIGADHNACI

SEQ ID NO: 81874 - protein, 293 aa, Candida glabrata CBS 138
MDSDLEIQNKTQVEHVDKMGDSDVPESVSNSANMLRSRFNIGPDSVRNHVIAFMGELCGTFMFLWCAYVIANIANHDVSLKDSPPHGSHPGQLIMIALGFGFSVMFSIWCFVGVSGGALNPAVSLSLALARAITPTRCVVMWIAQILGGMAAGGAASAMTPGPVKFDNGLGLGCSRTRGLFLEMFGTAILCLTVLMTAVEKGESNFMCALPIGISLFIGHLALTAYTGTGVNPARSFGAALAKRYFPHYHWIYWIGPLLGAILAWFVWQVLQWLDYANYVAREKEAAEKAKTH

SEQ ID NO: 81875 - protein, 952 aa, Ustilago maydis 521
MVKEVSSAVEFDAELNAAGSKLVVVDFHATWCGPCKVIAPIFQRLASQYTSVVFLKVDVDRVQPVAQRYSVCAMPTFLFLKNKSVVDTLQGADPNRLTALVKQHSSGASLAFSGSGQTLSGGSSSSSSSFGARVAGITDGHSSLLNTVEPKRSSALNEKPNHRLQDILGGPTGGKWLESDADEQLLIHFTFKQQVKLSGILLRTLPSQLAHAPKEIKIFANRPGLSFDDATADKGDQEAELSEDFVRGGENGGGGKALSLRFVKFQKVDSLTIAVLTNQSDAETTRIDAIDLYGVADQTTDMSELQKIAAEGGDRDFDFRTASKTGLKGGSSSRSARTGFHGPRSSSIPDMSTPAEPPLRPARSHSTSSLNSALPRYRRTTSSTSVPPMQHVDEEDGNDYADDGNYSRHSQPQTAFVPQAPPSLSEEEQAEFEAAQKAASETLGGWHYAPLAVALAPPLGSLLGGHSDAWSDAILLILASFWLYQFLRVPWEIYYASRTRSILTHDQDQDEIEHAEQVTLDGSPSSAPESSETGVQKEVRRAAAAELRRSELLSLVFCMLSPIMGAYMLHWMRETMTDGNKYLNTFNIRLFTLAAGIKPWSHAMSLVRRRMLHLQEEVHYPSSKVEKMNQRLRRLEADLSSLRKLYATKTELRLLREHDAELGRALRRSERKEEHLRLSAEEKFSIVEGRLEDLLREVAINAELIEEERRERERAASLRISLFEAIKYLLGSGLTIRRASPKHYLHDMPRSLPSTASLGIGAQSAEADLNMEAHTPGAPLPASVPIVSPTRPPRTIASATPDRPSSSSRGLASIQSEQPAAANVVNRPDHPKVGAVVERSRSRNNAHHISDPWWERGAAFYLFLPLNVSSAAVRFAGEKVKHILEDSENEAARNQRKTLQYQKHLADQQLQQHQRKISQKQYQHQPMLSPTRNRADASTIKIASASANPRTR

SEQ ID NO: 81876 - protein, 297 aa, Zymomonas mobilis subsp. mobilis ZM4
MNDQSSASVANEAAFLIGKPLVTEERLHGGDISQVTRLWLEDGSHAVAKNSPFPEIEAAMLAAISQSGAPAPMVYATNENLLVMEWLRNRDVLHHAWDDLGKVIALLHSTEGALYGWPKDYGIGGIPMVNKWMRSWPDFWGEYRLRPHLEHISADLVDRLEELIEDLPQRLPMTPPAVLLHGDLWDGNILVDDGRISGLIDPCCYYGDAEVDIAMINLFDRASGSFYEAYETYHPLTPGYKERLPIYKLWPALIHLRIFGDRLSPLGHPSSKGCRGLTGGITAPAPESSSTRKRILL

SEQ ID NO: 81877 - protein, 531 aa, Candida glabrata CBS 138
MSKHLRNPVLRDIPTSASEWKYAICGRHKHEIYPIGASKANDDNHDNDNDNDNDSTEHKKGFQKYWPIITTGAGLFSDGYINNSISTVSTCLSLLYGKEYSESHAIRNISSIVFAGTVCGMLIFGYLADHHSRKFSMLLGTSMLILFTILCAGAWGKGTTNTHAGGLFAALTAYRFFLGIAIGSEYSSSSPAAAEASNLLPRGKRNRYFIWFTNTMIDFGFVIGAFVPLVLLWICGSHHLTPVWRITIGLGAIPPCSLFVLRLFYKEGKKFRETRFNRKVPVWRIIKFYWFRVAIVSIIWFLYDFSSYAFGTYSSIIIGLVLPKDAPLYKNFGWNVVFNLFYMPGSIVGALLSDYFGPRLVISVGLIVQAAIGFALAGSLDHLKRHIVGFVFMYGVFITLGELSAGNNMGVVASKVNATPVRATLYGVAAMIGKVGAFVGTYVFPSLIKNHGLSSPYYVSSALCCFSALLAFLFLPDLDQDAMKREDDKFMEYLASTGYDLSTMGIQTDDESELSTISVKNSEINEKAFDK

SEQ ID NO: 81878 - protein, 276 aa, Oryza sativa Japonica Group
MSRPTQHHPTAAATAVILLLLAVSPAPSGADPDDERCLSSLQQSLSGLRNWSKASFSAPCEGFISHLQGVTCNNGRVYKLSLPGLSLAGTIPPDLSNCTNLQSLDLSSNALSGAIPPELSGLLNLAVLNLSANRLSGAIPRDLARCAYLNVIDLHANQLTGSIPDELGLLVRLSTFDVSYNRLSGPIPVLLANRSGTTGRFNATSFVGNKDLYGYPLPPMRGHALSVLAIVGIGLGSGLLSLVLSFSAVCLWLRATDRTATMPGEEGKISHLMPDY

SEQ ID NO: 81879 - protein, 226 aa, Zymomonas mobilis subsp. mobilis ZM4
MTNATSQNENLSPLAVVRAKIEKAAKIAGRNPDDIELIAISKLHPAEAALPLIAEGQRVFGENRVQEALGKWPPLIKAHPDIRLHCVGQLQSNKAKTAVELFDAIHSVDRPSLIEALGRAMESTEKKPECFIQVNIGEEDQKGGCDIADTKAILQQCRDAGLPVIGLMSVPPLEVDPAPYFALTVKMAHDLALPAVSIGMSADYELAITLGATHIRVGTALFGHRE

SEQ ID NO: 81880 - protein, 440 aa, Pseudomonas aeruginosa PAO1
MPAPLSPLIVRMRHAIEGCRPIQIRGRVTQVTGTLLKAVVPGVRIGELCQLRNPDQSLALLAEVIGFQQHQALLTPLGEMLGVSSNTEVSPTGGMHRVAVGEHLLGQVLDGLGRPFDGSPPAEPAAWYPVYRDAPQPMSRRLIERPLSLGVRAIDGLLTCGEGQRMGIFAAAGGGKSTLLASLVRNAEVDVTVLALVGERGREVREFIESDLGEQGLRRSVLVVATSDRPAMERAKAGFVATSIAEYFRDQGRRVLLLMDSLTRFARAQREIGLAAGEPPTRRGYPPSVFAALPRLMERAGQSERGSITALYTVLVEGDDMSEPVADETRSILDGHIVLSRKLAAANHYPAIDVLHSVSRVMNQIVDDDQRHAAGRLREWLAKYEEVELLLKIGEYQKGQDSEADRAIEKIGAIRQWLRQGTHETSDYAQACAQLRSLCA

SEQ ID NO: 81881 - protein, 230 aa, Solanum tuberosum
SRVDKFSKSDIIVSPSILSANFSKLGEQVKAIEQAGCDWIHVDVMDGRFVPNITIGPLVVDSLRPITDLPLDVHLMIVEPDQRVPDFIKAGADIVSVHCEQSSTIHLHRTINQIKSLGAKAGVVLNPGTPLTAIEYVLDAVDLVLIMSVNPGFGGQSFIESQVKKISDLRKICAERGLNPWIEVDGGVGPKNAYKVIEAGANALVAGSAVFGAPDYAEAIKGIKTSKRPE

SEQ ID NO: 81882 - protein, 517 aa, Vibrio parahaemolyticus RIMD 2210633
MTKNIHDQRILILDFGSQYTQLVARRVREIGVYCELWSWDVEEADIREFNPDGIILSGGPESVTEENSPRAPQYVFDSGVPVLGVCYGMQTMAEQLGGKVAGSNEREFGYAQVKVSGESAIFKDLEATQDVWMSHGDKVVEIPADFVKVGETDTCPYAAMANEEKKYYGVQFHPEVTHTKGGLQMLENFVLGVCGCERLWTSESIIEDAVARIKEQVGDDEVILGLSGGVDSSVVAMLVHRAIGDKLTCVFVDNGLLRLNEGQQVMDMFGDKFGLNIIKVDAEERFLEALKGKSDPEEKRKTIGHVFVDVFDEESKKLKNAKWLAQGTIYPDVIESAASKTGKAHVIKSHHNVGGLPDDMEMGLVEPLRELFKDEVRKIGLELGLPYNMLYRHPFPGPGLGVRVLGEIKKEYCDLLRRADAIFIEELHAADLYDKVSQAFTVFLPVRSVGVMGDGRKYDWVVSLRAVETIDFMTAHWAHLPYDFLGKVSNRIINEVEGISRVVYDISGKPPATIEWE

SEQ ID NO: 81883 - protein, 302 aa, Methanosarcina mazei Go1
MKKRYKNPEKSGSCGNFIQAIKMTDKVQPLESLSKKPEEPKIVVNLRRIKRKIMVMSGKGGVGKSTVAANLAVGLALRGHRVGLLDCDIHGPTVPTIFGLESARPGVSEEGILPIEVLPNLSVMSIGFLLENKDSPIIWRGPAKMGAIKQFLEEVFWGALDFLIIDLPPGTGDEPLSVAQLIPNCDGSVLVTTPQDVALISVRKSITFSEKLNVPIIGLVDNMHGLICPHCGKPIEVFGSGGVEKASKDFNIPILARLPIEPGVAEMEDRGTVVQDQLKHGTEWQKNFDNVVDAVEKILEKE

SEQ ID NO: 81884 - protein, 372 aa, Glycine max
MAPSLETSNGEAMHLKQVEEEQDGILFAMNMMSTMVYPFVVRTAIELGIFDIIAKAGEGAKLSAEEIIEQLGTKNPEAPTMLDRLLRLLASHSMLSSSLDTEDLQHGQNSPKRLYSLTYASKYFVTDADGVSFGATLNLLLDKVFLESWTELKGAILEGGVAFNRVHSMHSFEYPAVDPRFNDVFNKAMFNLTTIVMKRVLEFYEGFKNINRLVDVGGGLGINLNLITSKYPHVQGVNFDLPHVIEHAPTYPGIEHVGGDMFESVPNGDAIFMKWILHDWSDEQCLKLLKNCHKAIPSDGKVIVVDLILPILPESTVTAKSGFQADLLMMTQNSGGKERTQHEFMELALSSGFSGIKIVCSVSGFWVMEFYK

SEQ ID NO: 81885 - protein, 144 aa, Hyphomonas neptunium ATCC 15444
MIIEQILNDKGREVITLRADDTLREAARLLDERRIGAVVTLDADGEIVGVLSERDIVRQFARQGEGALDMPVGNAMTRAVITISADAEVDEALQLMTDRRIRHLPVVRNSRLTGFVSIGDLVKWKIAETQAEAEAMKSYLSSQF

SEQ ID NO: 81886 - protein, 131 aa, Oryza sativa Japonica Group
MPDLRLRSSALSRAPPPPPLQAPCSSPVCSYRSVQRRTGAREDNSTGRRQRWHSVLQRAENMVNAIKGLFISCDVPMAQFIVNLNASMPASDKFILHMLDPTHMFVQPHVAEMIRSKISEFRDQNSYEKPT

SEQ ID NO: 81887 - protein, 153 aa, Glycine max
EDGEKYYNQISNEESYKFDEETLVNLNNTEKRSKKTQSDVFSNEYSMFDQKGIKEGTKKIEEEKLLNEFGDEYIVITILVAAKGAHKLPNINGTEDLKEALQKLRTVLSSKLLAGKVLWTPQNEDDTLSKRRLLEDYPQLAKGMANFLVKKRE

SEQ ID NO: 81888 - protein, 211 aa, Vitis vinifera
MADQVLEGSQPVDLSKHPSGIIPTLQNIVSTVNLDCKLDLKAIALQARNAEYNPKRFAAVIMRIRDPKTTALIFASGKMVCTGAKSEHQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQWYVYLFFDYAT

SEQ ID NO: 81889 - protein, 468 aa, Escherichia coli CFT073
MIREPPEHILNRLPSSASALACSAHALNLIEKRTLDHEEMKALNREVIEYFKEHVNPGFLEYRKSVTAGGDYGAVEWQAGGLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMLTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 81890 - protein, 296 aa, Streptomyces rishiriensis
MRGILLAGGTGSRLWPVTRAVSKQLIPVFDKPMIYYPLTTLMMAGIREILVITRPEDQRQFRHLLGDGSQLGLCLEYAVQEKPEGIAQAFVLGADFIGDQSVALVLGDNIFHGAGLGTRLRQYSDPAGGRIFAYVVADPRAYAVVEFDEAGTAVSIEEKPASPKSRYAVPGLYFYDNRVLEVARDLMPSQRGELEITAVNETYLKWGQLRVTTLDRGAAWLDTGTFTSLVQASEYVRVVEERQGLKIGCVEEVAWRCGLIGNDQLRELSRPLLKSGYGRYLLDLLADQELKELKSS

SEQ ID NO: 81891 - protein, 436 aa, Physcomitrella patens subsp. patens
MEIGMPSLSPTMTQGNIAVWRKKEGDEVVAGDVLCEIETDKATLEMESMEDGFLGKILVKDGAKDIPVGQAICLMVDTKEELESIGDYKPSGGGGDSSPPPKKEESTPSPPPPPSKKQDKSEPTPSKPGHATPSPPSGGNRIFATPAARKFAEEKKLSLTSIEGTGPDGGIVKADVEAYLDQHVSGGAPPKGVAPIDDLSYTDIPNTQIRRITAKRLLQSKQTIPHYYLSLDIRVDKLLQLRGDLNASLDASKKKDAPTKKLSLNDFVIKAAALALQKVPEVNSTWTDEYIRQYHNVNISVAVQTEHGLMVPVVKDADKKGLATITEDVKTLAGKARSNTMKPSDYEGGTFTISNLGGPFGIKQFCAIINPPQAAILAVGTTEKRLVPGLTPDQYDVGTFMTVTMSCDHRVIDGAVGAQWLGAFKSYIEDPVTLML

SEQ ID NO: 81892 - protein, 491 aa, Vitis vinifera
MAMEKKTVVVDVEKRPKTKIVCTLGPACRSVPMLEKLLRAGMNVARFNFSHGSHEYHLETLSNLRAAMDSTGILCAVMLDTKGPEIRTGFLKDEKPIHLKQGQEITISTDYNIKGDEKMICMSYKKLAEDVKPDSVILCADGTITFTVLSCDKQKGLVCCRCENSAVLGERKNVNLPGVIVDLPTLTEKDKEDILNWGVPNKIDMIALSFVRKGSDLVEVRKLLGKHAKNILLMSKVENQEGVANFDEILANSDAFMVARGDLGMEIPIEKIFLAQKVMVYKCNIQGKPVVTATQMLESMIKSPRPTRAEATDVANAVLDGTDCVMLSGETAAGAYPELAVRTMAKICIEAESTLDYGDVFKRIMKNAPVPMSPLESLAASAVRTANSARAALILVLTRGGSTAKLVAKYRPGMPILSVIKTDSFDCLIFRGLVPVLSAASARASHAETTEEALEFAIQHAKAKGFCKKGDSLVALHRVGSASVIKILTVK

SEQ ID NO: 81893 - protein, 368 aa, Vitis vinifera
MEDAMGGRYWCHSCSQVVNPIAEAEPKCPLCQDGFIEDIDGTASRDHNDSDSDLASDRTLSLWAPILLGMMGNPRRRRRFRREDIEDEEEDNEDGEGRRGGETELDRELDSIIRRRRRSSATILQLLQGIRAGMVSESENSENDRDRDRDRERERERERLILINPFNQTIIVQGSFDSNQAQNQNQNTIGSLGDYFIGPSLDLLLQHLAENDPNRYGTPPAQKDAIEAMPTVKIKENLQCSVCLDDFEIGAEAREMPCKHKFHSGCILPWLELHSSCPVCRFQIAADESKLDSDASPNVSSNSSERSNNGHGSSEEGDGDGRSGNGRRSTFRWPFTSLFSSQGSQTSNGNSSSSGANAPGSASRANEN

SEQ ID NO: 81894 - protein, 634 aa, Oryza sativa
  misc_feature (122)..(122): Xaa can be any naturally occurring amino acid
MASSISSSSITYTLQTALVISSSLLVAADVGGGQSNNHYCPPSSCGDLHNISYPFRLQGDSRDCVAAPRPWYDLSCSNTGKATIQINTRTYYVSSINYTDLSFLVTDATMQDDDTSGSPGCXLPPSDHPPYSTDDLLDRTTTDSYGFLDLATSSDSAWACFVNCSRPIQDTTSPWYRPVSCLPTNNSFVYLNEFYGCTIGELQPSCRYLSMIPFDTQHISVSQLQNASYTDIIGFIGKGFRVRFPMDHSSLRPFLFRLMLAPLVVFIFLAHKYWKTRITIDAVEKFLQMQQMIGPMRYAYTDIIAITSHFRDKLGQGGYGSVYKGVLLPGNVHVAIKMLSGNSNCNGDEFISEVSTIGRIHHINVVRLVGFCSEEMRRALVYEYMPRGSLDKYIFSLEKCFSWDKLNEIALGIARGINYLHQGCEMQILHFDIKPHNILLDDNFVPKVADFGLAKLYPRDKSFVPVSAARGTVGYIAPEMISRSFGTISSKSDVYSFGMLLLEMAGGRRNADPNAANSSQAYYPSRVYKQLTRRETCEISDIVDMHELEKELCVVGLRCIQMRSSDRPTMSEVIEMLEGGSDDLQVPPKPFFCDDEQPLGVEPYHLSSDLTAISEAEEDDDDESISLFQSFSYQ

SEQ ID NO: 81895 - protein, 244 aa, Staphylococcus aureus subsp. aureus COL
MTKSALVTGASRGIGRSIALQLAEEGYNVAVNYAGSKEKAEAVVEEIKAKGVDSFAIQANVADADEVKAMIKEVVSQFGSLDVLVNNAGITRDNLLMRMKEQEWDDVIDTNLKGVFNCIQKATPQMLRQRSGAIINLSSVVGAVGNPGQANYVATKAGVIGLTKSAARELASRGITVNAVAPGFIVSDMTDALSDELKEQMLTQIPLARFGQDTDIANTVAFLASDKAKYITGQTIHVNGGMYM

SEQ ID NO: 81896 - protein, 148 aa, Oryza sativa Indica Group
MASKRILKELKDLQKDPPTSCSAGPVGEDMFHWQATIMGPADSPYAGGVFLVSIHFPPDYPFKPPKVAFKTKVFHPNINSNGSICLDILKEQWSPALTVSKVLLSICSLLTDPNPDDPLVPEIAHMYKTDRAKYESTARGWTQKYAMG

SEQ ID NO: 81897 - protein, 293 aa, uncultured marine bacterium 314
MAKELKLFCFGFGQVAQYFVKSLVFQKCEFDFVTTTTSKTSFNKKIFGKNYKSLFFEGNDYDPDILNELSNSNNVLVSIPPVSDEDLVLKNFTDEFKNNKFNWITYLSSTSVYGDKNGEWVDENSETLPTSSKGKARLRSEKLWMNLYKQYQMPIRIFRLAGIYSLEHNVINKLKNNTARIIDKKNQFFSRIHTDDIAQALVKSIERPSSGEVYNICDDYPCSNEEVTVYAANLLKVPIPQKIKLDTIENEMSKSFYKDSKRVKNTKMKENLKVKLKYPTYKEGLSNICSHLS

SEQ ID NO: 81898 - protein, 479 aa, uncultured marine bacterium 314
MSDKMLKFVNVGMQMPAKRAGGLRTKDFKEIYDQFIHEKAKEQSSRCSQCGVPFCQVHCPLHNNIPDWLKLTAEGRLQEAHELVHSTNNMPEICGSICPQDRLCEGNCVIEKAGHGTVTIGSVEKYITDTAWEKGWIKPIKVLKEIDQSVGIIGAGPAGLACAEELRKSGYKITIYDRYDRPGGLLIYGIPNFKLEKFTVERRTNLLKESGIKFKQDFEVGKDISLDELRKKHDTILIATGVYKPREIDLPGSDLKNIFPAMEFLTASNRKGLGDRVNNFDNGTLNAEGKNTIIIGGGDTGMDCVRTAVRQNAKSVKCLYRRDRENMPGSAREVHNAEEEGIEFIWLSNPKKFIGTSQISSVLVERMKLGKTDSSGRKKPEPIPNSGFEMKADMVINALGFDPEDLPKLFNSPDLSISKLGTIKINLKTMETNLSGVFAAGDIVRGASLVVWAIRDGRDATISIRKYLEHKRSKNVKAA

SEQ ID NO: 81899 - protein, 285 aa, Triticum aestivum
  misc_feature (84)..(84): Xaa can be any naturally occurring amino acid
MAKEVSEEPEHAAPAHKDYSDPPPAPLFDMGELRMWSFYRAIIAEFVATLLFLYITVATVIGYKVQSAADPCGGVGVLGIAWAXFGGMIFVLVYCTAGISGGHINPAVTFGLLLARKVSLLRAVMYIVAQCAGGIVGAGIVKGIMKDAYQANGGGANMVASGFSRGTALGAEIVGTFVLVYTVFSATDPKRSARDSHVPVLAPLPIGFAVFMVHLATIPITGTGINPARSLGAAVIYNKKAAWDNHWIFWVGPFVGALAAAAYHQYILRAAAIKALGSFRSSRSN

SEQ ID NO: 81900 - protein, 319 aa, Vibrio vulnificus YJ016
MGKLIEGVWHDVWYDTKQTKGKFVREDAGFRDWIENKPQAPFQPESGRYHLYVSLACPWAHRTLIFRKLKGLEEHIDVTVVCPDMLSDGWKMGLPEPLFGHTKLHQIYTQAKPDYTGRVTVPVLWDKKTNTIVSNESSEIIRMFNSAFNQLTGNQDDYYPDSLREVIEEWNAFIYPNINNGVYRCGFATTQEAYEEAYYALFSALDRVEHHLATHRYLAGSQMTEADWRLFTTLIRFDAVYVGHFKCNQKRIADYPHLNGYMKELYQIDGIAETTDFYHIKRHYYFSHIGINPTQVVPLGPNLDLDSDHGREGIGRQGI

SEQ ID NO: 81901 - protein, 234 aa, Zea mays
MAGEGDVKLLGTVVSPFAIRVRMALHLKGVSYEYLEQDLFDKGELLLDSNPVHKKVPVLIHVGRPICESLAIVEYVDEVWADGASLLPADPYGRAVARFWAAYIDDKLFPAWIGILRAATEEDRAEKLDAALAVVGPLEDALAQCSGGKDYFAGDSVGYLDIALGCNLFWFEALHEMFGVTVIDAGRTPRLAAWAERFVETEAAKKAAPLMKSMVDYAGKLRSMWAASAAAAAK

SEQ ID NO: 81902 - protein, 374 aa, Solanum melongena
LQEFDPDQMGLAENQLCFDLIQEWIVNNPKASICTYEGVQDFQDIAIFQDYHGLPEFRKAVARFMEKVRGDRVTFDPERIVMSGGATGAHESLAFCLADPGDAFLVPTPYYPGFDRDLRWRTGVQLFPVVCESSNNFKVTKEALEEAYKKAQESNIKVKGLLINNPSNPLGTILDKETLKDILRFINDKNIHLVCDEIYAATALCQPSFISISEVMNEVVGCNDDLVHIVYSLSKDLGFPGFRVGIIYSYNDVVVNIARKMSSFGLVSTQTQRLIASMLSDTIFVENFIAKSAMKLSQRHDLFTKGLGQVGITTLKSNAGLFIWMDLRRFLENSTFDDELKLWHIIINKVKLNVSPGCSFHCSEPGWFRVCFAA

SEQ ID NO: 81903 - protein, 170 aa, Bacillus thuringiensis serovar konkukian str. 97-27
MIYPYKEKNPKIASSAFIADYVTITGDVTVGEESSIWFNTVIRGDVSPTIIGNRVNVQDQCTLHQSPQYPLILEDDVTVGHQVILHSCHIKKDALIGMGSIILDGAEIGEGAFIGAGSLVSQGKKIPPNTLAFGRPAKVVRELTEEDRKDMERIRTQYVEKGQYYKSLQK

SEQ ID NO: 81904 - protein, 384 aa, Cytophaga hutchinsonii ATCC 33406
MPKILIIDDERSIRSTLTEILEYEKYTVEEAKDGEEGLKMILENDYDVVLCDIKMPKMDGMEVLEKVYTSGKDIPFIMISAHGSIETAIDATRKGAYDFITKPPDLNRLLVSVRNAMDRSNLVTETKTLKKKVNKSYQIIGKSKEIEHIFKTIEKVAPTDARVMITGPNGAGKELVARAIHTQSKRANELLIEVNCAAIPSELIESELFGHEKGSFTSAIKQRIGKFEQASGGTLFLDEIGDMSLSAQAKVLRALQENTITRVGGEKEIKVDVRILAATNKNLQKEIAEGRFREDLFHRINVIPIEVPALKDRADDIPLLIEHFLAIVADDYGTTPKKIDAKAVAELKSLPWTGNIRELKNVVERLVIMSDKTITLEDVKTYVK

SEQ ID NO: 81905 - protein, 448 aa, Triticum aestivum
  misc_feature (348)..(348): Xaa can be any naturally occurring amino acid
MVGSGAAGGGGGDHARSKEAAGMMALHEALRNVCLNSDWTYSVFWTIRPRPRCRGGNGCKVGDDNGSLMLMWEDGFCRPRMAECLEDMEGEDPVRKAFSKMSIQLYNYGEGLMGKVASDKCHKWVFKEPSECEPNIANYWQSSFDALPTEWTDQFASGIQTIAVIQAGHGLLQLGSCKIIPEDLHFVLRMRHMFESLGYQSGFFLSQLFSSSRGASSTPSFPLKQPPPARPPPQLFNWPGQPQLPHAAASPLFPPGPAAFHPSARSSMPHYPGGKDESHMYHLAPSQHGKPPHLDEHQHQHQQQMRPGEAPDGDLKWPNGLSFFTALTGRSDDSKLLYGGPGGGGGGXAQDDGKPAQDAQTGHGGAENVEEYLSLESHSNKARRMENTQSAKFKRSFTLPARMSSSNSPSPSVSASTGPAPQQQQQGMEYRAQHEGSVYSDLMETFLE

SEQ ID NO: 81906 - protein, 798 aa, Oryza sativa Japonica Group
MALPITVLFLLFTLHIPASCKVTDTISAGETLAGNDILVSSNGKFALGFFPTSSKSSHNASNWYLGIWFNQVPKLTPAWVANGDEPVTGPTSPEATISGDGNLVILDQATKSIFWSTQADITANTTMVKLLDNGNLVLQNTSNSSVVLWQSFDYPTNTHLAGAKLGRNKVTGLNRRLVSRKNSVDPASGMYSYELTDNNGSTRFILAALNSSIPYWSSGEWNGHYFGSIPEMTGQRLIDFTFVNNDEEVYFTYTLLDNATIMRFMLDISGQTKIFLWVEHVQDWVPTYTNPKQCDVYGICGAFTVCEESKLPICKCMKGFSVRSPNDWELDDRTGGCVRNTPLDCGINRNTSMQDRFHPMPCVGLPSNGQIIEDVTSAGGCAQICLSNCTCTAYYYGNTGCSVWNDELINVKQLQCGDIANTDGAILYLRLAAKEVQSIKSSGRSIFIGVAITASVASFALALFLIAKIPRNKSWLLGHRRKNFHSGSGVIAFRYADLQHATKNFSDKLGAGGFGSVFKGLLNESTVIAVKRLDGARQGEKQFRAEVGSIGIIQHINLVKLIGFCCEGDRRLLVYEHMPNLSLDTHLFHNDATVLKWSIRYQIALGVARGLAYLHDSCQDCIIHCDIKPENILLDASFVPKIADFGMAKFLGREFTQVLTTMRGTIGYLAPEWISGTVITSKVDVYSYGMVLLEIISGTRNSSKEFATRDDYEYFPLLVAHKLLDGNAGSLVDQNLHGDVDLEQVERAFRVACWCIQDNELDRPTMSEVVQYLEGLLEVGIPPVPRLLQAIAGNPYSK

SEQ ID NO: 81907 - protein, 519 aa, Picea sitchensis
MEIYSGGFITALMVSAAIIWYFTKSRKNKGDPVNWPVVGMLPSLLWNLSNVYEWAAGIVIRNGGTFAFKGPLGSKHFFEIVTSSAPNLEYILKDDFANFPRGPSFKSIFFDIFGDGLFVADGELWKRQRTAVAIAMSSTTFRDQNINQTQGLVLERLIPVLEESCKKNSSLDIQDILLRLNFDNICLALSGKDAGFLLPDLPEVPFAVAFEQAIESSTYRLIIPSFVSKVMQFFNVGFERKHRRAMGIILEYASELVRFKMAELEKMSNEKRGQCGDILSTFIHQERVDGRSPSLKSVRDLCLSIILAARDTSSLALSWFFWLLNQHPDVETKIMSELYEILKAKFSNNPYDINTLRFSHDDLKGMQYLRAALSEAMRLYPPVPVSYRQAVRDVILPDGTRVKKGSKLLYLIYATNRMENLWGKECREFRPERWINRNGICMKESDYKYPVFNAGPRLCLGREMAYVSMKCLAAHVLLRYRVRIYPGHPVQPKFGLTLFMRHGLKVTLQPRDNAVLQKN

SEQ ID NO: 81908 - protein, 475 aa, Zymomonas mobilis subsp. mobilis ZM4
MTEGLFPRGRKVRVVSTLGPASSTAEQIRDRFLAGADVFRINMSHGTHDEKKVIVDNIRALEKEFNRPTTILFDLQGPKLRVGDFKEGKVQLKEGQTFTFDQDPTLGDETRVNLPHPEIFKALDKGHRLLLDDGKIVVRCVESSPTKIVTRVEVPGPLSDHKGFNVPDVVIPLAALTPKDRKDLDFALQEKADWVALSFVQRVEDVIEAKELIKGRAPLLVKLEKPAAIENLESILAATDAVMVARGDLGVECLPESVPPTQKRIVERSRQLGKPVVVATAMLESMIKAPAPTRAEVSDVANAIYEGADGIMLSAESAAGDWPHEAVNMMHRIASYVENAPGYIERVRFTPTPAEPTTVDALAENASKTAETVGAKAIIVFTETGKTAQRVSRARPVAPILSLTPDAEVARRLGLVWGAQPVQVSTVKTLDEAKKLAAETAKKYGFAKAGDKLVVVAGEPFGKAGTTNIVDVIEA

SEQ ID NO: 81909 - protein, 402 aa, Magnaporthe grisea 70-15
MAAIFCNLSASRTIAFSLHLVSAQTRCKPRHLSPKHLQYKSISTATPLPHRRASAQATPPPPLAKAQSRTMATMRAVAFDKTGDSSVLSLREDMPKPTASASQILVKVEWHGINFIDTYMRTGLYQFATPPPHVSGTEGGGIVEAVGAEVPADYGLEVGDRVAFMKSPSAAEYAAVNPNLCFKLPEGVSTKDGAAFLLQGLTAWTLVRDAHEVKPGEVVLVQAAAGGTGGLVVQMCKHLGATVIGTVSTDAKAKLAREHGCDHVVVYTRDDVLKAVNEITHDLGCHAVFSGVGKATFEQDLAATRRKGSFITFGNASGAVEPFSLFKLTARNVRLMRPTLFNFVATREEWDARCRELFDLLAKGVVKTHIGGVYDLSEVAKAQDDLTGQKTVGKLLVKVAKD

SEQ ID NO: 81910 - protein, 140 aa, Glycine max
SVGGAIFINVFLSQSTRPGKFPSILFPIEIKNIQRGKHGSDTGVYDTEGRFVPSKFEEIFNKHAHTHPNALTYDELTEMIKANREPKDFSGRIGSVVEWKILYKLAKDKSGLLQKETIRGVYDGSLFEQLKKQHSSGKEK

SEQ ID NO: 81911 - protein, 545 aa, Thellungiella halophila
MAMLASYFDSFISKMPSLSTSDHASVVSLNLFVALLCACIVLGHLLEENRWMNESITALLIGLATGVVILLISKGKSSHLLVFSEDLFFIYLLPPIIFNAGFQVKKKQFFRNFVTIMLFGAIGTVISCTVITLGVTQFFKKLDIGTFDLGDYLAIGAIFAATDSVCTLQVLNQDETPLLYSLVFGEGVVNDATSVVVFNAIQSFDLTHLNHEAAFHLLGNFLYLFLLSTLLGVATGLISAYVIKKLYFGRHSTDREVALMMLMAYLSYMLAELFDLSGILTVFFCGIVMSHYTWHNVTESSRITTKHTFATLSFLAETFIFLYVGMDALDIDKWRSVSDSPGTSVAVSSILIGLLMLGRAAFVFPLSFLSNLAKKNESEKINFKMQVVIWWAGLMRGAVSMALAYNKFTRAGHTDLRGNAIMITSTITVCPFSTVVFGMLTKPLIRHLLPHQKATTSMLSGDNNTPKSIQIPLLDQDSFIEFAGNHNVPRPDSIRGFLTRPTRTVHYYWRQFDDSFMRPVFGGRGFVPFVPGSPIERDPPDLSKA

SEQ ID NO: 81912 - protein, 410 aa, Rickettsia felis
MNPQLNNPNLPIYMDYQATTPLDPRVMEAMLPYFTTKFGNPHSRSHSFGWEAENAVEEARSRVARLIGADTKEIIFTSGATESNNLAIKGIAKFYGNKKNHIITVVSEHKCVLDACRHLEQEGIKITYLPIKPNGIIDLETLKNAITDQTMLVSVMAVNNEIGVVQPLKEIGKICRERGVFFHSDIAQGFGKIPIDVNEFNIDLASISGHKIYGPKGIGALYVRKKPRVRVTPLINGGGQERGMRSGTLPTPLIVGLGMAAEIAYSVMEKDTKHVNYLFDRFLNNIHNRISEVYLNGDKNQRYKGNINLSFAGVEGESIILAIKDLAVSSGSACTSASLEPSYVLRSMGIGEELAHTSIRFGIGRFTTEQEVDYAVDLICSKIDKLRELSPLWEMVQEGIDLKKIKWATH

SEQ ID NO: 81913 - protein, 443 aa, Burkholderia vietnamiensis G4
MSETKPALDRRLGVTSATMFGLSYMSPMVVIATFGAIAVKTQGAVGTAYIIAIVAMLITAISYGYMSSRMPVAGSAYTYSSSVLGRTLGFAVGWVLLLDYFFIPMVICLLTATGLSTLDPNVPFWVWVVGVAILSTVINALGITVTDRVNLVIMALQLVMVVAILYLCVRYAFETPSIGTLVSPQPFTNKDTNFSLIMAGAAVACYSFLGFDAISTLSEETVDPRRSIPRAIFIATLLGGAIFLATAYFMMLVHPSLKFASEDTAAYEIAGQIGGPFFKTVFTLVVTIAFFAAGLCAHASASRLLYVMGRDNVLPSVGFSYLHPVFKTPIINICLVGVVMLIAARLDIATSTSFINFGAFTAFCAVNLCVVVHILRNRGNDSGGKLSAAALALVGALACASLFFSLDGLAVKLGVIWLCVGIVYLACKTRCLTKPLPAVAVGE

SEQ ID NO: 81914 - protein, 178 aa, Bradyrhizobium sp. ORS278
MRIDAIPIGKDPPREVNVVIEVPVGGEPIKYELDKEAGTLFVDRFLYTAMRYPGNYGFIPHTLSNDGDPCDVLVANTRAIVPGAVMSVRPVGVLLMEDEAGGDEKIIAVPSSKLTQRYDKVRTYSDLPDITLQQIQHFYEHYKDLEPGKWVKVLRWGNADDAHQLIAEGIARAKAAKK

SEQ ID NO: 81915 - protein, 315 aa, Vitis vinifera
MKTFVVSLLMVLLVVSRVPYRTALPSTVPAFLWSHHQFEMKEAVNYQTLYPKDLAKSVVSEGGWSNLLCSGEKDQQPVDLALVFVGRELSSLDISGSKHADPALVDLLKVSFARSNFSMAFPYVAVSEEKEAMENSLISGFTETCGHDLGVSNVAFLESCSVEGGNFKKLADLHSVHDYLVSRRKMRPVGPTDLVMFCHGGSHLEELDQRLESEVFSELISSLEQSGTKYTVLYVSDPFRSIQYPSYRDLERFLAEGTYGNGSANSTTCDEVCQIKSSLLEGLLVGIVLLIILISGLCCMMGIDTPTRFEAPQDS

SEQ ID NO: 81916 - protein, 455 aa, Burkholderia vietnamiensis G4
MTNTQKPWGSRETASFFHTFTDLPSLREDGATVIDHGEGPFIVDTNGNRFFEGNSGLWNMTLGFSEHRLAKVAAEQYSAFPGYHTFFGRNSKPTVELSERMLALAPVPMSRVFFTNSGSEANESVIKLLWMMWAAEGQPQRRKLLTRKNAYHGATVMASALTGKDYVKAFGLPTPDVITLDCPHAWRFAQAGESEEAFVKRLVSNLEKTILAEGPDTIAGMFAEPVMGAGGVIVPPAGYFEQVQAVLKKYQIPLVADEVICGFGRTGNLWGCQTVGLRPDIIVASKSMSAGYFPVGAVMLSAEIDRRATAASEQWEEFPHGFTTAGHPVACAVSLEAIRIITDEGILENVQKVGRKFQDGLRALADHPMVGDVRGVGLMGALEMVSDKSSKTSFSGELRVGERIAKAAREFGYIIRPLGASVVLAPPFITTSEQIDDLLTVLKRVLDSVYKDISG

SEQ ID NO: 81917 - protein, 412 aa, Arabidopsis thaliana
MKMRTKSIPVRSSRKSLDSLLDDEANENTQCDERDVPHKKRRCLGTSETTDRGGSVEPLLDLDACIVCEVSDERVSRCCGVDCLLSFHGECLYADLGSTSSSSSSSSEDVSNPFCPYCWLKIVALKSKTLREKTVEAEKAVCKYLDKEMKSRDEDITLSGDEIGNQEQSTDIVSDHELQGEKDGCSSKPDADQGKVGTGKVIDEVGASEKVATEKFQDAEDDETAKDQGTRILNTGAGKKREVSSFLSMQESFSAKEQDQVQQNEKRRRRGLKIIDSDISSKGSSNERNGEDVTEQVTSSVQVTSPSGRMRNQQATTKVVAKSKTVRDISFFKMDQRRRLLWTYEEEEMLKVGVEKFAAEANKNMPWRKILEMGEKVFHETRTPADLKDKWRSMVKIMNKNEQGSTLTPTAM

SEQ ID NO: 81918 - protein, 303 aa, uncultured marine bacterium 314
MSDKKQIISASPKVRKFARELGANLYQIHGSQREGRVSENDVRSFIKESLSGEIAKKRTVTPQEYEHSEFGEIDVQPIPRIKKIARSHLEKSWNEIPHVTHHDEADITEMDKFRKTLRDLYTGEKISITPLAFIIRAVVKALKDYPNFNASLDLENGKVIYKKYFHVGIAVDTPHGLMVPKIRDADKKDITALGKELKKVSKLCKELKIDKKEFFGGSITISSLGNIGGSFFTPIINQPEVAILGVGRAETKQVFMDGKYQSRIMLPLSLSYDHRIINGAEGARFCVHLRESLGKDFAYKLAV

SEQ ID NO: 81919 - protein, 468 aa, Klebsiella pneumoniae
MSKQQIGVVGMAVMGRNLALNIESRGYTVSVFNRSREKTEEVIAENTGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPVGDKAGFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTVSAAIAYYDSYRSAVLPANLIQAQRDYFGAHTYKRTDKEGVFHTEWLE

SEQ ID NO: 81920 - protein, 496 aa, Burkholderia thailandensis E264
MDKTTLAYWQDKAASLAIEGRAFIDGAYRDAHGGNTFDCVSPIDGRVLAKVADCGAADVDAAVAAARRAFDEQVWAGLNPRKRKAILLRWAALMRAHLDELSLLETLDAGKPIGDTTTVDVQGAAYCVEWFAEAIDKVGGEVVPADHHLVGLVTREPLGVVAAVVPWNFPILMASWKFGPALAAGNSVVLKPSEKSPLTAIKVAQLAHEAGIPAGVFNVVPGGGEPGKLLALHRDVDCLAFTGSTGVGKLIMQYAGQSNLKRVWLELGGKSPNIVLPDCPDLDRAAKAAAGAIFYNMGEMCTAGSRLLVHRDIKDAFLEKLVAAARAYKPGNPLDPNVSMGAIVDALQLERVLGYIEAGRAEAKLLLGGARVNAASGGFYIEPTVFDTAPDTKIAREEIFGPVLSVITFDSVDEAVRIANDSEYGLGAAVWTANLTTAHEVARRLRAGTVWVNCYDEGGDMNFPFGGYKQSGNGRDKSLHALEKYTELKSTLVRLR

SEQ ID NO: 81921 - protein, 106 aa, Triticum aestivum
  misc_feature (74)..(74): Xaa can be any naturally occurring amino acid
TFGELTWEKPTYSDFQVLSRESEYAGWTLVNGYALNHATVSTHRLESDIRSISKFNKFVEDNGFKLNTEGGILXVNEHHRRDGFEVGNADKIFESTSKDQLTRRSA

SEQ ID NO: 81922 - protein, 336 aa, Euglena gracilis
MAQTIPDQTALPDTTNWQLSDLTLKETLGTGTFGRVRLCLHKSSGNYYAIKCLKKSEVLRMKQVEHILAEASILGSIRHPFIVNMLKTFQDDKRLYIVLEYVVGGELFSHLRKAGKFPNDVAKFYAAEVILAFEYIHSMDILYRDLKPENLLLDVGGHIKITDFGFAKKVPERTFTLCGTPEYLAPEIIQSKGHGKAVDWWALGILTYEMLVGYPPFFDESPFRIYEKILEGKVQFPKWVDGRAKDLIKGLLTTDHTKRLGTLKRGVTDIKKHKWFYGVDWDMLLARKIPAPIPVKVTTPGDSRYFDRYPESKEDKSQPLTPAQQELFKGFGPYST

SEQ ID NO: 81923 - protein, 461 aa, Mycosphaerella graminicola
MPSLGFLKKKRTKDSTASNEVASPTSPTIGSPISQTLSRQSNLFSEQNQQSQQQPPQTSGQDSVQQNTSASQSSNAKADDPMNISPQPSAVQQQPAQPQQQYNGSQHDSAHEQNGHNPNQQHVPLLNVSKTAPTVNPLRETKGKYTLNDFQISRTLGTGSFGRVHLVQSKHNSRFYAVKVLKKAQVYKMKQVEHTNDERKMLQRCRNPFLITLWGTWQDSKNLYMVMDFIEGGELFSLLRKSQRFPNPVAKFYAAEVTIALDYLHSMNIIYRDLKPENLLLDRHGHIKITDFGFAKEVPDITWTLCGTPDYLAPEVVSSKGYNKSVDWWSLGILIFEMLAGFTPFWDSGSPLKIYENILKGRVKYPPYIHPDAQDLLSKLITADLTKRLGNLHGGSQDVMNHAWFAEVTWDRLAKKDIDAPYVPPVRGGAGDASLFDKYPEETEAYGATGDDPHRTLFPDF

SEQ ID NO: 81924 - protein, 328 aa, Triticum aestivum
MSWAPIENDPGVFTELLQQLQLKGLQVDELYSLDLDALNDLQPIYGLIVLYKWRPPEKDERPVIKDAVPNLFFANQIINSACATQAIVSVLLNSSGITLSEDLKKLKEFAKDMPPELKGLAIVNCESIRMTSNSFAKSDDYSEEQKSKDDDVYHFISYVPVDGVLYELDGLKEGPISLGKCPGGIGEMGWLKMVQPVIQERVDKFSQNEIRFSVMAITKNRKEIFIMELKELQRKRENLLSQMGDPSANRQRPSIERSLAEVAAQIEAVTEKIIMEEEKAKKWKTENIRRKHNYVPFLFNFLKILEEKQQLKPLIEKAKQNSHSRNPK

SEQ ID NO: 81925 - protein, 250 aa, Zea mays
MVKLAFGSVGDSFSVTSIKAYVAEFIATLLFVFAGVGSAIAYGQLTNGGALDPAGLVAIAIAHALALFVGVSVAANISGGHLNPAVTFGLAVGGHITILTGVFYWVAQLLGATVACLLLGFVTHGKAIPTHAVAAGISELEGVVFEVVITFALVYTVYATAADPKKGSLGTIAPIAIGFIVGANILAAGPFSGGSMNPARSFGPAVAAGNFAGNWVYWVGPLVGGGLAGLVYGDVFIGGSYQQVADQDYA

SEQ ID NO: 81926 - protein, 382 aa, Cytophaga hutchinsonii ATCC 33406
MHACANSLISLRPIRNKMLSYNLPNCRKMKLLLQWTIIIPILAWALFFSGFIDNNTIVQIIASILLILSVMSAVHHSEIIAHRVGEPYGTIILAIAITVIEVSIIVSLMVSGGQESVSLARDTVYSATMLILNGIVGLSLFIGGLKHHEQEFSKHSVTIALVSLISIVVFTLVVPTFTESVHGSYYSTPQLIFASIACLVIYFFFLFAQTSRHREYFLSGKDDTDNVTVISNWNLAISLLFLLVSLGIVVLLAKTLSPTIESIIISYQLPVTLVGVVIAIIILLPECIAAIIAARNNKLQTSLNLSLGSALASIGLTIPSVAVVCIMNDMKIIMGLDIKSIILLGLSVFTVMLSLSSGRTNIVYGVVLLVNLFAFIFLIIYP

SEQ ID NO: 81927 - protein, 615 aa, Deinococcus radiodurans R1
MSAIYQRARPIRWEDVVGQEHVKDVLRTALEQGRIGHAYLFSGPRGVGKTTTARLIAMTANCTGPAPKPCGECESCLAVRAGSHPDVMEIDAASNNSVDDVRDLREKVGLAAMRGGKKIYILDEAHMMSRAAFNALLKTLEEPPEHVIFILATTEPEKIIPTILSRCQHYRFRRLTSEEIAGKLAGLVTLEGASADPDALNLIGRLADGAMRDGESLLERMLAAGTAVTRPAVEEALGLPPGERVRGVASALLVGDAGEAISGAAQLYRDGFAARTVVEGLVAAFGAALHAELGLGEEGRLEGAEVPRLLKLQAALDEQEARFARSADQQSLELALTHALLAADGGTGGGAPSLGSAATSAPAQVPGDLLQRLNRLEKELSTLRSAPRAAAPASAVPAAPAEKRGPAPAREAVREAAASIAPAAAPTQGSWADVMAQTTMQMRAFLKPARMHAQDGYVSLTYEDRSSFHAKQVAGKFDELAALVERVFGPITFELIAPEGLGRKREAGRAGGSQAAASAPAPTLNPAPTRSTPAPKADAPVEIPDFDPSPRRSRRGPEFEPVTVGAAQPQPVAAAQTASTQTPGTQTASAPPPSLPPRPPARPSGTRPCACGPAT

SEQ ID NO: 81928 - protein, 408 aa, Picea sitchensis
MATAAAVSPLSASTFNRVGASGFLEAKAINLSTSQFSSKGLYRSSFLSRMPEIKSQHRRNAFKRPAPGLIPKALSESHDNGKPSEVSPLVVCFGEMLIDFVPTVSGVSLAEAPAFKKAPGGAPANVAVGIARLGGSSAFIGKVGDDEFGYMLADIMKENNVEHRGMRFDPVARTALAFVTLKADGEREFMFFRNPSADMLLTESELEVDLIQQAKIFHYGSVSLITEPCRSAHLAAMRIAKDTGSFLSYDPNLRLPLWSSASAAREGMLSIWDEADVIKVSDEEVEFLTEGADPYDDTVARNLFHPNLKLLLVTEGDQGCRYYTKDFSGRVNGVAVQAVDTTGAGDAFVSGILSELAKDFNLLQEEKGLREALKFANACGAITVTERGAIPALPTREAVLASLTKVLA

SEQ ID NO: 81929 - protein, 449 aa, Picea sitchensis
MYAAPPPQIPDIGGSNMDQTASEKRVYQSWKGSNKFFFAGRFIFGPDVRSLVLTFVLILAPATIFCVFVARKLLDKFSHHAGVSIMVIAVVFTIYVLVLLLLTSGRDPGIIPRNAHPPEPEEGYDVASLTPESIGGQTPHPRLPRTKDVFVNGISVKIKYCDTCMLYRPPRCSHCSICNNCVERFDHHCPWVGQCIGLRNYRFFFMFVFSTTLLCIYVFSFCWVYIKKIMVADDVTVWKAMSKTPASIVLILYTFFSVWFVGGLTVFHLYLISTNQTTYENFRYRYDRRANPYNKGVIHNFKEIFFSSIPPSKNSFRAKLQHDSTLQDTSADPGGNFLSPNMGKGGIDLEIGNKPSWPTVGAEALADFDEHESNGGLENKDGYEDSFAHALSRTLPVESAEGRGGIHPRRSSWGRKSGSWEITPDILALAAGVNEANRVSGDITPPGNR

SEQ ID NO: 81930 - protein, 221 aa, Glycine max
GISYVLLLNIVCKCSNKVISLPVSSSFCRQAWQKLGAMPPEDAMQKYIDIVTEIYPTWLDGSSLRNKSGDSGGHGSEAKGPMGPVFSTFVYEEEYGSDSQMEAIHGFAREGDMANLLKCIENGVSMNLKDSEGRTPLHWAVDRGHLNVTELLVGKNADVNAKDNDGQTPLHYAVTCEREAIAEYLVKHNADIYSKDNDGSSPRDICESNWPCMQHVGEEVN

SEQ ID NO: 81931 - protein, 535 aa, Neptuniibacter caesariensis
MAVLQTKINPRAEDFRSNHDSMAEAVNDLRDKVATIEQGGGPKYQERHLSRGKLLPRERINALLDEGAPFMELSQLAAHEVYDDVIPAAGIIAGVGRVSGQECMIVANDATVKGGTYFPLTVKKHLRAQEIAEQNHLPCIYLVDSGGANLPQQDDVFPDRDHFGRIFFNQARMSSKGIPQIAVVMGLCTAGGAYVPAMADESIIVRNQGTIFLAGPPLVKAATGEVVSAEDLGGADVHCKVSGVADHYAENDAHALQIARTCVSNLNRKKNLDLDIREPKAPLYSADEIYGIVGTDLKKPFDVREIIARIVDGSEFDEFKKMYGTTLVTGFAHIHGYPVGIVANNGILFGDSAQKGAHFIELCCQRKIPLLFLQNITGFMVGQKAESEGIAKHGAKMVNAVACADVPKLTVLIGGSFGAGNYGMCGRAYSPNFLWMWPNARISVMGGEQAAGVLATVKRDNMDRVGQEWSADEEAEFKKPIIDTYEHQGHPYYASARLWDDGVIDPAQTRDVIGMGLSAALNKPIGDTKFGVFRM

SEQ ID NO: 81932 - protein, 256 aa, Streptococcus agalactiae NEM316
MKIGIIGVGKMASAIIQGLKQTQHDIVISGSCLERSKEIAERLDVTYAESHQSLINQADIIMLGIKPQLFEKVLLPLDITKPIISMAAGISLARLSQLTRSDLPLIRIMPNINAQILQSCTAICYNNHVSDELRQLTKEITDSFGSSFDIAETNFDTFTALAGSSPAYIYLFIEALAKAGVKYGFPKEQALSIVGQTVLASSQNLLQGQNSTSDLIDNICSPGGTTIAGLLDLEKNGLTHSVISAIDATIEKAKKL

SEQ ID NO: 81933 - protein, 256 aa, Lentisphaera araneosa HTCC2155
MKRRLFIAGNWKLNKTAAETTETVADLKAKLADFNGSLDVALFPPFLSIAAGQAAAAGSPIGIGAQNVHFAESGAYTGELSAAMLKEAGIELVIIGHSERRQYFGETNETVNLRTKAALAAGIKPFVCIGETLEEREGGNMESVLKAQIVEGFADITAEQMTNLVVAYEPVWAIGTGVTASPEQAQDTHAYIRSEFAALYGQEVADKVIIQYGGSVKPANVAELMSCEDIDGALVGGASLKADDFSALILNAAALS

SEQ ID NO: 81934 - protein, 283 aa, Thermus thermophilus HB27
MLRGVKALRALGLLLLLGLALGQKSGGGVGGRPYVPSTPPPMSPGPAPVYPTPAPYYPVPGPVYVYPGGGGSLGAAPVLVFFGLALVAFLMVRGLSRAGEEGPRASVGRLRLALLLSPGVQRALRRLAEEADTTTAKGLADLLDEVALVLLREAPAWRFASYEAREGTEEEVLGQFDAWMLEDRSTYRETFRHFEGKKVEAAYTPKVEPGGRYLVASLVLAVRGSLPPGGPLDRGKAREVLLAFAATTPFTLLAFHLAWTPEKEGEGLTEEELLALYPNLEKL

SEQ ID NO: 81935 - protein, 177 aa, Triticum aestivum
  misc_feature (9)..(9): Xaa can be any naturally occurring amino acid
MAPTVMVSXSATSVAPFQGLKSTAGPSPSAAAPTALASASVSNGGRIRCMQVWPIEGIKKFETLSYLPPFSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESDKD

SEQ ID NO: 81936 - protein, 40 aa, Erwinia amylovora
SHDCGNKLGYMQAFVEYGVRHETLGSDFKAWLESAVGNKK

SEQ ID NO: 81937 - protein, 446 aa, Erwinia amylovora
MKVTVFGIGYVGLVQAAVLAEVGHDVLCIDVDENKVENLKKGIIPIFEPGLTPLVMQNYEAGRLKFSTHAEEGVNRGVMQFIAVGTPPDEDGSADLKYVTAVARTIAQHMQGHKVVLDKSTVPVGTADRVRQVMEETLKGRGAALSFDVVSNPEFLKEGAAVSDCMRPERIVIGTDNDEVVELLRELYEPFNRNHDRMILMDIRSAELTKYAANCMLATKISFMNEISNLAERLGADVEKVRQGIGSDSRIGYSFIYPGCGYGGSCFPKDVQALIRTAEQIGYQPRLLQAVEDVNDAQKHKLPTFIKRHFGENLRGKTFALWGLSFKPNTDDMREASSRVLMEALWQAGASVHAFDPEAMDEAQRIYGHRSDLKLMGTKEAALQGADGLVICTGWQNFRAPDFDVIKNALKEPVIFDGRNLYDPERIIKRGFVYYAIGRGASLNIA

SEQ ID NO: 81938 - protein, 249 aa, Xanthobacter autotrophicus Py2
MAVTRRTLLAGLIACPVCASAAHAAGVHWTYEGHGGPQEWGSLESGFQACAVGSQQSPINLEGAVQAAGDGPTLAWKPDAFKIVNNGHTIQADVVGDAGTATMGGKTYTLRQFHFHAPSEHALNGERTAMEAHFVHDAPGGGLLVVGVFIKPGATNAAFSEVMASAPRAEGSTALKAPLDATGLLPAQRATYRYEGSLTTPPCSEVVDWNVYATPISVAEADIAAFRAIFPMNARPLQAVNRRFLLRLN

SEQ ID NO: 81939 - protein, 277 aa, Rhodococcus sp. RHA1
MECENPGGGAGQVLRPDVHRGRVALITGGGTGIGRAIALDMARCGADVVISGRRSEPLEKTAAEIEALGARVLAVPADIREEEQVTDLVDRALDTFGRIDILVNNAGGQFAAPAEDITSKGWRAVHRLAVDATWAVTREVAVRAMIPQRSGCIFFMAFSPRRGIASMVHATSARAALENLASGLSLEWSRYGIRSICIAPGTIATEGMEGNYTEEARAQWTSAVPLGRLGTAEDVSGVVTFLASPAGSYVTGTTLVIDGGADAWGTGHPAPKVEETR

SEQ ID NO: 81940 - protein, 83 aa, Glycine max
VTEGSTQDCHKKFILTYPITGCHIKLESNDDLKLRAVRDKRFPHKVPGDALSEELNGDVIWITSGCDRYRFPMSQGILITSRF

SEQ ID NO: 81941 - protein, 322 aa, Azoarcus anaerobius
MAGYLNRGVWHSAERARTNAEGAFLRDDSQFRDRVTADGAGNFKAEAGRYHLYVSLACPWAHRTLLYRALKGLQDAIGVSVVDPVSGDEGWVFSDYPGATPDHANGLTALHQLYTLAQPDYSGRVTVPVLWDKASRRIVNNESADIIRILNDAFVAFEHRAIDFYPQHLRAEIDAVNAFVYENVNNGVYRCGFATSQAAYDQAVLQLFAALDRLEERLSRHRYLVGNRLTEADMRLFPTLVRFDAVYFIHFKCSVRRIADYPNLSGYLRDIYQMPGVSETVNMDHIKRHYYLSHRHLNPTGIIPAGPDFDFAGRHDRQRFQE

SEQ ID NO: 81942 - protein, 421 aa, Azoarcus anaerobius
MPSVSTSMTEGTLARWLKKDGETVAKGEVIAEIETDKAILEVEAEAEGIFKAFVADGATVKVGEPMGALLAPGETLGGTISAAQSAAAPTAAAVGGETAVAVAVAAPAAAPSTGHAPAAHDGTRIFASPLARSLALLHGLDLVNISGSGPQGRIVKRDIEAAMSAQRPASGAVAAPVAEAPVKAPQPAAPQAAGAGYELIPHSSMRRVIAQRLSESKQQVPHFYLTVDCRLDKLLALRQQVNGSLPDVKVSVNDFIVKAVAAAMKRVPATNASWSDEGVRRYRDIDISVAVATPNGLITPVVRQADAKSVGTISAEVKDLAERARQGKLKPDEYQGGGFTISNLGMYGVRDFAAIINPPQACILAVGTAEKRPVIEDGAIVPATVMTCTLSVDHRVVDGAVGAEFLAAFKALLETPLGLLV

SEQ ID NO: 81943 - protein, 465 aa, Azoarcus anaerobius
MAQEKFDLTVIGGGPGGYVAAIRAAQLGLRTALIEREHLGGICLNWGCIPTKALLRSAEIFDHFKHAGDFGLEVQGASFDLQKIVARSRGVAAQLNAGVKHLLKKNKVQVFEGSGRLAGSGTIRLEQKDGVSEIQSTHIILATGARARAMAPVEPDGRLVWSYKEAMTPERMPKSLLIVGSGAIGIEFASFYRSLGAEVTVVEVRDRVLPVEDAEVSAFAHKAFERQGMKLLTSSSVVSLQKQADSVIAVIDTKGTTTEIRADRVIAAVGIVGNVENLGLEGTGVQVENTHIVTDAWCQTGEPGVYAIGDVAGAPWLAHKASHEGILCVERIAGVDGIHPLDKTRIPGCTYSRPQIASIGLTEAQAKERGYELKVGRFPFMGNGKAIALGEPEGFIKTVFDAKTGELLGAHMVGAEVTELIQGFSIGKTLETTEAELMHTVFPHPTLSEMLHEATLAAYGRAIHT

SEQ ID NO: 81944 - protein, 416 aa, Streptococcus thermophilus CNRZ1066
MITANDIVKANEVLKNVVERTPLDFDRYLSEKYGATIYIKKENMQKVRSFKLRGAYYAIHQLSDEDKEHGVVCASAGNHAQGVAYTCNEMKIPATIFMPVTTPLQKIGQVRFFGGKFVTIKLVGDTFDESAKAAQEYTKSEGMTFIDPFDDYNVQAGQGTVAYEIYEQAQEEGVSFDSILVPVGGGGLISGVATYIKDVAPSIEVVGVEASGARSMRAAFDHGYPVKLEKIDKFADGIAVQKVGAKTYEVARKYVDRLLGVDEGLISETLIDMYSKVGTIAEPAGAASVAALEVIKDEIKGKTIVCIISGGNNDINRMPEMEERALIYDGIKHYFVVNFPQRPGALREFVNDILGPNDDITRFEYIKRANKGKGPVLIGIALSDKNDYDGLLERLSEFDPSYINLNGNETLYNMLV

SEQ ID NO: 81945 - protein, 466 aa, Escherichia coli CFT073
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRIRKILRAEGSEIRLRMWLYPWLTWLVIGFITFVLVVMLFRPAQQLEVISTGLLAIGIICTVPIMARWKKLIMWQKTPIHNTR

SEQ ID NO: 81946 - protein, 353 aa, Saccharomyces cerevisiae YJM789
MFEGFGPNKKRKISKLAAEQSLAQQPWVEKYRPKNLDEVTAQDHAVTVLKKTLKSANLPHMLFYGPPGTGKTSTILALTKELYGPDLMKSRILELNASDERGISIVREKVKNFARLTVSKPSKHDLENYPCPPYKIIILDEADSMTADAQSALRRTMETYSGVTRFCLICNYVTRIIDPLASRCSKFRFKALDASNAIDRLRFISEQENVKCDDGVLERILDISAGDLRRGITLLQSASKRAQYLGDGKNITSTQVEELAGVVPHDILIEIVEKVKSGDFDEIKKYVNTFMKSGWSAASVVNQLHEYYITNDNFDTNFKNQISWLLFTTDSRLNNGTNEHIQLLNLLVKISQL

SEQ ID NO: 81947 - protein, 450 aa, Burkholderia thailandensis E264
MDLSSKRYNMGLNDSLLDMQLLTIGINHHTAPVALRERVAFPLEQIKPALSTFKSVFLGHPAPNAPEAAILSTCNRTELYCATDDRAARDAAIRWMSDYHRIPADELAPHVYALPQSEAVRHAFRVASGLDSMVLGETQILGQMKNAVRTASEAGSLGTYLNQLFQRTFAVAKEVRGTTEIGAQSVSMAAAAVRLAQRIFEQVAQQRVLFIGAGEMIELCATHFAAQGPRELVVANRTAERGAKLAERFGGRAMPLSDLPARMHEFDIIVSCTASTLPIIGLGAVERAVKARRHRPIFMVDLAVPRDIEPEVGKLKDVFLYTVDDLGAIVREGNASRQAAVAQAEAIIETRVQNFMQWLDARSIVPVIRHMHTQADALRRAELERARKMLARGDDPAAVLDALSQALTNKLIHGPTSALNRANGADRDSLIDLMRGFYQHAPRSSDTSDH

SEQ ID NO: 81948 - protein, 360 aa, Moorella thermoacetica ATCC 39073
MHKFAFMIHPLDIHDVTRKFPVARHLPPALLEKAVRYLPPIKASHITGVRSAYAETEGWFVACSLTSRQMLSLPQDLVIKKLIRTGRLAEKLGAEILGLGAMTSVVGDAGITIARHLNIAVTTGNSYTVATALEATAKAAAMMDIDLTRAEIAIMGATGSIGAVCARILARNCRHLTLIARNEEKLARLAHQIKEETGLKARVTNHSREALRRADVIITVTSAVDTVIEPEDLKPGAVVCDVARPRDVSRRVAEVRDDVLVIDGGVVQVPGDVDFHFNFGYPPGLSYACMAETMILALEGRIENFTLGRELTVEQIDTINRLAAKHGFQVAGFRSFELPVSEEQVAAIRERARQRAALAR

SEQ ID NO: 81949 - protein, 335 aa, Erwinia amylovora
MKYLVTGAAGFIGFHVAQRLLNAGHQVVGLDNLNDYYDVNLKTARLALISHHASFTFIKGDLADREGRAELFRCHRFQRVIHLAAQAGVRYSLENPLAYADANLVGHLNILEGCRHNQVEHLLYASSSSVYGLNRKMPFSADDSVDHPVSLYAATKKANELMSHTYSHLYGIPTSGLHFFTVYGPWGRPDMALFKFTRAIIAGEKIDVYNHGQMRRDFTYIDDIVESVFRLQEVIPQADKDWTVEAGSPATSSAPYRVYNIGNSQPVTLMDYIGALESALGTVADKNMLQMQPGDVVDTSADISALYKAIGFKPQTSVKEGVARFVSWYKEFYHK

SEQ ID NO: 81950 - protein, 494 aa, Arabidopsis thaliana
MVLTKTATNDESVCTMFGSRYVRTTLPKYEIGENSIPKDAAYQIIKDELMLDGNPRLNLASFVTTWMEPECDKLIMDSINKNYVDMDEYPVTTELQNRCVNIIARLFNAPLEESETAVGVGTVGSSEAIMLAGLAFKRKWQNKRKAEGKPYDKPNIVTGANVQVCWEKFARYFEVELKEVNLSEGYYVMDPDKAAEMVDENTICVAAILGSTLNGEFEDVKRLNDLLVKKNEETGWNTPIHVDAASGGFIAPFIYPELEWDFRLPLVKSINVSGHKYGLVYAGIGWVVWRAAEDLPEELIFHINYLGADQPTFTLNFSKGSSQIIAQYYQLIRLGFEGYKNVMENCIENMVVLKEGIEKTERFNIVSKDQGVPVVAFSLKDHSFHNEFEISEMLRRFGWIVPAYTMPADAQHITVLRVVIREDFSRTLAERLVADISKVLHELDTLPSKISKKMGIEGIAENVKEKKMEKEILMEVIVGWRKFVKERKKMNGVC

SEQ ID NO: 81951 - protein, 218 aa, Burkholderia thailandensis E264
MRHSMNDGRISPTMSASVRTRVNVPIRPRTAQQRFDAEMVTFQGLCDNAEHLALVFGPLADAPLVRVHSECLTGDVFGSARCDCGEQLDESVAMFGREGGILLYLRQEGRGIGLYNKLDAYRLQISQGLDTFAANRALNFPDDMRDFRVAAQMLQALGVTEISLVTNNPDKVSQIEKHGIRIRRVLQTGVFVNTTNHGYLRAKIDHHRHAINLSQELQ

SEQ ID NO: 81952 - protein, 486 aa, Azoarcus anaerobius
MLNLKDAALFRQQCYIDGAWQDADNGESQPVRNPSTGEVLGTTPRMGAAETRRAILAAEAAWPAWRAKTAKERAGLLRKWYDLMLAHQDDLAAILTAEQGKPFAEARGEILYGASFIEWFAEEAKRIYGDTIPEPVAGRRLVVIKQPVGVVAAITPWNFPNAMITRKVGPALAAGCTVVVKPASQTPYSALALAELAERAGIPRGVFNVVTGSARAIGGELTANPAVRKLSFTGSTEIGQELMAQCAATIKKISLELGGNAPFIVFDDADLDAAVAGAIASKFRNTGQTCVCTNRLLVQAGVYDEFARRLSDAVSRLKVADGFDPDAQQGPLIDQAAVDKVEAHIADAVSKGARVLVGGKRHARGGTFFEPTVLADVTTGMAVAREETFGPVAPLFRFETEEEAIRMANDTEFGLASYFYSRDIGRVWRVAGALEYGMVGINEGLISTEVAPFGGVKHSGLGREGSKYGIDEYLEMKYLCMGGIGG

SEQ ID NO: 81953 - protein, 438 aa, Mycobacterium bovis AF2122/97
MHFARHGAGIQHPVIVRGDGVTIFDDRGKSYLDALSGLFVVQVGYGRAELAEAAARQAGTLGYFPLWGYATPPAIELAERLARYAPGDLNRVFFTSGGTEAVETAWKVAKQYFKLTGKPGKHKVISRSIAYHGTTQGALAITGLPLFKAPFEPLTPGGFRVPNTNFYRAPLHTDLKEFGRWAADRIAEAIEFEGPDTVAAVFLEPVQNAGGCIPAPPGYFERVREICDRYDVLLVSDEVICAFGRIGSMFACEDLGYVPDMITCAKGLTSGYSPLGAMIASDRLFEPFNDGETMFAHGYTFGGHPVSAAVGLANLDIFEREGLSDHVKRNSPALRATLEKLYDLPIVGDIRGEGYFFGIELVKDQATKQTFTDDERARLLGQVSAALFEAGLYCRTDDRGDPVVQVAPPLISGQPEFDTIETILRSVLTDTGRKYLHL

SEQ ID NO: 81954 - protein, 376 aa, Zea mays
MGKARHAAKLSLALIPKTKLRSHAASPSTQPPSAHPPANPTKPGKNPHGSSKNFTAVAPVAAVHEERKPIRTPADLAAAIRAAADADIDAAAALALSAPPDVPLPTHSLALLLRRLFTTRSVAAARSLLDKLHPSGEDGCPRPNPAPRGALLALADAVCRRGEPREISRVLPVLRDHGVRADAHLYNALMKANVAADDPGAVLRVFRQMRSDGVDPDLVTYNTLIFGLARAGMVAKARAFLDAMAAEGHLPDVVTYTSLMNGMCVKGDALGALKLLEEMQGKGCQPNERTYSTLLMGLCKNKKLDKAVEVYKSMAAAGTKLESPAYASFVRALCRSGSVADAYEVFDYAIQTKSFAEVTAYSELENSLKWLRRMNS

SEQ ID NO: 81955 - protein, 502 aa, Mycobacterium bovis AF2122/97
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPDTARWYLLKGRIADARSALRRIQPEADIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSLMLTSTLTANAIVAAFSLTMLRVLGGAGVFAVFGTFAVVAFVVVYRFAPETKGRKLEEIRHFWENGGRWPAERSPAADEP

SEQ ID NO: 81956 - protein, 82 aa, Clarkia biloba subsp. biloba
TNLPLVEKFGIDPNNAFAFWDWVGGRYSVCSAVGVLPLSLQYGFAVVEKFLQGAHSIDQHFSSAPFEKNIPVLLGLLSVWNV

SEQ ID NO: 81957 - protein, 337 aa, Zymomonas mobilis subsp. mobilis ZM4
MAVKVAINGFGRIGRLAARAILSRPDSGLELVTINDLGSVEGNAFLFKRDSAHGTYPGTVTTEGNDMVIDGKKIVVTAERDPANLPHKKLGVDIVMECTGIFTNTEKASAHLTAGAKKVLISAPAKGDVDRTVVYGVNHKDLTADDKIVSNASCTTNCLAPVLHVLQQKIGIVRGLMTTVHSFTNDQRILDQIHSDLRRARTASASMIPTSTGAARAVALVIPELKGKLDGISIRVPTPDVSLVDFTFVPQRDTTAEEINSVLKAAADTGDMTGVLGYTDEPLVSRDFYSDPHSSTVDSRETAVLEGKLARVVAWYDNEWGFSNRMVDTAAQMAKTL

SEQ ID NO: 81958 - protein, 397 aa, Zymomonas mobilis subsp. mobilis ZM4
MAFRTLDDIGDVKGKRVLVREDLNVPMDGDRVTDDTRLRAAIPTVNELAEKGAKVLILAHFGRPKGQPNPEMSLARIKDALAGVLGRPVHFINDIKGEAAAKAVDALNPGAVALLENTRFYAGEEKNDPALAAEVAKLGDFYVNDAFSAAHRAHVSTEGLAHKLPAFAGRAMQKELEALEAALGKPTHPVAAVVGGAKVSTKLDVLTNLVSKVDHLIIGGGMANTFLAAQGVDVGKSLCEHELKDTVKGIFAAAEKTGCKIHLPSDVVVAKEFKANPPIRTIPVSDVAADEMILDVGPKAVAALTEVLKASKTLVWNGPLGAFEIEPFDKATVALAKEAAALTKAGSLISVAGGGDTVAALNHAGVAKDFSFVSTAGGAFLEWMEGKELPGVKALEA

SEQ ID NO: 81959 - protein, 298 aa, Rhodococcus sp. T104
MTTSPFRPDALAGKRVLITGGGTGLGRGVARHLVDHGAEVHLWGRRPAVLEEAAAEASVSRPGSVHWQTVDVRKADLVSAAMDEIWTLHGPLTGVINNAAANFIAPTESLSARAFEAVTSTVMNGSFNTTHAAGRRWIEGGNKGVVLSTLTTWVWSGSAFVVPSAMAKAAVHSMTMSLAVEWARYGIRLNALAPGPIPTDYAWEMLNPTDKSAVGATQADQVPMGRMGTMEELANLTTFLLSDACDYLTGQTIAMDGGQMLAGPGTFAGLTSMTNEDWATAREKSKAASEAAKAQRGV

SEQ ID NO: 81960 - protein, 231 aa, Chaetoceros muellerii
CTFVMCQYWSTSMFAKEVAGTANALVGGWGNLGGGVTQLVMGSVLFPLFKQGMSPEMAWRTVSIVPACVGFLTGYTIMEISDDCPKGNYKEMKQNGIMNEISAAASFRDGALNFNTWLLFIQYGCCFGVELTMNNAAASYFKETFDLSTESAAAIASIFGWMNLFARGLGGFTSDKLNAKMGMRGRLIVQTITLAVEGVMVLVFAQTKSLGLAIFVLVIFSTMVQAAEGST

SEQ ID NO: 81961 - protein, 327 aa, Bradyrhizobium sp. ORS278
MSHRFQTIAVVGAGAWGTALAAVAARAGRNVTLYARDADHAVRIATARENPRLPGIPLADSITVTTDLARAARADAILIVVPAQHLRGAVMHLAPLLAPGTPLVACAKGIEHSTHKFMTEVIAEAAPRATPAILSGPSFADDVARGLPTAVTLAAPDEALASALVQALGSSTFRPYHSTDVRGVEIGGAAKNVLAIAAGIVSGRDLGASALAALTTRGFAELVRLGRAYGARSETLTGLSGLGDLILTCAGPQSRNFAAGLALGRGEPLPAGKLAEGQYTAPVLVELAASRGVEMPVAQAVAAILSGTVTIDAAIEALMLRPFKAEE

SEQ ID NO: 81962 - protein, 539 aa, Picea sitchensis
MSCLRIYSMCIASAFLLSLLLCSMHPTAALAALSSEEAVPGGIVHLEASPPAPLAENSSLVLAARRTHRHDPLDNFKRYGGGWNISNEHYWASVGLTGAPYFAIACLWFIGFGLVLSALLCYHCCCKRRVKLDELHEKAYTISLILLVLFTCAGVAGSILLYVGQDKFHRSISHTLDYVVDQSKFTVQNLRNVSEYLDLAKTAGVDQVFLPVSNQQKIDDLNRKLNREANNLESKTNDNSRTIKDVLENVRFTLIVVAAAMLLLAFLGLLFSILGLKTLVYFLVLGAWFLVAGTFILCGVFVLLNSAVGDTCVAMKEWVAHPYEDTALDHILPCVDVATAEQSLNQSKEVTSKVVAVVNQVLSTVANRNLPPNAGPLYYNQSGPLVPTLCSPYTVRLDNRQCNAGEVNLTNAVQVWKNYTCTVSSSGICATTGRITPDIYKQLVLAVNISYGLYHYTPFLVSLEDCTFVRDTFGTITKNYCPGLREHLRWVYIGLAFVSTGIMLSIIFWVVYSKQRRRRDEYLKQHGDGQFMARDNKSV

SEQ ID NO: 81963 - protein, 419 aa, Bacteroides fragilis NCTC 9343
MQTIDNFNFAGKKAFVRVDFNVPLDENFNITDDTRIRAALPTLKKILADGGSIIIGSHLGRPKGVADKFSLKHIVKHVSELLGVEVQFANDCMGEEAAVKAAALQPGEVLLLENLRFYAEEEGKPRGLAEDATDEEKAAAKKAVKESQKEFTKKLASYADCYVNDAFGTAHRAHASTALIAKYFDTNNKMFGYLMEKEVKAVDKILNDIKRPFTAIMGGSKVSSKIEIIENLLNKVDNLIITGGMTYTFTKAMGGQIGLSICEDDKLDLARELMQKAKDKGVNLVLAVDAKIADAFSNDANTKFCPVNEIPDGWEGLDIGPKSEEIFAEVIKNSKTILWNGPTGVFEFENFTHGSRSVGEAIVEATKNGAFSLVGGGDSVACVNKFGLANGVSYVSTGGGALLEAIEGKVLPGIAAIQE

SEQ ID NO: 81964 - protein, 318 aa, Shigella boydii
VVDAAVEKAYKGERKISWMEIYTGEKSTQVYGQDVWLPAESLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKYWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLR

SEQ ID NO: 81965 - protein, 183 aa, Triticum aestivum
  misc_feature (40)..(40): Xaa can be any naturally occurring amino acid
RSLPRNRLRSREDGLARVETDALTPSRRDHYCRPFTVFKXSRRAQSVVASLASDKNVWDAVLKNERVMEFYKSHQQTLVNTFPEGTDSSDSVESPEKFEEASPEYALPTASPLSDFVDNAKKTMMEMVDNITNFFQDLFHNPAEAEAGPGSSSKKPSFAEMAAGGSFVALAMAVILVVLFKRA

SEQ ID NO: 81966 - protein, 1097 aa, Candida albicans
MSTSQPSQQQNPEQVVNDIRQKIEKERKIIQGFNDVKRNTNNPEVIQKWKSKIIESQSMIDYYQETMNKLTRQMQRLNTNSSSRTASRSSVISEYKPSYSNFDLIKYECPSLGNKIQFMLQYLEFKLQVENKYSEANKKLSHLYLMDGDKSSSNAAEGGRAESDQRIQLLEKALKKYQKFSINDHEFDRDYEIMDSTKHSRKLLTGRLTVSITCIRDVDHIATALAKKRETVVVIKVDDLEKARTKPSKNDNWNEEMVIDVDKSHEIELAVMDKQNGIYVPVAVNWFSLFDLAEEIRKKKVAKDQGSSGWLPAANLPQTGGSGAGTGSSMTGGASYGATSPLPAHNDLRPSVSPSSDAKENKVSVSTWLSLEPGGQMLINLNFEKSITNGKQFRGPLGRHGAIRQKKEEVFEKHGHQFVQKQFYNIMSCALCGEFLRYTGYQCQDCKFLCHKKCYQKVVTKCISKSGSDYDAAQLNHRIPHRFEPITNHGTKWCCHCGYILPWGKKNVRKCTECGVMCHAQCTHLVPDFCGMSLQMANEILATIESTKVSPKKAQHQQSHAKPLPPKPPIESKPSMDSEETLHNEPSYKSLRPASVVHQDTNFVSKLPTTVQNKYQEPVELPPQQQNQVVPSTRRRGHGSTDLSFETGYGQQQHQHHRDVPQIVVEDHQHYNSNDNRDVEMEESKDEFDNFDYNNKYTENEILTDVQQDQVRSPFADQIQGVPETSHAKQQNQQVQQVQQQEELGHQRTHSSGKSGKSKRRKRKVGLDDFQFLAVLGKGNFGKVMLAESRHTSKLCAIKVLKKDFIVENDEAESVKSEKRVFLTANKEMHPFLLNLHCCFQTENRIYFVMEYISGGDLMWHIQKNRFTAKRAKFYACEVLLGLKYFHDNGIVYRDLKLDNILLTTKGHIKIGDYGLCKEDMWHKSTTSTFCGTPEFMAPEIVAGKAYDRSVDWWAFGVLLFQMLLCQSPFKGDDEDDIFNAIENDEVKYPINLSRQTVLVLQALLTKDPSQRLGSGPKDAEEIMEHPYFHDVNFDDVLNCRIPAPYIPEVQSEHDYSNFDKEFTSETPRLTPVETVLTSEMQEQFRGFSHISDNATI

SEQ ID NO: 81967 - protein, 135 aa, Zea mays
  misc_feature (57)..(57): Xaa can be any naturally occurring amino acid
MAEDSAAAATWGGGDKLILRGLQFHGFHGVLREEKTLGQKFVVDIDAWMDLAAAGEXDCIADTVSYTDIYSIAKDVVEGTPRNLLESVAHSIAEATLLKFPQVSAVRVKVGKPHVAVRGVLDYLGVEITRQRKKE

SEQ ID NO: 81968 - protein, 446 aa, Shewanella sp. MR-7
MADSPYNTTHEHPSLEHYWMPFTANRQFKASPRLLAQAEGMYYTDINGNKVLDSTAGLWCCNAGHGRREISEAVSKQIREMDYAPSFQMGHPLAFELAERLTELSPEGLNKVFFTNSGSESVDTALKMALCYHRANGQASRTRFIGRELGYHGVGFGGISVGGLSNNRKAFSGQLLQGVDHLPHTLDIQNSAFSRGLPSLGAEKAEVLEQLVTLHGAENIAAVIIEPMSGSAGVILPPQGYLKRLREITQKYGILLIFDEVITAFGRVGAAFASQRWGVIPDIITTAKAINNGSIPMGAVFVQDFIHDTCMQGPTELIEFFHGYTYSGHPVAAAAALATLSIYENEQLFERSFELERYFEDAVHSLKGLPNVIDIRNTGLVAGFQLAPNSQGVGKRGYSVFEHCFHQGTLVRATGDIIAISPPLIVEKHQIDQIVNSLSDGIRAVG

SEQ ID NO: 81969 - protein, 497 aa, Neptuniibacter caesariensis
MTQQVPLLINGELVQSKSENWIPVTNPATQEVIAQVPCATADEVEQAIDAAKAAFEDWKDTPVGERARLMLRYQAILKERQDDIARLISQEVGKTFEDAKGDVWRGIEVVEHACNIASLSMGETVENVARKIDCYSITQPLGVCVGITPFNFPAMIPLWMFPMAIACGNTFVLKPSEQDPLTPMLLAELFKEAGAPDGLLQVVHGAKDVVDQLLVHKDTPAISFVGSVNVGEHIYRTGTDKMKRVQAFAGAKNHMVVMPDASKNQVVNSIAGASVGAAGQRCMAISVAVFVGEARQWIPEVRDALAKVRPGAWDDPEAGYGPLINPQARERVLNFIQEGKDAGAECILDGSECVVDGFPDGNWVGPTMFRGVTRDMSIYQEEIFGPVLIALEVDTLEEAIELINENPYGNGTSMFTSSGAAARKYQHEIKVGQVGINVPVPVPLPMFSFTGWRKSFYGDQHAYGKQAVKFYTETKTVTARWFEDDIDTGVNTTIQLK

SEQ ID NO: 81970 - protein, 496 aa, Shewanella sp. MR-7
MLTMTHYVNGEHTAASTRSQEIFEPATGECRGQVSLASRDEVSAAIAIAKSAFDTWSQVTPLNRARVLFKFKALVEQHMDELARLITLEHGKVLEDARGELIRGLEVVEFACGIPHLLKGEHTEQVGGGVDAWSVNQALGVVAGIAPFNFPVMVPMWMFPIAIACGNTFIMKPSEKDPSAVMRIAEFLTEAGLPAGVFNVVNGDKEAVDTLLSHEDIQAVSFVGSTPIAEYIYSTASKHGKRVQALGGAKNHMLLMPDADLDQAVSALMGAAYGSAGERCMAISVVLAVGDVGDKLVDKLLPQIQQLKVGNGLTPEMEMGPLISRQHHAKVTEFVDAGVQEGATLVVDGRQLTVADHQQGYFLGACLFDNVTPEMRIYREEIFGPVLSIVRVKDYASALALINQHEFGNGTAIFTQSGEAARHFCHHVQVGMVGVNVPIPVPMAFHSFGGWKRSLFGPLHMHGPDGVRFYTKRKAITARWPVGKQTQAEFVMPTMK

SEQ ID NO: 81971 - protein, 561 aa, Solibacter usitatus Ellin6076
MYHFGIMRLLVIFLLASLGSAQDRSQARSMVLSDRGIAATSQTLASQAGAQVLARGGSAIDAAIAANATLGVVEPERGGIGGDLFVIYWEAKTGKLTGINASGWAPKGLTIDALKAMGNTSMPQTGIHAVTVPGCVDGWAKLHQKFGKLPWKDLFAPAIYYAKNGFPVTEIIHETWHEESAKLAADVNGRRVYMKNGETPKLGEIARNPELAAAYELIAAQGAAAFYKGAIAKAIVKTSERLGGKMSAADLSEFASEWVTPVSTEYRGWKVYELPPNSQGIGPLEMLNIMSAFPMGSYAPRGVEELHAQIEAQKLTFADLHRYLADPRVSKVPVEGLIAPAFGRERAKLIDANRARCEETPGAPDTVAGNTVYLSVVDREGNIASLIQSVYQHFGSGVVVDDYGFALQNRGALFELDPAHPNALAPRKRPYQTIIPAFMEKGDVHIGFGIMGGMNQTPAHGQFVSNVVDHGMSIQMALEAPRFTKLKFSGCDILMENRVRKEVRDALAAKGHEIKVVGDFSNQMGGGQAVIYNSATGVKYGASDPRKDGSAVPEPHPYFKP

SEQ ID NO: 81972 - protein, 635 aa, Xanthomonas campestris
MSFDSSDSRNGGPRHVSRRHFVQGLASGGAVATLGLWPQLSWALKGSGQSNVLSGTEFDLAIGETPVNFTGRARPAITVNGSIPAPLLRWREGTTVNLRVSNVLPAESIHGHETSIHWHGILLPANMDGVPGLSFAGIGRGDTYHYRFTVQQGGTYWYHSHSAFQEQAGLYGPLVIDPIEPEPFSFDRDYVVMLSDWTDLDPAALFARLKKMAGHDNYYRRTVGDFVRDAREDGLKATLADRKMWGQMRMTPTDLSDVNANTYTYLMNGTTSLGNWTGLFRSGEKVRLRFINGSAMTYFDVRIPGLKMTVVAADGQYVHPVSVDEFRIAVAETFDVIVEPSGQDAFTIFAQDSGRTGYISGTLAVREGLRAPVPSVDPRPILTMADMGMDHGGMSGMSMSASDSSDSSDSSNKPAMAMNMAGMAHEPGQRSPAGADADPHAGHDMSGMQSGSMPGMDHGAGMQAHPPSEDRNPLVDNQAMTPTSRMDDPGNGLRGNGRTVLTYAMLKSTFEDPDGRAPGREIELHLTGHMEKFAWGFNGQKFSDVTPLRLNYGERLRIVLVNDTMMSHPIHLHGMWSDLEDDGGNFQVRKHTVDMPPGSKRTYRVRADALGTWAYHCHLLYHMEAGMMRAVKVEE

SEQ ID NO: 81973 - protein, 249 aa, Deinococcus radiodurans R1
MIVKYGGNAMKSLDLRRAVARELGTLRGAMPLVVVHGGGPVIERELAARGVASEFIGGLRVTTPEAMDVVEMALCQLNKQLSQDIGQAVGLMGRDDELLRAEVLDPQLGRVGRVTGVNAGLLRTLLGAGLTPVVGCVAVGEDGEALNVNADTVAGAVAGALGEGAVFLTDVDGVYRAYPDPDSRAAQLTRAEVEDGLAAGWIAGGMIPKVRAALDALGRGAPFAIIASGMTAGVLAQAARGEAGTRIVP

SEQ ID NO: 81974 - protein, 273 aa, Lentisphaera araneosa HTCC2155
MLLELDRYKFIEEVERLLQGVGDFQLDNFRDLEVQEEEKEPRELVSFVDRQSESMLFEGLSPLYPEAEFWGEENGKRGEADWMWLVDPLDGTTNYLNHLDQFSISVALLYKGKPQFGAVYKPISSEFFHAFKGLGFFHNHKQLHSLQTQRSFEKAMIGTGFPYRSPDLKDQFFSLIEDLMPRCRGIRRFGSAALDLSYVAAGWLQGFWESDLQPYDVGAGLLFLEEMGMTVSNHKGEAYDMNVDRMLVTAKPEVHKELLARVADHYGEEGLQF

SEQ ID NO: 81975 - protein, 497 aa, Brassica juncea
MVALTAEKQDQNLLSRMAAGDGHGENSAYFDGWKAYEENPFHPINRPDGVIQMGLAENQLCGDLMRKWVLEHPEASICTAEGVNQFSDIAIFQDYHGLPEFRQAVAKFMEKTRNNKVRFDPDRIVMSGGATGAHETVAFCLANTGEGFLVPTPYYPGFDRDLRWRTGVNLVPVTCHSSNGFKITVEALEAAYENARVSNIPVKGLLITNPSNPLGTTLDRDCLKSLVNFTNNKGIHLIADEIYAATTFGQSEFISVAEVIEEVPHSNRDLIHIVYSLSKDMGLPGLRVGIVYSYNDRVVQIARKMSSFGLVSSQTQHLIAKMLSDEDFVDEFIRKSKLRLAARHAELTTGLDGLGIGWLKAGAGLFIWMDLRNLLKTATFDSEMELWRVIATNKVKLNVSPGGSCHCNEPGWFSMFANMDHKTMETALERIRVFTSQLEEESLKQTKPMAAPTVMAKKKMCWQSSLRLSFKDTRRFEEGFFSPHSPVPHSPLVRAQI

SEQ ID NO: 81976 - protein, 210 aa, Arabidopsis thaliana
IEQVKKLYELFRKTDCTMLEINPLAETSTNQLVAADAKLNFDDNAAFRQKEVFAMRDPTQEDPREVAAAKVDLNYIGLDGEIGCMVNGAGLAMATMDIIKLHGGTPANFLDVGGNASEHQVVEAFKILTSDDKVKAILVNIFGGIMKCDVIASGIVNAAKEVALKVPVVVRLEGTNVEQGKRILKESGMKLITADDLDDAAEKAVKALAH

SEQ ID NO: 81977 - protein, 261 aa, Xylella fastidiosa 9a5c
MRTMTQSRWRLDGRTALITGASTGIGLAVARELLGLGADVLLVARNADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDVYYYEQVIERTPMRRIGEPEEVAAAVAFLCLPASSYVTGECIAVDGGFMRYGF

SEQ ID NO: 81978 - protein, 205 aa, Gossypium herbaceum
HTCGEHVGLNVNGEPFVACHECNFPICKSCFEYDLKEGRKACLRCGSPYDENLLDDVEKATGDQSTMAAHLSKSQDVGIHARHISSVSTLDSEMTEDNGNPIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVICEIWFAF

SEQ ID NO: 81979 - protein, 410 aa, Streptococcus thermophilus CNRZ1066
MSALDAYKIRQDFAILDQVVNDEPLVYLDNAATTQKPQVVLDALMAYYREENANVHRGVHTLAERATAAYEASREKIRQFISAKSTKEILFTRGTTTGLNWVGRFAEQVLEPGDEVVISIMEHHSNIIPWQEACKKAGAKLVYAYLKDGQLDMEDLANKISEKTKFVSLAQVSNVLGCINPVKEIAQMAHRVGAYMVVDGAQSAPHMAIDVQDLDCDFFILSGHKMLGPTGIGVLYGKEEILNQMNPIEFGGEMIDFVYEQEATWKELPWKFEAGTPNIAGAIALGTAVDYLSALGMENVHAYEQELVDYVLPKLQAIEGLTVYGPEDSGKHAGVIAFNINGLHPHDVATALDYEGVAVRAGHHCAQPLINYLGISSAARASFYIYNTKEDCDKLVEAILATKEFFNGTL

SEQ ID NO: 81980 - protein, 231 aa, Chaetoceros muellerii
CTFVMCQYWSTSMFAKEVAGTANALVGGWGNLGGGVTQLVMGSVLFPLFKQGMSPEMAWRTVSIVPACVGFLTGYTIMKISDDCPKGNYKEMKQNGIMNEVSAAASFRDGALNFNTWLLFIQYGCCFGVELTMNNAAASYFKETFDLSTESAAAIASIFGWMNLFARGLGGFTSDKLNAKMGMRGRLIVQTITLAVEGVMVLVFAQTKSLGLAIFVLVIFSTMVQAAEGST

SEQ ID NO: 81981 - protein, 507 aa, Oryza sativa Japonica Group
  misc_feature (106)..(106): Xaa can be any naturally occurring amino acid
MAAARAHVKDPAHRTKVVLRRLPPAIAQQAVVEQVDARFGGRYDWSCFRPGNASQKNHRYSRLYLNFKGPEDVVEFAEVFNGHVFVNEKGAQFKALVEYAPSQQVXKSNTKKDARQGTIMKDPEYLEFLESISKPAEHLPSAEIQLERKEAERAAAGKEPPVVTPLMVYVRQQRAAKSMAQRSGSSRLSRKVAGVVTSSPSPSKRGSEKRRTSASTQYVLRENAKEKPTYILVPKRDEHAQREKDATSGGISGSAHVAENKKEKIVLLKGRARVDSNTSDVTSQQQSGTPMKNAAQSSSRQDPRLEGSGRIIKTILSNKEGRHVVTSQHDQEGHIITAEKRPPRIPNPRSVVKDQVVENAEKNHLDDKHSHLHGSGLISEKTERHARNRDRPDRGVWAPRRYDKSASGGTHSSSSEFSPMQQHSGENFCQQADGHGERKIDPRGHGGIRGGPVENGHRHANRRGPPRGLKEMEISASTSDGKPSKRASANYGAHERQVWVQKSSSAT

SEQ ID NO: 81982 - protein, 205 aa, Gossypium raimondii
HTCGEHVGLNVNGEPFVACHECNFPICKSCFEYDLKEGRKACLRCGSPYDENLLDDVEKATGDQSTMAAHLNKSQDVGIHARHISSVSTLDSEMAEDNGNSIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVICEIWFAF

SEQ ID NO: 81983 - protein, 888 aa, Erythrobacter sp. NAP1
MTTTVYPFGGAAAHDDPRQRDKTITGGKGANLAEMASIGLPVPPGFTITTEESVRYLQGGEEFRDELRGEVTNALAHIEASVGKTFGNAADPLLVSVRSGARVSMPGMMDTVLNLGLNDDTVEGLAKTSEDERFAWDSYRRFIQMYSDVVLGLDHGLFEEALEIVKEDNGFYNDTELSADDWRGIVGQFKGIVDEELGKPFPQDVNEQLWGAIRAVFDSWDSDRAKVYRRLNDIPADWGTAVNVQAMVFGNMGETSATGVAFTRDPATGERAYYGEYLINAQGEDVVAGIRTPQYLTKAAREAAGAKPLSMEEAMPDAYGELARVFDLLEGHYKDMQDIEFTVERGKLWMLQTRSGKRTAKAALKMAVDMEGEGLIDREEAVRRVDPMALDQLLHPTLDPEAPRDVLVTGLPASPGAAAGKIVLDADTAEQWANRGDKVILVRVETSPEDIHGMHAAQGILTARGGMTSHAAVVARGMGRPCVSGASGVSIDRKSRTLRIGNSEMKEGDEITLDGANGQVMMGIVPTVEPELAGDFGTLMEWADALRRMKVRTNAETPADCAMARQFGAEGIGLCRTEHMFFDASRISAVRQMILAEDERGRRKALDLLLPEQRADFTSIFEAMAGLPCTIRLLDPPLHEFLPTQDAEFEELADATGLGVDHLKRRAGELHEFNPMLGHRGCRLGITYPEIYEMQARAIFEAACDVAASSGEAPIPEVMIPLVATKRELQLLRALVDKVAAEVFEEKGASVEYLVGTMIELPRAALMAGEIAEEGAFFSFGTNDLTQTTLGVSRDDSARFLAPYVEKGIFPRDPFVSLDIDGVGQLVELAAERGRATRADIKLGICGEHGGDPASIAFCEKVGLDYVSASPYRVPIARLAAAQAALKA

SEQ ID NO: 81984 - protein, 231 aa, Chaetoceros muellerii
CTFVMCQYWTTSMFTKEVAGSANAIAGGWGNLGGGATQILVGSVLFPLFKMFMSADMAWRTVSIVPAFVAFSTGFMILCISDDCPRGNFRELKRHGVMNHVSASASFHEVAMNFNTWLFFLQYACCFGVELTMNNSAATYFHEEFNLSTEKAAAITSIFGLMNIFARGLGGFISDKFNAKMGLRGRLIWQTTCLTMEASMILCFARAPNLGVSILILVFFSISVQAAEGST

SEQ ID NO: 81985 - protein, 218 aa, Vibrio sp. Ex25
MNQSSLLAEFGDPITRVENALIALKEGRGVLLLDDEDRENEGDIIYSVEHLTNEQMALMIRECSGIVCLCLTDAQADKLELPPMVVNNNSANQTAFTVSIEAKVGVTTGVSAADRVTTIKTAANPHAKPEDLARPGHVFPLRARPGGVMTRRGHTEGTIDLMQMAGLQPAGVLCEVTNPDGTMAKAPEIVAFGRLHNMPVLTIEDMVMYRNQFELKLA

SEQ ID NO: 81986 - protein, 231 aa, Chaetoceros muellerii
CTFVMCQYWTTSMFTKEVAGSANAIAGGWGNLGGGATQILVGSVLFPLFKMFMSADMVWRTVSIVPAFVAFSTGFMILCISDDCPRGNFRELKRHGVMNHVSASASFHEVAMNFNTWLFFLQHACCFGVELTMNNSAATYFHEEFNLSTEKAAAITSIFGLMNIFARGLGGFISDKFNAKVGLRGRLIWQTTCLTMEASMILCFARAPNPGVSILILVFFSISVQAAEGST

SEQ ID NO: 81987 - protein, 473 aa, Burkholderia thailandensis E264
MAHRNDSLLTSAQQDARHLLHPWADLTALGRETPTVIVDAQGTRVTDAEGRTYLDAIGGMWCVTVGYGRREIADAIRDQALRMPFYTPFGAMTNAPAAALGARLAERAPGDLKRVHLTTCGSTAVESALRFAHYYFGATGRPHKRHIVTRGDAYHGSTYLAASVSGKAWDRTCFHYDSTIVHHLSSPNPYRRPAGMSVAAFCASLVDEFDALIAKLGADRIACFIAEPILASGGVIVPPPGYLAAMRERCRRHDILYISDEVVTGFGRVGHFFASQAHFGIEPDMIVVAKGLTSGYQPLGAVLISERLVEAVSGERAYGNGVFTNGFTYSGHPVACAAALANIELMERERICEHVRDVGPYFIRRLDALRRFPIVGDVRGDHLMACIECTSGAGATGALPTPADIAIAQRVDRHCEEMGLLVRPYESMCILSPPLTVTRADIDEICEILAAALERTQRELAERAPVREENETC

SEQ ID NO: 81988 - protein, 113 aa, Oryza sativa
MAANQSIKELMAAETKASKIISEARQERGERLKQAKIEAEAEINAYRKQQEHQFQMSANTDLMGDDPSILDEDTAREIQKMRGEFEMNKAGVIQMMVEHVGRVQLKVPDARKA

SEQ ID NO: 81989 - protein, 1148 aa, Saccharomyces cerevisiae YJM789
MDQDNNNHNDSNRLHPPDIHPNLGPQLWLNSSGDFDDNNNNNNNNNSTRPQMPSRTRETATSERNASEVRDATLNNIFRFDSIQRETLLPTNNGQPLNQNFSLTFQPQQQTNALNGIDINTVNTNLMNGVNVQIDQLNRLLPNLPEEERKQIHEFKLIVGKKIQEFLVVIEKRRKKILNEIELDNLKLKELRIDNSPQAISYLHKLQRMRLRALETENMEIRNLRLKILTIIEEYKKSLYAYCHSKLRGQQVENPTDNFIIWINSIDTTESSDLKEGLQDLSRYSRQFINNVLSNPSNQNICTSVTRRSPVFALNMLPSEILHLILDKLNQKYDIVKFLTVSKLWAEIIVKILYYRPHINKKSQLDLFLRTMKLTSEETVFNYRLMIKRLNFSFVGDYMHDTELNYFVGCKNLERLTLVFCKHITSVPISAVLRGCKFLQSVDITGIRDVSDDVFDTLATYCPRVQGFYVPQARNVTFDSLRNFIVHSPMLKRIKITANNNMNDELVELLANKCPLLVEVDITLSPNVTDSSLLKLLTRLVQLREFRITHNTNITDNLFQELSKVIDDMPSLRLIDLSGCENITDKTIERIVNLAPKLRNVFLGKCSRITDASLFQLSKLGKNLQTVHFGHCFNITDNGVRALFHSCTRIQYVDFACCTNLTNRTLYELADLPKLKRIGLVKCTQMTDEGLLNMVSLRGRNDTLERVHLSYCSNLTIYPIYELLMSCPRLSHLSLTAVPSFLRPDITMYCRPAPSDFSENQRQIFCVFSGKGVHKLRHYLVNLTSPAFGPHADVNDVLTKYIRSKNLIFNGETLEDALRRIITDLNQDSAAIIAATGLNQINGLNNDFLFQNINFERIDEVFSWYLNTFDGIRMSSEEVNSLLLQVNKTFCEDPFSDVDDDQDYVVAPGVNREINSEMCHIVRKFHELNDHIDDFEVNVASLVRVQFQFTGFLLHEMTQTYMQMIELNRQICLVQKTVQESGNIDYQKGLLIWRLLFIDKFIMVVQKYKLSTVVLRLYLKDNITLLTRQRELLIAHQRSAWNNNNDNDANRNANNIVNIVSDAGTNDTSNNETNNGNDDNETENPNFWRQFGNRMQISPDQMRNLQMGLRNQNMVRNNNNNTIDESMPDTAIDSQMDEASGTPDEDML

SEQ ID NO: 81990 - protein, 231 aa, Ditylum brightwellii
CTFVMCQYWSSRMFTKEVVGTANALVGGWGNLGGGETQLVMGPLLFPLFKTGMSAEMAWRTVSIVPAIVAFSTGITVYFISDDSPKGNYSDLKKHGNMPEVSAAASFRSGAMNFNTWILFIQYACCFGVELTMNNAAALYFREEFNQSTEAAAAIASIFGWMNLFARGVGGFASDKMSARMGMRGRLIVQTVLLACEGAMVLIFANTSNLAGAIVVMIVFSIFVQAAEGST

SEQ ID NO: 81991 - protein, 544 aa, Yarrowia lipolytica CLIB122
MVLSEHVNADKLLSNLTGKGDEHAIRALIASHTLRDPYSSKYNSQEPIPKFRIPEEGCEEKQAYQLIKDDLDLDGKPNLNLASFVNTYISDRAEKLAVENLTKNLADADEYPALMTVHARCVSILGHLWNNTDHEKAIGTATTGSSEAIHLGGLAMKKRWQEKRRAAGKSTEKPNILMAANAQVALEKFARYFDVEDRIIPVREASKHCLDLSKIKENLDENTIGIFVIMGSTYTGHYEDVQGVAKILDEYEKETGHSIDIHVDGASGAMVAPFLYPDLEWDFRVPRVKSINTSGHKFGLTTAGLGWILWRDAKYLPKELIFELHYLGGKEESYTLNFSRPGFPVLHQYYNFLHLGFDGYKQLHASSMANARLLSVFLEATGHYTCVSEIHLPANGSKPKDVKHVATADPLQYMAGLPVVAFRFSDSFRKAHPEVPQAAVSTLLRVKGYIIPNYELPPSEQKTEILRVVVRQSMSIDLLDRLMEDISAITNVLLEAVEDVKKLRAEGDHDPQLIHKYVLTLVTGKPVEEREEDWEGHSTFRAAC

SEQ ID NO: 81992 - protein, 912 aa, Zymomonas mobilis subsp. mobilis ZM4
MTLTKMLIDARHREETRVAVIKGNRIEEFDFESADRRQLKGNIYLAKVTRVEPSLQAAFVDYGGNRQGFLAFSEIHPDYYQIPREDREALLREEEEYSARHNKQQESEDDEEGEDLSDSEAIRNDANDDSLENLRNRRRHFGRHHYRIQDVIRRRQVLLVQVVKEERGNKGAALTTYLSLAGRYCVLMPNTSNGGGISRKISNLADRKRLKSIMAELNLPSSMGCIVRTAGLQRTKTEIKRDFDYLARLWDEIREKTLLSQAPALIYGDSDLVKRAIRDIYSREIDEILVEGDDGYRAARNFMKLLMPSHVRKVRPYADPAPLFQRFGVEAQLNAMYQPIVQLKSGGYLVINPTEALVSIDINSGRSTREHNIEQTATATNLEAAAEIARQLRLRDMAGLIVIDFIDMESSANIRRVEKAMKDALKHDRARIQVGHISSFGLMEMSRQRLRTGMLEASTVPCPHCQGSGLMLTTPSAGLMALRMIEDEASRGNGSQIHVLTSLDSAIYVLNKKRKELGSIETLYGVTILIDGDPLRGNNQISVESAGPPPSHGLMLPPPLPTSSPDEIDDYEEEPEIEEIEAEEVIEAPFRRNHRQNMARRNSSYNAEVAIQDNQRMEPKEATQAFLNTEEDASHEEDSEHSRRNRRSRRGRRGGRRRNGENFAEKPLMLSSEASEATSPDEDTPIKESYESEALPVEKDVAEKSTPTEETSEAENKTARSSRTRRRPRARSPKVESESYQAPANVLHEETPPTETAVVEVKNEEPIAEKPATEAETAVVASSEPETVEETKPKRVRKRTTTTRRKKAEPKTADKAEESEDSEAEAKPKRPATRRTRTTKAATAKVAAKKAETESETPVVVKAEAKTIEKTDDTAIKSETPKDSDAAPVSDSKEEAEKPAPRRGWWQRTFGE

SEQ ID NO: 81993 - protein, 231 aa, Ditylum brightwellii
CTFVMCQYWSSRMFTKEVVGTANALVGGWGNLGGGVTQLVMGSLLFPLFKTGMSAEMAWRTVSIVPAIVAFTTGITVYFISDDSPKGNYSDLKKHGNMPEVSAAASFRSGAMNFNTWILFIQYACCFGVELTMNNAAALYFREEFNQSTEAAAAIASIFGWMNLFARGVGGFASDKMSARMGLRGRLIVQTILLACEGAMVLIFANTSNLAGAIVVMIVFSIFVQAAEGST

SEQ ID NO: 81994 - protein, 306 aa, Erythrobacter sp. NAP1
MKATSILETIGNTPHIRLSRMFPDHEVWLKSERANPGGSIKDRIALAMVEDAEASGALKPGGTIVEPTSGNTGIGLAMVAAVKGYTLVLVMPESMSIERRRLMLAYGATFDLTPKEKGMKGAIERATEIVETTEGAWMPSQFDNGSNPAVHARTTAKEILGDFADNPIDVMITGVGTGGHLTGCAEELKKSWSDFKAYAVEPVGSPVISGGEPGPHPIQGIGAGFIPGNLHTNAIDGAIKVDPEDAKEMARRAAREEGMLIGISSGATLAAIAQKLPDLAAGTRIMGFNYDTGERYLSVPDFLPVE

SEQ ID NO: 81995 - protein, 321 aa, Candida albicans
MSTNSIKLLASDVHRGLAELVSKRLGLRLTPSELKRESTGEVQFSIGESVRDEDIFIICQIGSGEVNDRVFELMIMINACKTASARRITVILPNFPYARQDRKDKSRAPITAKLMADMLTTAGCDHVITMDLHASQIQGFFDVPVDNLYAEPSVVRYIKETIDYSEAIIISSDAGGAKRAAGLADRLDLNFELIHKERARANEVSRMVLVVDVTDKICVIVDDMADTCGTLAKAAEVLLDNNAKDVIAIVTHGILSGNAIKNINNSKLKKVVCTNTVPFEDKLKLCLKLDTIDISAVIAESIRRLHNGESISYLFKNAPCK

SEQ ID NO: 81996 - protein, 318 aa, Pachysolen tannophilus
MTLQYYTLNNGRKIPAIGMGCWKLENAADMVYAAIKEGYRLFDCACDYGNEKEVGEGINRAIKDGLVKRKDLFITSKLWNNFHAKENVKKALMKSLSDFNLDYFDLYLMHFPISFKFVPFEEKYPPGFYCGDGDKFIYEDVPIIETWRAMENLVDEGLVKSIGVSNVSGGLLEDLIKAARIKPASLQIEHHPYLQQNKLVEYAQLKGIVVTGYSNFGPLSFLELGNETAKKTQPLYENKTITTIAAKHGKTPFQVLLRWVNQRGIAIIPKSTFPNTLAVNLHVDEFDLTKEDFEEIAKLDRHLRFNDPWTWDKIPTFV

SEQ ID NO: 81997 - protein, 315 aa, Bacillus caldolyticus
MSDCQHQLKLFALNSNMKLAKEIAEVMGIELGKCSVSRFSDGEIQINIEESIRGDDVFVIQSTSVPVNEHLMELLIMIDALKRASARTINIVMPYYGYARQDRKARSRNPITAKLVANLLETAGASRVITLDLHAPQIQGFFDIPIDHLMGVPILADYFKSKQLEDIVVVSPDHGGVTRARKLADRLKAPIAIIDKRRPKPNVAEVMNIVGQVAGKTAILIDDIIDTAGTITLAANALAESGAKEVYACCTHPVLSGPAIERIQSSKIKELVVTNSIALPEEKKIDKIVKLSVRPLIAEAITRVYEMKSVSVLFD

SEQ ID NO: 81998 - protein, 157 aa, Enterococcus faecalis V583
MIRIGQGFDVHQLVPQRPLIIGGVTLPYEKGLLGHSDADVLTHAIIDAILGAAGLGDIGQLFPETDPQFKNANSVNLLKKVNEKVGRSGFTIGNIDCTILAEEPKMSPYLAEMKKNLAASCHLAVTQVNIKATTMETMGFVGKKEGIGAIAVALLEK

SEQ ID NO: 81999 - protein, 309 aa, Streptococcus agalactiae NEM316
MRCSTKEMRLVYRDFLLQANQENKQITVLEADLSSSMSTNVLASEFGKRYINLGIMEAEMVGLAAGLAIKGYKPYLHTFGPFASRRVFDQVFLSLGYSQLSATIIGSDAGVSAEMNGGTHMPFEELGLLRLIPKATIFEVSDDIQFEAILKQTLSIDGLKYIRTIRKAPTAVYEGCEDFSKGFIQLRQGKDIALVASGIMVSRAIEAADYLKELGIEASVIDLFKIKPLPEELKPLLIDQSIVTIENHNRIGGIGSALCEWLSMEKDTTVSRMGIDERFGQVGQMKYLLEEYGLAVKDIVEHCKSIYKS

SEQ ID NO: 82000 - protein, 179 aa, Enterococcus faecalis V583
MSWLKRSVAAVKRNDPAARTTLEVLLTYPGLHALFWHRLSHFLYRHQLFLLAKIHAQFWRFITGVEIHPGATIGAGVFIDHGMGIVIGETAEIEEDVVLFHGVTLGGTGRDTGKRHPTVKKGAMISARAQILGPVVIGERSKIGAGAVVISDIPADATAVGVPAKVVRLNGRKVEKGHD

SEQ ID NO: 82001 - protein, 360 aa, Magnaporthe grisea 70-15
MKSYSIASIPADGIGPEVIDASIAVLNTLADTLGSFNIEFTHFDWSSDTYKKTGKYIPDGGLDKLKKHDAILFGAVGSPEVPDHVSLWGLRLAICQPFQQYANVRPTKIFRGTRSPLRDCATSDLDWVIVRENSEGEYAGQGGRSHRGLPWETATEVAIFTRHGVERIMRFAFELARNRPRKLLTVVTKSNAQRNGMVLWDEVAAEVARDFPDVTWDKMLVDAMTCRMVLKPESCDTIVASNLHADILSDLAAALAGSIGIAPTSNLDPSRQNPSMFEPIHGSAFDITGKGVANPVATFWTSAEMLAWLGEKDASMKLLEAVERVCEKGVVTADLGGTATTKQVTDAVIDEIKALYGKSS

SEQ ID NO: 82002 - protein, 240 aa, Triticum aestivum
  misc_feature (140)..(140): Xaa can be any naturally occurring amino acid
  misc_feature (203)..(203): Xaa can be any naturally occurring amino acid
  misc_feature (218)..(218): Xaa can be any naturally occurring amino acid
MAMARRRALALVSQLLQRRVLPAPRFLSSAAGGALDRLNSPPFARPAAPRNPAPPSPWDRLGGQKRTMFIQTQSTPNPQSLMFHPGKPVMEVGSSDFPHARTAMTSPLAKALFAIEGVTRVFFGSDFVTVTKSDETSWDXYLKPEVFAAIMDFYSSGQPLFLDSNTAAAMDTAIHEDDSEIVAMIKELLETRIRPAVQDDGGXDIEYRGFEPETGIVXKLKMPGACQWLPRVHPAPVEFL

SEQ ID NO: 82003 - protein, 221 aa, Triticum aestivum
MDAMAALARTGPSLAAAGHRSSATFRPSASLSSFASASSRNRGRVGLSTAGCNRWATRVARATPNRIVASSEVEQTYIMIKPDGVQRGLVGEIISRFEKKGFLLKGLKLFQCPKDLAQEHYKDLKERPFFPNLIDYITSGPVVCMAWEGDGVVASARKLIGATNPLQVEPGTIRGDLAVQTGRNVVHGSDSPDNGKREIGLWFKEGELAQWESVQTPWLIE

SEQ ID NO: 82004 - protein, 258 aa, Salmonella enterica subsp. arizonae serovar 62:z4,z23:--
MMNPLIIKLGGVLLDNEEALERLFTALVNYRESHQRPLVIVHGGGCVVDELMKGLNLPVKKKNGLRVTPADQIGIIAGALAGTANKTLLAWAKKHHIASVGLFLGDGDSVKVIQLDEALGHVGLAQPGSPKLINTLLENDFLPVVSSIGVTEDGQLMNVNADQAATALAATLGADLILLSDVSGILDGKGQRIAEMTAAKAEQLIDQGIITDGMIVKVNAALDAARALGRPVDIASWRHADQLPALFNGTPIGTRILA

SEQ ID NO: 82005 - protein, 713 aa, Thermus thermophilus HB27
MEGTPNVPQAHRYELTLAGRPLVLETGKYAKQASGSVLVRYADTVVLATAQASETPVEADFLPLTVEFEERHYAVGKIPGSFMRREGRPGEKAILSARMTDRPIRPLFPKGFRHEVQIIVTVLSADQKNPPDILGPIAASAALMLSDIPWEGPIAAVRVGLIGGSFVLNPTLQELEESQLDLVVAGSKEAILMVEAEAGEVDEETLVQALEFAHKEMQPILELQEAMARELAKPKMAWTPPESLPEEEKEALYRLALERGLSQVLQTASKGERSRALAEFAERLIAEALPKGEDGTPDEGKKPLYESAFDEVVRRELRRLVLEEGKRADGRGPKDLRPIWIEVDVLPRAHGSAVFTRGETQVLGTVTLGTGRDEQILDDLGIDETEKFLVHYNFPPFSTGEVRRLRGVSRREVGHGNLAKRALKAVMPKEEDFPYTIRVVGDVLESNGSSSMATVCAGCLALMDAGVPIRAPVAGVAMGLVWEENRAVILTDILGLEDALGDMDFKVAGTRKGVTALQMDNKVGGLPREVLKEALLQAREARLKILDLMETVLPAPRPELKPFAPRILSLKVPVEKIGLVIGPGGKNVRALEELGVEVDIEEDGTVRIYSSDLNAALEAKKRIEDLTREAKVGEIYEGTVTRITPFGAFISLFPGTEGLLHISQIAPGRVERVEDHLKVGDVIKVKVHRIDERGKIDLIRPELEGKIPPRRRK

SEQ ID NO: 82006 - protein, 331 aa, Lentisphaera araneosa HTCC2155
MKITVLSSGSWGTALAKTLCDNNHDVHLWSRSQEYSDAMEAKRENFRYLPGFPLPDSLHLTADLAKAIENTDLIVTSTPTQYVRHSLEMLKEHKTTAPICNVSKGIEVSSLQRISEITSEILGESHPFCVLVGPSHAEELIKNMPTAVVVSSQFNYLAKMVQNVFMNQNFRVYTSSDLVGVELGGALKNIFAIAAGVIDGLGLGDNTKAALMTRGNVEMARLGRALGGFEETFNGLSGIGDLIVTCTSKHSRNRSVGEMLGKGLSMDDIKAKLGHSVAEGVATTKSAYQLAQQYKVEVPIIEQCYQVLYEDRSAAEAINYLMTRDAKQERN

SEQ ID NO: 82007 - protein, 131 aa, Glycine max
TNDHDIVPHLPPYYYYLRQKTYHHFPREVWLYNIGLGSLVYNVEKICDESGEDPDCSRSVTGNSIADHLVYYGVDMGSDEPSSCRIVMDSHVQNTSIRDSRGNLILSRDPATPLIKLGGEGDNQENPINVD

SEQ ID NO: 82008 - protein, 189 aa, Neptuniibacter caesariensis
MSNSLINTEVKPYNASAFHNGEFIDVSEADLKGKWSVFFFYPADFTFVCPTELGDLADYYPQLQEMGVEVYSVSTDTHFTHKAWHDTSDTIQKINFPMIGDPTGLITRNFEVMIEEAGLAERGTFVIDPEGKIQIIEINAGGIGRDAGELVRKIKAAQYVAAHPGEVCPAKWKEGEETLAPSLDLVGKI

SEQ ID NO: 82009 - protein, 332 aa, Zea mays
MRAAPWRASLHFILFFTFEMASAHAGDDVKKPDCVPGMDPRSFPGIGSGSHGGGITPVTPSHSHGGSTGTPSHGGGGGGGDLPSPSHGGTTLPSPSHGGSGGDLPSPSHGGTTLPSPSHGGSGSTPTSPSTGGSPSHGGSGSSPTAPSTGGGYGGSPSHGGGAYGGSPSTPGSGGAYGGGSPSPAHGGGAYGSSPTPAYGDAPSHGGIGTSSPTPLGDPHSFGSLPGSCDYWRSHPMEIWSAIGGRFPGTSSSMGTMGHFFGAAGRVGGTDVSIQDALANTRSDGAGALLREGAAALLNSMTRSGFPYTTEQVRDAFAAAAAEAAGGSDGAA

SEQ ID NO: 82010 - protein, 271 aa, Cucumis sativus
MSIQLLPAIARRLEGKVAVITGGARGIGEQTAKLFFKHGAKVVIADIQDHLGQTLCKDLGQSSSVFVHCDVTKEKDVETAVDTAVSKYGKLDIMLNNAGVFEESPNFDILKDDPLTFQRVVNVNLVGASLGTRHAARVMKPAGRGSIVTTASICSVIGGIGTHAYTSSKHGVLGLMRNAAVDLGRYGIRVNCVSPNVVPTEMGRKLFKVKDGGEFPSFYWSLKNGDILREEDVGEAVVYLGSDESKCVSGLNLIVDGGFTVVNQALCSFRS

SEQ ID NO: 82011 - protein, 358 aa, Cryptococcus neoformans var. neoformans JEC21
MSILTRLSSRVPYLAKQLSTMPSFQIPKTMKAIQVDAPGGPEVNVLREIPVPTPNPDEVLIKVQYTGVNYIDTYYRSGLYPKKFPYTVGQDAVGTLVQGPSSPDVKFDIPLGTTVFTPAGSSFAEYLVAPSSRVGVVPEGVDPKDGVSWSTVGLTALALAKESYPVKKGDWVLIRAAAGGVGLVLTQIVKYLGGHVIGTVSSQDKAELVKSYGADLVLLSTDPSEDNVKKILEVTNGGVHGVYDGVGKDTWEEDFLVVRRKGTIVTFGNASGAVPAFAPLKLTPKALKVTRPTVWSIVTTPEEFKEYTTELVDIVKKAGLKFEVYKVYELTQEGVVQAQKDITSRGTTGKLLIHVADK

SEQ ID NO: 82012 - protein, 521 aa, Thermus thermophilus HB27
MADNARLILDELLAELEERRRRVLQGGGEERVKKQHQQGKLTARERIDLLLDPGSFVELMPFAEHLETGLMEGIEAPADGVVTGYGTIGGRLVFVFSQDFTVLGGSLGKMHGRKIASLMDLAAKVGAPIVGLNDSAGARIQEGVDSLSGYGEVFYRNAIYSGVVPQISAILGPCAGGAVYSPAMTDFILMSRGTSYMFITGPEVIKSVTKEEVTFEELGGADVHMEKSGVAHLEGKDDKEVLDLVKKLLSYLPQNSREKPPVLEPKDDPFRPTPELLEIVHPDARRPYNMHQVIRTLLDDGEFLEIQPRYARNIIVGLGRLGGYPVGVIANNPRFMAGALDINASDKAARFIRTMDAFNIPLLTLVDVTGFLPGVAQEHGGIIRHGAKMLFAYAEATVPKITLIARKAYGGAYLAMNSKDMGADVVLAWPTAAVAVMGAEGAANIIYRKEIQSSQNPEETRRRKIEEYRRAFDNPWVAAARGYIDDVIDPTHTRRVLYQHLRMLWEKQEERPRKKHDNIPL

SEQ ID NO: 82013 - protein, 205 aa, Gossypium robinsonii
HTCGEHVGLNVNGEPFVACHECNFPICKSCFEYDLKEGRKACLRCGSPYDENLLDDVEKATGDQSTMAAHLSKSQDIGIHARHISSVSTLDSEMTEDNGNPIWKNRVESWKEKKNKKKQPATTKVEREAEIPPEQQMEDKPAPDASQPLSTIIPIPKSRLAPYRTVIIMRLIILGLFFHYRVTNPVDSAFGLWLTSVICEIWFAF

SEQ ID NO: 82014 - protein, 523 aa, Pseudomonas aeruginosa UCBPP-PA14
MHVSKVFPSLRDTLPRDLMASVVVFLVALPLCMGIAIASGMPPAKGLLTGIVGGLVVGFLAGSPLQVSGPAAGLAVLVFELVRTYGVAMLGPILLLAGAIQLLAGRLRLGCWFRVTSPAVVYGMLAGIGILIVLSQLHVMLDLAPKASGLDNLLAFPQAAFAALGSLGMDSGLDAALLGLGTIAVMWGWDKLRPQRLRFLPGALLGVSLATLASLWLALDVRRVEVPANLGEAIDWLRPVDLLALADPSLLLAAVVVAFIASAETLLSAAAVDRLHDGPRSDMDRELSAQGVGNMLCGLLGALPMTGVIVRSSANVNAGARTRASAIFHGLWLLAFVLLLGSLLRQIPVASLAGVLVYTGVKLVDFKALGNLSRYGRMPMLVYAATALAIVFTDLLTGVLVGFALTLLKLVLKAARLKIALRYTGEHEAELRLSGAATFLKVPALSRVLDEVKPGTTLHVPMDNLSYVDHACMELLEDWGRMAPVQGSRLVIEPRALKRRLEGRLRGSVGLGGARNGGAVSPG

SEQ ID NO: 82015 - protein, 580 aa, Zea mays
  misc_feature (57)..(57): Xaa can be any naturally occurring amino acid
  misc_feature (66)..(66): Xaa can be any naturally occurring amino acid
SAAATQSHTLTHTHQLGAAEMQQRRKSVFASAPFAMKQAALGAGVAARKNGAPLSLXAAVVFALFXVFATFLYNEDIKSITDFQFSSGAIRAKSPDLHLLQEAEAAAHAAVNTLAKRGEEVIVRVLEVEAPPVVNTSSVLAAAAKANAKAKANAVDVGQEKERDVTLPTVTGGRGGADEARRRADEEVAEKAASAKAAAATAALRGVVSVPQTCDLYRGSWVYDEVSAPVYKEGECEFLTEQVTCMRNGRRDDSYQKWRWQPAGCDLPRFDARLLLERLRNKRLMFVGDSLNRNQWESMVCLVQSVIPDRGQKTLTKFVNGGSSNVFYAHEYNATVEFYWAPFLVESNSDNPKVHSVPDRVIQWHAIAKHARNWIGVDYLVFNTYIWWLNTLDIKVLKQGSSFDDQGGSTEYVEVDRPVAYKEVLTTWAKWVDRNIDPNRTTVFFMGMSPNHITPEAWGNKGGIKCAMETLPIASNRSAALDVGTDWRLYAGAREVLPTLRRVPVHFVDITALSELRKDAHTSVHTLRQGKLLTPEQQADPKTYADCIHWCLPGLPDTWNQFLYARIASSPWPNDAQAQQ

SEQ ID NO: 82016 - protein, 521 aa, Juglans regia
MPAVSGVPAGGVPGKAYPGNLTPYVTVTCIVAAMGGLIFGYDIGISGGVTSMDPFLKKFFPSVYRKKNEDKSTNQYCQYDSETLTMFTSSLYLAALLSSIVASTVTRKFGRKLSMLFGGVLFCAGAILNGFAKAVWMLIVGRILLGFGIGFANQSVPLYLSEMAPYKYRGALNIGFQLSITIGILVANVLNYFFAKIEGGWGWRLSLGGAMVPALIITVGSLVLPDTPNSMIERGQHDEAKEKLKRIRGVDDVEEEFCDLVAASEASQLVENPWRNLLQRKYRPHLSMAILIPFFQQLTGINVIMFYAPVLFNTIGFGSDASLMSAVITGIVNVGATMVSIYGVDKWGRRFLFLEGGTQMLICQAIVTAAIGAKFGVDGNPGDLPKWYAIVVVLFICIYVAGFAWSWGPLGWLVPSEIFPLEIRSAAQSVNVCVNMIFTFVVAQAFLAMLCHMKFGLFLFFAFFVMVMTVFVYFFLPETKGIPIEEMNRVWKTHWYWSRFVSDDDNPKVEMGKGGRAIKNV

SEQ ID NO: 82017 - protein, 509 aa, Burkholderia thailandensis E264
MNATPSSQKGHHVPTVKLLIAGEFVESHATEWRDIVNPATQELLARVPFATAAEVDAAVEAAQAAFAKWKSTPLSARMRIMLKFQDLVRANLPQIAKTLTAEQGKTLPDAEGDVFRGLEVVEHACSIGTLQLGEFAENVAGGVDTYTLRQPLGVCVGITPFNFPAMIPLWMFPMAIVCGNTFVLKPSEQDPLSTMLLVELAIEAGVPKGVLNVVHGGKEVVDALCSHPLVKAISFVGSTAVGTHVYRLGSEHGKRVQSMMGAKNHAVILPDANREQTVNALVGAAFGAAGQRCMATSVAVLVGAARDWLPDIVAKAKTLKVNAGAEAGTDVGPVVSRAAKQRILGLIETGAKEGAKLVLDGRDVSVPGYEHGNFIGPTIFADVKPEMSVYTHEIFGPVLCVMSVDTLDEAIALVNANPFGNGVGLFTQSGAAARKFQSEIDIGQVGINIPIPVPVPFFSFTGSRGSKLGDLGPYGKQVVQFYTQTKTVTARWFDDDATAGAVNTTIRLH

SEQ ID NO: 82018 - protein, 231 aa, Ditylum brightwellii
CTFVMCQYWTSRMFTKDVVGTANALVGGWGNLGGGVTQLVMGSVLFPLFKTGMSAEMAWRTVSVVPAIVAFSTGVAVWFISDDAPKGNYTDLKKHGNMPEVSAAASFRSGALNFNTWFLFVQYACCFGVELTMNNAAALYFREEFGQSTESAAAIASIFGWMNLFARGLGGYMSDKLNEKMGMKGRLLVHTVCLFAEGILVLVFANTPNLAGSIVVLVFFSIFVQAAEGST

SEQ ID NO: 82019 - protein, 508 aa, Juglans regia
MPAVSGVPAGGVPGKAYPGNLTPYVTVTCIVAAMGGLIFGYDIGISGGVTSMDPFLKKFFPSVYRKKNEDKSTNQYCQYDSETLTMFTSSLYLAALLSSIVASTVTRKFGRKLSMLFGGVLFCAGAILNGFAKAVWMLIVGRILLGFGIGFANQSVPLYLSEMAPYKYRGALNIGFQLSITIGILVANVLNYFFAKIEGGWGWRLSLGGAMVPALIITVGSLVLPDTPNSMIERGQHDEAKEKLKRIRGVDDVEEEFCDLVAASEASQLVENPWRNLLQRKYRPHLSMAILIPFFQQLTGINVIMFYAPVLFNTIGFGSDASLMSAVITGIVNVGATMVSIYGVDRWGRRFLFLEGGAQMLICQAVVTAAIGAKFGVDGNPGDLPKWYAIVVVLFICIYVAGFAWSWGPLGWLVPSVNVCVNMIFTFVVAQAFLAMLCHMKFGLFLFFAFFVMVMTVFVYFFLPETKGIPIEEMNRVWKTHWYWSRFVSDDNNPKVEMGKGGRAIKNV

SEQ ID NO: 82020 - protein, 231 aa, Ditylum brightwellii
CTFVMCQYWTSRMFTKDVVGTANALVGGWGNLGGGVTQLVMGSVLFPLFKTGMSAEMAWRTVSVVPAIVAFSTGVAVWFISDDAPKGNYTDLKKHGNMPEVSAAASFRSGALNFNTWFLFVQYACCFGVELTMNNAAALYFREEFGQSTESAAAIASIFGWMNLFARGLGGYMSDELNEKMGMKGRLLVHTVRLFAEGILVLVFANTPNLAGSIVVLVFFSIFVQAAEGST

SEQ ID NO: 82021 - protein, 282 aa, Saccharomyces cerevisiae YJM789
MVPKFYKLSNGFKIPSIALGTYDIPRSQTAEIVYEGVKCGYRHFDTAVLYGNEKEVGDGIIKWLNEDPGNHKREEIFYTTKLWNSQNGYKRAKAAIQQCLNEVSGLQYIDLLLIHSPLEGSKLRLETWRAMQEAVDEGLVKSIGVSNYGKKHIDELLNWPELKHKPVVNQIEISPWIMRQELADYCKSKGLVVEAFAPLCHGYKMTNPDLLKVCKEVDRNPGQVLIRWSLQHGYLPLPKTKTVKRLEGNLAAYNFELSDEQMKFLDHPDAYEPTDWECTDAP

SEQ ID NO: 82022 - protein, 231 aa, Ditylum brightwellii
CTFVLCQYWTSRMFTKDVVGTANALVGGRGNLGGGVTQLVMGSVLFPLFKTGMSAETAWRSVSVVPAVVAFSTGVAVWFISDDAPKGNYTDLKKHGNMPEVSAAASFRSGALNFNTWFLFIQYACCFGVELTMNNAAALYFREEFGQSTESAAAIASIFGWMNLFARGLGGYMSDKLNETMGMRGRLLVHTVCLLAEGVLVLVFADTPNLAGSIAVLVFFSIFVQAAEGST

SEQ ID NO: 82023 - protein, 369 aa, Canavalia lineata
MASISSNFSSIRTDKASLSSAFFRSSSVPILRQSHTFPRNISHFTLTVSCRASSVQSSPVTAKTEVKDFLHINDFDKKSIFKILDRAIEVKALIKSGDRAFQPFKGKTMAMVFCKPSLRTHVSFETGFTLLGGHAVYLAPTDIQMGTREETRDVARILSRFTDIIMARVFSHQDILVLSKYGSVPVVNGLTDYNHPCQVMADAITIIEHIGKLEGTKIAYVGDGNNVVHSWLEMASLVPIQFVCASPKGFEPDKKTVEKAKQAGLSKIVITNDPKEAVKGADIVYTDVWASMGQKEEADRRLASFKGFQVDQSLMDLAGSKALFMHCLPAEKGTEVTEDVIEGPRSIIFDQAENRLHAQNAIMLHVLGK

SEQ ID NO: 82024 - protein, 318 aa, Shigella dysenteriae
VVDAAVEKAYKGERKISWMEIYTGEKSTQVYGQDVWLPAESLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLR

SEQ ID NO: 82025 - protein, 231 aa, Skeletonema costatum
STFVMCQYWTSRMFTKEVVGTANALVGGWGNLGGGVTQLIMGSVLFPLFKLGMSAEMAWRTVCIVPAVVGIAVGFIILKISDDAPKGNYNEMKKNGTMAEVSAAASFRAGAMNFNTWLLFVQYACCFGVELTMNNAAALYFREKFLLTTETAAAIASLFGWMNLFARGVGGFVSDKANARMGMRGRIWWQTICLVCEGIMVLIFAHSNSLGAAIVLMVIFSSFVQAAEGSS

SEQ ID NO: 82026 - protein, 359 aa, Canavalia lineata
MAAISCHCYCTVRGSDKPYLSGQNLRRRTPLPAVSVSFRRRISCIATSAAPQKVGQKNFLHLDDFDKDTILKMLDRALEVKSLLKSGDRTFRPFEGKTMSMIFTKPSMRTRVSFETGFTLLGGHAIYLGPDDIQMGKREETRDVARVLSRYNDIIMARVFAHQDILDLAKYATVPVINGLTDYNHPCQIMADALTMIEHIGRFEGTKVVYVGDGNNIVHSWLLMASVIPFHFVCACPKGFEPDAKTVEKARKAGISKIEITNDPKEAVKGADVVYSDVWASMGQKEEAAHRREVFKGFQVDHNLMNIAGSKAFFMHCLPAERGVEVTDEVVEASNSIVFPQAENRMHAQNAVMLHVLGK

SEQ ID NO: 82027 - protein, 231 aa, Skeletonema costatum
CTFVMCQYWTSRMFTKEVVGTANALVGGWGNLGGGVTQLIMGSVLFPLFKLGMSAEMAWRTVCIVPAVVGIAVGFIILKISDDAPKGNYNEMRKNGTMAEVSAAASFRAGAMNFNTWLLFVQYACCFGVELTMNNAAALYFREKFLLTTETAAAIASLFGWMNLFARGVGGFVSDKANARMGMRGRIWWQTICLVCEGIMVLIFAHSNSLGAAIVLMVIFSSFVQAAGGST

SEQ ID NO: 82028 - protein, 517 aa, Bacteroides fragilis NCTC 9343
MSNQLEKVKELIELRAQARLGGGEKAIEKQHAKGKYTARERIAQLLDEGSFEELDMFVQHRCTNFGQEKKHFLGDGVVTGYGTIEGRLVYVFAQDFTVFGGSLSETMAQKICKVMDMAMKMGAPVIGINDSGGARIQEGINALSGYAEIFQRNIMASGVIPQISGIFGPCAGGAVYSPALTDFTLMTEGTSYMFLTGPAVVKTVTGEDVSQEDLGGASVHASKSGVTHFTAETGEEGLAIIRKLLSFIPQNNLEEAPLVNCTDPIDRMDDLLNEIIPDSPNKPYDMYEVIGAIIDNGEFLEVQKDYAKNLIIGFARMNGQSVGVVANQPKYLAGVLDSNASRKGARFVRFCDAFNIPLVTLVDVPGFLPGTGQEYNGVILHGAKLLYAYGEATVPKVTVTLRKSYGGSHIVMSCKQLHGDMNYAWPTAEIAVMGGAGAVAVLYAKEAKDQENPAQFLADKEAEYTKLFANPYNAAKYGYIDDVIEPRNTRFRVIRALQQLQTKKLTNPAKKHGNIPL

SEQ ID NO: 82029 - protein, 483 aa, Prochloron didemni
MVATTETTNIGKITQIIGPVVDAEFPSGKMPRIYNALRVEGKNAAGQDVAVTCEVQQLLGDNQVRAVSMSSTDGLVRGMEITDTGAPINVPVGKATLGRIFNILGEPVDNQGPVYTAETSPIHRAAPKFTDLDTKPTVFETGIKVIDLLTPYRRGGKIGLFGGAGVGKTVIMMELINNIAINHGGVSVFGGVGERTREGNDLYNEMIESKVINADNLNESKIALVYGQMNEPPGARMRVGLSALTMAEYFRDVNKQDVLLFIDNIFRFVQAGSEVSALLGRMPSAVGYQPTLGTDVGDLQERITSTKEGSITSIQAVYVPADDLTDPAPATTFAHLDGTTVLSRGLASKGIYPAVDPLDSTSTMLQAGIVGEDHYNTARAVQSTLQRYKELQDIIAILGLDELSEEDRLIVDRARKVERFLSQPFFVAEVFTGAPGKYVSLEDTIKGFKMILSGELDDLPEQAFYLVGDIQEAKAKAEKLKQD

SEQ ID NO: 82030 - protein, 271 aa, Cucumis sativus
MSIQLLPAIARRLEGKVAVITGGARGIGEQTAKLFFKHGAKVVIADIQDHLGQTLCKDLGQSSSVFVHCDVTKEKDVETAVDTAVSKYGKLDIMLNNAGVFEESPNFDFLKDDPLTFQRVVNVNLVGAFLGTKHAARVMKPAGRGSIVTTASICSVIGGIGTHAYTSSKHGVLGLMRNAAVDLGRYGIRVNCVSPNVVPTEMGRKLFKVKDGGEFPSFYWSLKNGDILREEDVGEAVVYLGSDESKCVSGLNLIVDGGFTVVNQALCSFRS

SEQ ID NO: 82031 - protein, 273 aa, Enterococcus faecalis V583
MKIRRSERLIDMTQYLLDHPHTLVSLTYFADRYQSAKSSISEDLAIVKKTFKERGTGILETIPGAAGGVRFIPEIPYEEAEQLIMDLCDRLSEQDRLLPGGYVYLSDLLGEPNLLRQVGRIIASKYLGKQIDAVMTVATKGVPIAQAVSYYLNVPFVIVRRDSKITEGSTVSVNYVSGSSERIEKMELSKRSLKRGSKVLVVDDFMKGGGTVNGMKSMIEEFEAELVGITVFAESKFNGRRAIDDYTSLLYVEDVDTQTKTISVVPGNYFTEK

SEQ ID NO: 82032 - protein, 457 aa, Thermus thermophilus HB27
MTYDLLIVGSGSAGVAAALEASALGAKAAVVEAGVLGGTCVNVGCVPSKYLLRAADAFHRARHPAFPGLRTEALGVDWKALLAGKEGLIAALRKEKYQEVLEAAGVPVLRGRARFLDGERMEVEGREVLAGRYLLATGARPFLPPIPGLRESAPWTYLEALSAPALPESLLVVGGGPIGLELAQAFARLGSRVTVLEALPEVLPQEDRELARLLRGYLEEEGLRVHTGVRVEAVAREGAFRVRTDRGVFEAERLLVATGRRPDLEGLGLERAGVERDERGFLRLDPSLRTTNPRVYAAGDAAGLPQFVYVAAQSGRVAARNALGVKAPLDLAALPRVTFTDPALAAVGLTEEEARRRYGAGVRAATLPLSQVPKALTVRDARGAFKIVVDEEGTVLGLHVLAHEAGDVIQEGILAVKYGLGYRDLIDTFHPYLTLAEGIRLVAQALDADPKKLSCCA

SEQ ID NO: 82033 - protein, 344 aa, Blastopirellula marina DSM 3645
MAKLAGKPRELGYRWPAEWEPHVGTLLSWAHNRESWPDKFEPIPFVYQRLVETLSQFEPVHIQAAGDALAEATQMVGHLPNVTLHPIATNDAWARDHGPIFLQSTNDDQPRAALDWRYNAWGGKYPPWDADDASAQQLLADLDVPYFEPGIILEGGAVEGNGAGVILTTEECLLNPNRNPTLSRDDMERYLRDYLCAEKVLWLGRGIVGDDTDGHIDELARFVAPNRIVAAYEPNTGDENHEPLAENFARLQAMTDPHGKPFEVIKLPMPQPKLVGEQRIPACYCNFYIANGVVIVPQFDDPADAAAVEVLRRCFPDRQIVPLPALDLVWGLGAYHCITQQIMR

SEQ ID NO: 82034 - protein, 165 aa, Euphorbia esula
MSADIEYRCFVGGLAWATTDQSLQEAFSPYGEILDSKIINDRETGRSRGFGFVTFNNEKSMRDAIQGMNSQELDGRNTTVNEAQSRGNGRSGGGGGYSRGGGGGGYGSGGGRRERGYGGGGGGYNSISTGGSGGYGGGRDQGYGSGGGGSRYSTGGGESDGNWRN

SEQ ID NO: 82035 - protein, 282 aa, Cryptococcus neoformans var. neoformans JEC21
MSVFSTSRLAGKTVLVTGASAGIGASTAELFAKCGSNVVLLARRADNLQAVKAKCEAAHKESGLKEGGKVVVIEADMQKNEHLDAIPTKLEGLEVDILVNNAGMVRGKEQVGAEDDINVMFSTNVLGLIHLTQIFVRQFKQRNAGMIINLGSIAGREPYAGGAIYCATKHALAAFTGSLLRELVNTPIRVCEVQPGMVETEFSIVRFRGDKDAADAVYKGIQPLVAQDIAEEIVWCASRPAHVNIAQLCKVTVPKMCIELTSFFSVVMPVNQATPTLAHRSS

SEQ ID NO: 82036 - protein, 632 aa, Cryptococcus neoformans var. neoformans JEC21
MAKIKKRGESGAAKNYVTRNQALKKLQISLSDFRRLCILKGIYPREPLNKKRANKGSSAPASFYYHKDIQYLLHEPLLVKFREHKAFAKKLARAIGRQEWGLAKNLEDAKPVARLDHLVRERYPTFTLALQDLQDPLNLVHLFSTLPTNPIPGKTLVPSEVIAECSRLISEWKLWAIRTHSLRKMFLGIKGVYYECEVPGQGGEPVRVRWLEGFEFQQHVPHDVDFRILLTFLDLYRTMVGFVLFKLYTDENLVYPPPLDVELDEQGESVGAFKLVERKAAEGADGKTQVSKKAVRKAIKGIKAAGDDADVDMDEGAKETDEEEDEDFVERPSKAQEVDDVASAPLTTYNSLLATSSTPARQNLLFSPYTFYLSRETSSRTWEFVVRAMGGKVITSLTAPTPADAPNADSITHVIIDRPITVERMREMEAGRKWVWIQPQWVADCVNKQKIISSEGYGPGQLLPPHLSPWDGEGELYRPWLEEQGEKAAEGQEGEEEEEAAEQDEGESEDEEEDGKEEVAAEYPPALLAAAQNPSDASLLHAAELEAETNGVSHSAFRAQLKEATKVHAKKVPASQKEKKGEEDLRKIMMSNKKAKLYEKMQYSNREKAAEKEKLEKKRKAIEKRKAKEAKA

SEQ ID NO: 82037 - protein, 168 aa, Brassica napus
  misc_feature (130)..(130): Xaa can be any naturally occurring amino acid
MGGVTSSMAAKLAFFPPNPPSYKITRDEATELLLMDPFPHRENVDVLRLPTRRGNEIVVMYIRYPMAVTTLLYSHGNAADIGQMYELFVELSIHLRVNLMGYDYSGYGQSSGKPSEQNTYADIEAAYKCXEETYGAKQENIILYGQSVGSGPTVDLATRLPQLLGMHL

SEQ ID NO: 82038 - protein, 429 aa, Glycine max
MATKSLGFAVSVTHLFGSKSPPKLCVFTLRCSAGNGERPWKTSGARLMLEDGSIWKAKSFGASGTQVGEVVFNTSLTGYQEILTDPSYAGQFVLMTNPHIGNTGVNFDDEESRQCFLAGLVIRSLSISTSSWRCAETLGDYLAERNIMGIYDVDTRAITRRLRQKGSLIGVLSTDNSKTEEELLKMTHSWDIVGIDLISGVSCQSVHEWVDTTKQEWDFSSKGHGETFHVVAYDFGIKHNILRRLASYGCKITVVPSTWPASETLKMKPDGVLFSNGPGDPSAVPYAVETVKNILGKVPVFGICMGHQLLGQALGGKTFKMKFGHHGGNHPVRNLRTGQVEISAQNHNYAVDPATLPEGVEVTHRNLNDGSCAGLAFPAQRIMSLQYHPEASPGPHDSDYAFRDFVELMMQEKNKKSEPQISTVSSLDA

SEQ ID NO: 82039 - protein, 231 aa, Skeletonema costatum
CTFVLCQYWTSRMFTKEVVGTANALVGGWGNLGGGVTQLIMGSVLFPLFKLGMSAEMAWRTVCIVPAVVGIAVGFIILKISDDAPKGNYNEMKKNGTMAEVSAAASFRAGAMNFNTWLLFVQYACCFGVELTMNNAAALYFREKFLLTTETAAAIASLFGWMNLFARGVGGFVSDKANARMGMRGRIWWQTIYLVCEGIMVLIFAHSNSLGAAIVLMVIFSSFVQAAEGST

SEQ ID NO: 82040 - protein, 231 aa, Thalassiosira weissflogii
CTFVMCQYWSSRMFTKEVVGTANAIVGGWGNLGGGVTQLIMGSVLFPLFKTGMSAEQAWRTVCIVPAVVGMILGILVTKISDDAPKGNYSEMKKNGTMPEVSAAASFRTGTLNLNTWLLFIQYACCFGVELTMNNAAASYFKSTFELTTESAAAIASIFGWMNLFARGLGGFFSDKPNAKIGMRGRLIVQTICLVAEGVLVFVFANTPQLWAAILVMVFFSMFVQAAEGST

SEQ ID NO: 82041 - protein, 231 aa, Thalassiosira weissflogii
CTFVMCQYWSSRMFTKEVAGTANAIVGGWGNLGGGVTQLIMGSVLFPLFKTGMSAEQAWRTVCIVPAVVGMTLGILVTKISDDAPKGNYSEMKKNGTMPEVSAAASFRTGTLNVNTWLLFIQYACCFGVELTMNNAAASYFKSTFELTTESAAAIASIFGWMNLFARGLGGFFSDKLNSKMGMRGRLIVQTICLVAEGVLVFVFANTPQLWAAILVMVFFSMFVQAAEGST

SEQ ID NO: 82042 - protein, 318 aa, Escherichia coli
VVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGEPIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLR

SEQ ID NO: 82043 - protein, 231 aa, Thalassiosira weissflogii
CTFVMCQYWSSRMFTKEVAGTANAFVGGWGSLGGGVTQLVMGSVLFPLFKTGMSAEQAWRTVCIVPAVVGMFLGILVTKISDDAPKGNYSDMKKNGTMPEVSAAASFRTGTLNVNTWLLFIQYACCFGVELTMNNAAASYFKSTFELPTESAAAIASIFGWMNLFARGLGGYYSDKFNAKTGMRGRLIVQTICLVAEGVLVFVFANTPQLWAAILVMVFFSMFVQAAEGST

SEQ ID NO: 82044 - protein, 92 aa, Candida albicans
FTIPPNHEMIFTTDDAYKTKCDDKVMIIDYKNITKVIAPGKIIYVDDGVLSFEVISVDDQQTLKVRSLNAGMISSHKTANDVLELRVLSTSG

SEQ ID NO: 82045 - protein, 231 aa, Thalassiosira weissflogii
CTFVMCQYWSSRMFTKEVAGTANALVGGWGNLGGGVTQLVMGSVLFPLFKTGMSAEQAWRTVCIVPAVVGMFLGILVTKISDDAPKGNYSDMKKNGTMPEVSAAASFRTGTLNVNTWLLFIQYACCFGVELTMNNAAASYFKSTFELSTGSAAAIASIFGWMNLFTRGLGGYYSDKFNAKMGMRGRLIVQTICLVAEGVLVFVFANTPQLWAAILVMVFFSMFVQAAEGST

SEQ ID NO: 82046 - protein, 568 aa, Bradyrhizobium sp. ORS278
MLLLAGCWPAHALDPQGVDVPQPPNVAAPAQAPAHGMVVAQERIAAEVGQRVLALGGNAVDAAVATGFAMAVTYPVAGNIGGGGFMVIHLAKTNEDVAIDYRETGPAAMTRGIFLGADGRPDNAKSRDSALSIGVPGSVAGLALALEKYGSGKFTLAQLVAPAIVLARDGIPVADDVAFTLPMMAPRLAKWPSSAAIFIRPDGTVLKEGDRLVQRDLAATLAAIAERGPRGFYEGPVAEKLAKAIQAAGGIMTADDLKAYQPVLRTPVRGTYRGYDIVSMPLPSSGGTVLVETLNILEGFKLSELKQGSPASLHLLIEAMKRAYADRARYLGDPAFVDAPVRAMLSKDYAAQQRAGIDPARATGAGDVLNIKPLREGSNTTHFSVVDNDGNAVSNTYTLNFPYGVGLIAEGTGVLLNNELDDFTAAPGASNAFGLVGFEANLPGPGKRPLSSMSPTIVLKDGKPVLVTGSPGGSRIISTVLQVIVNVLDYEMDVPQAVSAPRLHHQWMPDEVRIEKGFGDDVLADLRARGHKIEEPMGRTSANSILVTSDGLVGAPDPRSKGATAAGR

SEQ ID NO: 82047 - protein, 315 aa, Shigella boydii
MPDMKLFAGNATPELAQRIANRLYTSLGDAAVGRFSDGEVSVQINENVRGGDIFIIQSTCAPTNDNLMELVVMVDSLRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVLVDDMIDTGGTLCKAAEALKERGAKRVFAYATHPIFSGNAANNLRNSVIDEVVVCDTIPLSDEIKSLPNVRTLTLSGMLAEAIRRISNEESISAMFEH

SEQ ID NO: 82048 - protein, 340 aa, Vitis vinifera
MIDKFKKSSDSKRFRSRYGYYEKAVLTLAKAKKFSFIEDILEHQEQYNEISTEVFAVRLITLYGKAGMFEHAHKLFDELPKLNCERTVMSFNALLSACVNSKKFDKIDGFFQELPGNLGIVPDVVSYNILVNAFCEMGSLDSALSVLDEMEKVGLEPDLITFNTLLNAFYQNGSYADGEKIWDLMKKNNVAPNVRSYNAKLQGVISENRMSEAVELIDEMKTSGIKPDVFTLNSLMKGFCNAGNLEEAKRWYSEIAINELPPVRATYMTLIPFLVEKDDFEMATELCKEVFRRRWLIEPALLQQVLEGLVKESKIEEATELVELAKLKKFSITLELPSDK

SEQ ID NO: 82049 - protein, 379 aa, Deinococcus radiodurans R1
MPALRPDIDPDGLLEYSVVYTDRSLNHMSQVFQGVMRDLSADLKAVYHAHAVAIIPGSGTSAMEAVVDQLAQGQHCLVIRNGWFSYRWSQIVEMSHLPKSVTVLKAQAQEEGKAPQFAPFPIEEATATIRRERPALVFAPHVETSAGIILPEDYIKALAEATHEVGGLLVIDCIASGCVWLDMHSLGIDVLISAPQKGWSSTPCAGLVMLSEAAAARVEATNSVSFTLDLKKWRSIMKSYEDGGFAYHATLPTDGLRQFRDTVQEVKAFGFQKAQDAQWELGLRVRGLLAEAGFRSVAAPGFEAPGVVVSYTDQDDIQSGKAFREAGLQIASGVPLQVDEPAGFKTFRIGLFGLDKLQDVSGAAERFGAALRQVCAVSR

SEQ ID NO: 82050 - protein, 422 aa, Campylobacter lari RM2100
MNLKELDLKHIWHPCTQMSDHEFLPLIPIKKAKGVYLYDFDEKSYIDCISSWWVNIFGHCNEYINEKIKDQLQSLEHVLLAGFSHEPIIKLSQRLCKLLPFDKCFFADNGSSAIEVALKMSFQYHLNNGSKKDKFLSLSNSYHGETLGALSVGDVALYKKTYEPLLLKSITTPVPTSKDYIKELEILESILKNHHHEICAFILEPLLQCAGNMHMYELGYLNEAVKLAKDYDVQVIFDEIATGFGRTGEMFALDYCSQSIDYICLSKAITGGYLPLSVVLTKDEIYEKFYDSYESQKAFLHSHSYTGNALACTAANATLDIFENENIIAKNKIKSAFIKTQWESLKEFEFLGNFRNLGMVSAFDIQKSKYKRAGLEVFQRALEKGLLLRPLGNTIYFMPPYVINEDEITYVVQSLREIFKEF

SEQ ID NO: 82051 - protein, 328 aa, Vitis vinifera
RFRSRYGYYEKAVLTLAKAKKFSFIEDILEHQKQYNEISTEVFAIRLMTLYGKAGMFEHAHKLFDEMPKLNCERTVMSFNALLSVCVNSKKFDKIDGFFQELPGNLGIVPDVVSYNIIVNAFCEMGSLDSALSVLDEMEKVGLEPDLITFNTLLNAFYQSGSYADGEKIWDLMKKNNVESNVRSYNAKLRGVISENRMSEAVELIDEMKTSGIKPDVFTLNSLMKGFCNAGNLEEAKRWYSEIAINELPPVRATYMTLIPCLVEKGDFEMATELCKEVCSRRWLIEPALLKQVLEGLVKESKIEEATELVELAKLKKFRITLELPSDK

SEQ ID NO: 82052 - protein, 454 aa, Aspergillus nidulans FGSC A4
MLSGILIFNQKGENLIFRAFRNDCRPRLADIFRIQVISNPQVRSPILTLGSTTFSHVKHENIYLVAVTKSNANAALVFEFLYRLVLLGKSYFGKFDEEAVKNNFVLIYELLDEILDFGYPQNTETDTLKMYITTEGVKSAITNNPSDSARITQQATGALSWRRADVKYRKNEAFVDVIEDVNLLMSATGTVLRADVNGQIVMRAYLSGTPECKFGLNDRLLLDNDAAGPGSSNPGAGGRGVGGHSSSKTRAAAGSVTLEDCQFHQCVKLGRFDSDRIISFVPPDGEFELMRYRATENVNLPFKVHPIVREIGTTKVEYSVAIKANYSSKLFATNVVIRIPTPLNTAKTTERTSQGRAKYEPEHNNIVWKIARFSGGSEYVLTAEATLSAMTNQKAWSRPPLSLNFSLLMFTSSGLLVRYLKVFEKSNYSSVKWVRYMTRAGSYEIRYVYFECSW

SEQ ID NO: 82053 - protein, 173 aa, Glycine max
  misc_feature (123)..(123): Xaa can be any naturally occurring amino acid
MEPHDETGCQAPERPILCINNCGFFGRAATMNMCSKCYKDMLLKQEQDKFAASSVENIVNGSSNGNGKQAVATGAVAVQVEAVEVKIVCAQSSVDSSSGDSLEMKAKTGPSRCATCRETWLFXTGFSCKCGNLFCAMHRYSDKHDCPFDYRTVGQDAIAKANPIIKADKLDKI

SEQ ID NO: 82054 - protein, 217 aa, Legionella pneumophila str. Paris
MTFQILPSLLSADMTRLGEEVDAVMKAGADFIHFDVMDNHYVPNLTFGPAFCDALIKKFPNLPIDVHLMTTPVDTLIEAFAKAGAKRISIHPDATIHLDRSLQLINNLGCEAGLVLNPATSIDTLTWCAHNLKFVLVMTVNPGFGGQKLIPEVIPKLSKIRQQYPNLDLCVDGGVTPQNIASLAHAGANQFVAGSAIFNSSNYSETIKRMREQLASI

SEQ ID NO: 82055 - protein, 716 aa, Shewanella oneidensis MR-1
MIYQSPTIQVELLEDNIAKLCFNAPGSVNKFDRETLASLDAALDSIKQQSNIQALVLTSGKDTFIVGADITEFLGLFAQDDAVLLSWVEQANAVFNKLEDLPFPTASAIKGFALGGGCETILATDFRIADTTAKIGLPETKLGIIPGFGGTVRLPRVIGADNALEWITTGNEQRAEDALKVGAVDAVVAPEALEVAAIQMLKDAVAEKLDWQARRQRKLSPLTLPKLEAMMSFTTAKGMVFSVAGKHYPAPMAAVNVVEQAATKGRSDALQIEHQAFIKLAKTDVAKALIGIFLNDQFVKGKAKKAGKLAKAVNSAAVLGAGIMGGGIAYQSASKGTPIVMKDIAQPALDLGLNEAAKLLSAQVARGRSTPEKMAKVLNNITPALEYAPVKHADVVVEAVVEHPKVKAQVLAEVEQYVSEDAIIASNTSTISISLLAKSMKKPERFCGMHFFNPVHKMPLVEVIRGEHSSEETIASVVAYASKMGKTPIVVNDCPGFFVNRVLFPYFAGFNGLLAEGGDFAAIDKVMEKQFGWPMGPAYLLDVVGLDTGHHAQAVMAEGFPDRMGKSGNDAIDVMFENKRLGQKNGKGFYAYSVDSRGKPKKDVDPTSYELLKAAFGEQKAFDADEIIARTMIPMIIETVRCLEEGIVASPAEADMGLVYGLGFPPFRGGVFRYLDTMGVANFVALADKYAHLGGLYQVTDAMRALAANNGSYYQA

SEQ ID NO: 82056 - protein, 414 aa, Zea mays
ELGHQVALIRQVANKVFTSMGKTIGYKIGMMIEIPRAALVADEIDAIRGWLDGGNSASPVIGQPLAHRELAPNIAGIGSKNLPPPELLDLIRDVRTLNALVETGSKKNTGEKQTPEEIDASRREESGLRATVVARMRRALHACCPSPCWSVRSDLLSACVWDISYPAATGPGSKAWVTRKGRDQTTVVKSGSERIAAGSESHFHRPARWTHLPASRRAEHLKPTPAVLLPLPHRTKPPVRSTKASPPLFSCWLAHQACPNNPPADSPHGRPKPAPFPRRQILKPGELRAGLTSPIPLPDSLCRREETASSPGKRSSPRNLFHLSSPYEFQTVSLFGVVIASTPRRTICYLKQLSQTASMGAVLGRHDTHKRSSHGSKLEEMDWDKNGMVTFKEFLFAFTRWVGIDENEDEDDDE

SEQ ID NO: 82057 - protein, 409 aa, Sulfolobus solfataricus P2
MRIGVVGLGVVGLVTGAVLADQGHEVVGVDIDQNKVKGLQCNRSPIYEPGLDELLLKNKNRFLFTTDYSALKDVDIVFITVATPTVEGKNYIGYVLDAAKTMKPYLKRDAIVVVKSTVVPGTSRKVKQIVEREVVANPEFLKEGSAVIDTIKPDRIVIGSDSKAAGDVIENLWSFTKTVVLRTSIEEAEMIKYAANSFLATKISFINEIANLCEVIPNCDVNTIAKAIGLDKRIAPYFLNAGLGYGGSCFPKDTLAFASFARELGEELKIVEAAIKVNEERPRRAVKIMEELLGELKGKTICILGIAFKPNTDDTRESVALKIAKLLVDIGANVIAYDPKAKTSLVEMVSSKEECVKRSDGVIIATEWDEFRGIEHMLKDKAVLDGRRVLDPNKMSRSKYRAIGLSKVR

SEQ ID NO: 82058 - protein, 246 aa, Sulfolobus solfataricus P2
MGTRLLPASKEIPKEMFPIPFNGQFKPIIQIIFEQLYDIGIRDFVIVVGRGKRVIEDHFTPDYDFINYLEAKGKVIQANYLRQFYQKVENSRIAFVNQPEPKGFGDAVLRAEPFIQGEFLVVAADTILPMIPISSMVVNSFLVTTVQDPRPYGVVLVDKQGCVIDIEEKPKQPKSNLVVVPYYMFDEEIFDELRQIKYEEELQLTDGIKGLIKRGRRFKAIMVDKVYDLGTVENYIESLRRLLNND

SEQ ID NO: 82059 - protein, 231 aa, Thalassiosira weissflogii
CTFVMCQYWSSRMFTKEVAGTANALVGGWGNLGGGVTQLVMGSVLFPLFKTGMSAEQAWRSVCIVPAAVGMFLGILVTKISDDAPKGNYSDMKKNGTMPEVSAAASLRAGTLNVNTWLLFIQYACCFGVELTMNNAAASYFKSTFELSTESAAAIASIFGWMNLFARGLGGYYSDKFNAKMGMRGRLIVQTICLVAEGVLVFVFANTPQLWAAILVMVFFSMFVQAAEGST

SEQ ID NO: 82060 - protein, 231 aa, Thalassiosira weissflogii
CTFVMCQYWSSRMFTKEVAGTANALVDGWGNLGGGVTQLVMGSVLFPLFKTGMSAEQAWGSVCIVPAVVGMFLGILVTKISDDAPKGNYSDMKKNGTMPEVSAAASFRTGTLNVNTWLLFIQYACCFGVELTMNDAAASYFKSTFELSTESAAAIASIFGWMNLFARGLGGYYSDKFNAKMGMRGRLIVQTICLVAEGVLVFVFANTPQLWAAILVMVFFSMFVQAAEGST

SEQ ID NO: 82061 - protein, 215 aa, Dunaliella tertiolecta
GWGNLGGGVTQLIMPLIYSGIKQSGRPGFTAWRWSFMYLEPCSCCCNDDLLFAQDTPNGSYRDLRKTRAAQVDGKKTCCCSEELQNLGADSQLWLLLWSGADHQQHYCVLLFDQFGLTLEIAGIVGAVFGLMNLFCRSAGGLASDLGGKYFGMRGRLWAYFILQLCAGALSIVLGNVDDTLGGTIAVMIVFSAFVQSAEGACYGVVPFVSRRSYG

SEQ ID NO: 82062 - protein, 315 aa, Shigella boydii
MPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVLVDDMIDTGGTLCKAAEALKERGAKRVFAYATHPIFSGNAANNLRNSVIDEVVVCDTIPLSDEIKSLPNVRTLTLSGMLAEAIRRISNEESVSAMFEH

SEQ ID NO: 82063 - protein, 217 aa, Emiliania huxleyi
GWGNLGGGVTNLTMPYIFLIMMSFANDDIDRAWRLCYIVPLVLHVVGAAAVFTARDLPDGNYAELEKSGAKQKTDSKVVLVTGVTNINAWLLTLTYGFCFGVELTMNNVAAGFFYNYQGVTPQLAGIAASMFGLMNIFARSLGGLLSDFCNARFGMRGRLWSCWIIQTIEGVMCCVLGSVTALAIAVIIVIIFSVFVQMAEGLHFGIVPFVSRRSYG

SEQ ID NO: 82064 - protein, 728 aa, Saccharomyces cerevisiae YJM789
MEEIPALYPTEQEFKNPIDFLSNPHIKRLGVRYGMVKVVPPNGFCPPLSIDMENFTFQPRIQNLENLDLKNRCRLFFMKQLNNFKRSVKDPSKLILREPYTIVEYSDSTHASEILKKKVYFYDVFSELIKDNRTLTDTTQSFRRKLKFRDISQLRGDSSLWRTISKKFNVPIGLLKEIFEKYIASYYIFLHSLNENVHTALHADQYPKSLLSDDEDDFDLGPDSNSGSDFEEDDDDACIVCRKTNDPKRTILCDSCDKPFHIYCLSPPLERVPSGDWICNTCIVGNGYYGFTQDTHDYSLPEFQEYCKHQNSRLLPARKLSIDELEEMFWSLVTKNRRSSLTTVKYGADIHNELPGQITGFPTREFIPKNINGDELKDYLKYCDHPMNLTNLPMAHNSLLPLFKRNISGMTIPWIYIGSLFSTFCWHMEDQYTLSANYQHEGDPKVWYSIPESGCTKFNDLLNDMSPDLFIKQPDLLHQLVTLISPYDSNFKKSGIPVYKAVQKPNEYIITFPKCYHAGFNTGYNFNEAVNFTIDFWLPYGFGAITDYKLTQKACVFDMFDLMINVLDKYNKDTLLFNDAFVRQCYSSLIVFYNTELKRIRKIQAIVPRTTLLEVHTDPNDEDEEYDIFCSQCKTICSIAFVLRKNNSDSIRTYKRHKKNHLSIRKWNELSTTDSKVSILCTQDYLKSIQNLNNSDGEEPYIDDELYFTKSLKDIDSLIKQVGVKLDR

SEQ ID NO: 82065 - protein, 184 aa, Synechococcus sp. WH 8102
MTGSSPQPLLGPVQRIVLVVAAIVLAVGLTMMRGGLQSGSPLEQLARRSMTPDVALSNGRPTMIEFYADWCQVCREMAPAMLKLEQSMQQQLDVVMVNVDNPRWQDLVDRYDVNGIPQLNLFNAEGDAVGRSIGLRREQELSLLADALIQGSPLPSLQGLGRVSERTDVAPQQASLTAGPRSHG

SEQ ID NO: 82066 - protein, 511 aa, Saccharomyces cerevisiae YJM789
MVLPRLYTATSRAAFKAAKQSAPLLSTSWKRCMASAAQSTPITGKVTAVIGAIVDVHFEQSELPAILNALEIKTPQGKLVLEVAQHLGENTVRTIAMDGTEGLVRGEKVLDTGGPISVPVGRETLGRIINVIGEPIDERGPIKSKLRKPIHADPPSFAEQSTSAEILETGIKVVDLLAPYARGGKIGLFGGAGVGKTVFIQELINNIAKAHGGFSVFTGVGERTREGNDLYREMKETGVINLEGESKVALVFGQMNEPPGARARVALTGLTIAEYFRDEEGQDVLLFIDNIFRFTQAGSEVSALLGRIPSAVGYQPTLATDMGLLQERITTTKKGSVTSVQAVYVPADDLTDPAPATTFAHLDATTVLSRGISELGIYPAVDPLDSKSRLLDAAVVGQEHYDVASKVQETLQTYKSLQDIIAILGMDELSEQDKLTVERARKIQRFLSQPFAVAEVFTGIPGKLVRLKDTVASFKAILEGKYDNIPEHAFYMVGGIEDVVAKAEKLAAEAN

SEQ ID NO: 82067 - protein, 325 aa, Emiliania huxleyi
GWGNLGGGVTNLTMPYIFLIMMSFANDDIATAWRLCYIVPLALHLLGAAFVFTGRDLPDGNYRELESSGAKQKTDSKVVVVTGITNVNAWILTITYGFCFGVELTMNNVANGFFAKYQGVTPQLAGIAASMFGLMTLRALARRLLSDYCNTRWGMRGRLWSCWIIQTCEGIMCCVLGSLTQPRRALPDHMTQVPPLLPTSRVVASGDRRAVRVDAAQRQRVRLERDRAALRLEADQGNCRAEILPPDAGHAHPGAGPALRHHAHRWRQHDHRHVERGHRAAQRVYLPRQPLLRRRHHCDYLLRLCADGGGPPLWHRALRVSTLLR

SEQ ID NO: 82068 - protein, 217 aa, Campylobacter lari RM2100
MDRYTRIKWLVNEENFIKFQNTKVLVCGLGGVGGICVDALFRSGFSNLTLIDADKFETTNQNRQLHSENIGKEKAKVFERIYNAKGIVSKIDDEFLKNFDLNEFDLIIDAIDDIPAKVALANLVDLKKQIFISSTGGARKLDPTRIKTTSIFKTHGDALAKKFRYELRKSGFKGDFDVVFSDEEAHCKDLGSFMGVTASFGLALASLALRKVLNKKK

SEQ ID NO: 82069 - protein, 423 aa, Magnaporthe grisea 70-15
MLSTMRIASRQVAGRRMAVRPLAALRPASTWANVQMGPPVRITEAFKADSNNKKINLGVGAYRDDAGKPYVLPSVRQAEEKVIAARMNKEYAGITGVPEFTSGALTLAYGKDSTALDRTAITQSISGTGALRIGAEFLSKFYPGAKNIYIPTPSWANHGAVFTQAGLKVEKYRYYNKDTIGLDFEGLVADVKAAPKGSIFLFHACAHNPTGVDPTPEQWREIETVVKSAGHYAFFDMAYQGFASGDIHKDAFALRHFVAQGHNVCLAQSFAKNMGLYGERVGAFSIVCDSAEEKKRVDSQLKILVRPMYSNPPIHGARIAAQILNTPALYDQWLAEVKGMADRIITMRALLKENLEKLGSKHDWSHITSQIGMFAYTGLTPEQMEQLAKSHSVYATKDGRISVAGITSENVGRLAEAIFKIKG

SEQ ID NO: 82070 - protein, 315 aa, Shigella boydii
MPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVLVDDMIDTGGTLCKAAEALKERGAKRVFAYATHPIFSGNAANNLRNSVIDEVVVCDTIPLSDAIKSLPNVRTLTLSGMLAEAIRRISNEESISAMFEH

SEQ ID NO: 82071 - protein, 447 aa, Kluyveromyces lactis NRRL Y-1140
MGCVASTGNYENEDDPFIQNKRANDLIEQNLQQERNKNKNEVKLLLLGAGESGKSTVLKQMKLLHQGGFTHRERMQYGQVIWADAIESMRTLILQAGKLGIELDSDLKNAHSGQLVNTELHQCKEKIFRANTLDQIDARMAGGSEFLNEYVLKYNGIGSKKKRQTTLGFKESNGADPEEEDETDAFLSEKLAGTSYTGSSETSELKRIDQSTNEEIAYAIKKLWTQDKGIRQCFNRSSEFQLEGSASYYFDNIEKFARVDYVCDDMDILKGRIKTTGITENSFKIGPSTFKVYDAGGQRSERRKWIHCFEGITAVVFVIAISEYDQMLFEDERVNRMHESIVLLDTLLNSRWFANTPFILFLNKVDIFQEKVKRSPIRTWFPNYPGKLGDSETGLKYFESLFLSLNRSNKPIYVHRTCATDTQSMRFVLGAVTDLVIQQNLKKSGIL

SEQ ID NO: 82072 - protein, 393 aa, Geobacillus stearothermophilus
MKLAKRVASLTPSATLAITEKAKELKAAGHDVIGLGAGEPDFNTPQHILDAAIKAMNEGHTKYTPSGGLPALKEEIIKKFARDQGLDYEPAEVIVCVGAKHALYTLFQVLLDEGDEVIIPTPYWVSYPEQVKLAGGVPVYVEGLEQNHFKITPEQLKQAITPRTKAVIINSPSNPTGMIYTAEELKALGEVCLAHGVLIVSDEIYEKLTYGGAKHVSIAELSPELKAQTVIINGVSKSHSMTGWRIGYAAGPKDIIKAMTDLASHSTSNPTSIAQYAAIAAYSGPQEPVEQMRQAFEQRLNIIYDKLVQIPGFTCVKPQGAFYLFPNAREAAAMAGCRTVDEFVAALLEEAKVALVPGSGFGAPDNVRLSYATSLDALETAVERIHRFMEARA

SEQ ID NO: 82073 - protein, 403 aa, Pseudomonas aeruginosa
MNNSFWKAGHAPTLFAAFLYFDLSLMVWYVLGPLGVQIAGDLQLSTQQRAMMVATPILAGAVLRFLLGLLADRWSPKSSGILAQVIVIAALAAAWLLGVNSYEQALLLGLFLGFAGASFAVALPLASQWYPPQHQGKAMGIAGAGNSGTVLAALFAPGLAAAFGWNNVFGFALLPLVLTLLVFAMVARNAPQRPAPKAMGDYLKAFGDRDSWWFMFFYSVTFGGFLGLASTLPGYFHDQYGLNPVTAGYYTAACVFAGSLMRPLGGALADRIGGIRSLLMVYTLAAICIAAVGFHLSSAMAALGLFVVAMLSLGAGNGAVFQLVPQRFHKEIGVMTGLIGMAGGIGGFCLTAGLGAIKQSTGDYQLGLWLFASLGVLAWFGLHGVKRRWRTTWGSAAVTAARV

SEQ ID NO: 82074 - protein, 545 aa, Shewanella sp. MR-7
MTILTQSTTWQALAAHSHQIPHMRELFAGDPARFSNMSLSTCGLFLDYSKNRATPETLNLLQTLAQEAKLDAKIKAMFAGDIINTTEKRAVLHTALRSTAEQSIVAEGQDIVPEVQQTLNKMQQFVTSVTSGQWKGFTGKAITDIVSIGIGGSFLGPKIVSQALRPYWITGLNCHFVANVDGTSISEKLKLLDPETTLFIMSSKSFGTQETLTNTLTAKAWFLAKGGSQSDVAKHFVAVTSNVAKATDFGIDADNIFPMWDWVGGRYSLWSAIGLPIALLIGMDNFRSLLKGAHQMDTHFANAPLAENMPVIMGLFSLWYGNFFNAQSHVVLTYDHYLRGLPAYFQQLDMESNGKSVTLNGTHVDYSTGPVIWGGEGTNGQHAYHQLLHQGNALIPADFIMPLQSHNPIGEHHDQLASNCFGQTQALMQGRTLDEALAELSKSSLSDEEKLLIAKHKVMPGNKPSNTLLMDKLTPETLGALIALYEHRTFVQGAIWDINSFDQWGVELGKSLGNDVLARIGAEQDATALDASSNGLINLYRQGKI

SEQ ID NO: 82075 - protein, 635 aa, Streptococcus pyogenes MGAS10394
MIILQGNKLERSFSGDVLFQNISLQVDERDRIALVGPNGAGKSTLLKLLVGEETPTSGEVNTKKDLTLSYLAQNSRFESDQTIYEEMLKVFEALRQDEKRLRQMEMDMATVSGQDLTRLMTDYDLLTEHFRQQGGFTYESDIKAILNGFKFDESMWQMTIAELSGGQNTRLALAKMLLEKPELLVLDEPTNHLDIETIAWLENYLANYQGALIIVSHDRYFLDKVATVTLDLTPHGLDRYVGNYSRFMTLKAEKLVAEEKQFDKQQKEIAKLEDFVQKNIVRASTTKRAQARRKQLEKIERLDKPTSARKSAHMTFQADKPSGNVVLTVEKAAIGYNQHVLSEPINLDVHKLDAIAIVGPNGIGKSTLIKSVIGQIPFIKGEVKYGANVEIGYYDQTQSHLTSSNTVLEELWQDFSTTPEVDIRNRLGAFLFSGDDVKKSVAMLSGGEKARLLLAKLSMENNNFLVLDEPTNHLDIDSKEVLENALIDFDGTLLFVSHDRYFINRLATKVLEITENGSTLYLGDYDYYLEKKAELEELARLAAGETVEETKEASATDYQLQKANQKERRRLTRRYEEIEARLETIEERIGAIQEDMHASNDTAQLIAWQKEWDQLDQEQETLMEEWETIAEQIES

SEQ ID NO: 82076 - protein, 603 aa, Zea mays
MAAAATTASPSASFPAASLRRDARRTSCVAAAAAATTAAEAGLAAVPAPPPTPMVRVVPESLQRESGCLVEGFRARGACAADGEGFGDAAGEGGGPGAMEYLTSVLSSKVYDVAIESPLQLASKLSHRLGVNIWIKREDLQPVFSFKLRGAYNMMAKLSREQLERGVICSSAGNHAQGVALSAQRLGCDAVIVMPVTTPEIKWKSVERLGATVVLEGDSYDEAQSYAKLRCQQEDRTFIPPFDHPDVITGQGTVGMEIVRQLQGPLHAIFVPVGGGGLIAGIAAYVKRVRPEVKIIGVEPSDANAMALSLYHGKRVMLEHVGGFADGVAVKAVGEETFRLCRELVDGIVMVSRDAICASIKDMFEEKRSILEPAGALALAGAEAYCKYYNLKGETVVAITSGANMNFDRLRLVTELADVGRKREAVLATFLPEQQGSFKKFTELVGRMNITEFKYRYDSNAKDALVLYSVGIYTDNELGAMMDRMESAKLKTVNLTDNDLAKDHLRYFIGGRSEIKDELVYRFIFPERPGALMKFLDAFSPRWNISLFHYRAQGETGANVLVGIQVPPVDFDEFKSHADNLGYEYMSENNNEIYRLLLRDPEV

SEQ ID NO: 82077 - protein, 590 aa, Shewanella sp. MR-7
MDPHVSHSAHLFSLRIAHALSEACVKDKYSVKRFGQDLLAGLTVGIIAIPLAMALAIASGVAPQYGLYTAIVGGFIIAMTGGSRYSVSGPTAAFVVLLYPIAQQFGLAGLLIATVMSGMMLVAMAMLRLGRLILYIPESVTLGFTAGIGVVIATLQLKDFFGLHIEHMPEQYFAKLMALGQALPSLHLPSLLVAAATLATMLLWPKLKMPVPAHLPAIALGSILALVLNTMGADIETIGTRFHYQLSDGSVGTGIPAVLPHFEWPWLQTGANGQAFEFNLATFQALLPAAFAIAMLGAIESLLCAVVLDGMTGKRHSANSELLGQGIGNIITPFFGGIPATAAIARSAANVKAGAQSPIASMIHAIVVLIGLVALAGILAYLPMSAMAALLLVVAWNMSEAPKAVHLLKTAPTSDILVFLTCFSLTVIFDMVIAISVGIILAALLFMKEIAEMTKLYDISTNKRYVEQPLPPDWAVIKINGPLFFAAADRIFAEIASLTQDKQVIVLYLDGVSILDAGGLAALNKLIDKCKLNHTKLIVADLQFQPIRTLARAKVQPIEGVLKFYPTLREALAEAPAPELAVEASAATHS

SEQ ID NO: 82078 - protein, 469 aa, Streptococcus pyogenes MGAS10394
MAFEIIMPKLGVDMQEGEIIEWKKQEGDTINEGDILLEIMSDKTNMELEAEDSGVLLKIVRPAGDTVPVTEVIGYIGAEGESVDTIASSEKTTEIPVPASADAGPTVAPKENVASPAPQVAATAIPQGNGGKVRATPAARKAAAEMGIDLGQVPGTGPKGRVHKEDVENFKGAQPKASPLARKIAADKGIDLATVSGTGFNGKVMKEDIIAILEAAKPAEAKAPAAKEEKVVDLPEGVEHKPMSAMRKAISKGMTNSYLTAPTFTLNYDIDMTEMIALRKKLIDPIMAKTGLKVSFTDLIGMAVVKTLMKPEHEYMNASLINDANDIELHRFVNLGIAVGLDDGLIVPVIHGADKMSLSDFVLASKDVIKKAQTGKLKAAEMSGSTFSITNLGMFGTKTFNPIINQPNSAILGVGATIPTPTVVDGEIVARPIMAMCLTIDHRLVDGMNGAKFMVDLKKLMENPFELLI

SEQ ID NO: 82079 - protein, 427 aa, Cryptococcus neoformans var. neoformans JEC21
MASSQKKPQKRKSAAADSLVHVSVGDSSRGSGPAFVNFPSVKPSKKIPFTMYTRDAATTADLTKQHTLIAGETEDVEFFSTNRDRSNNPEGVDCQYLPAVYDPSTRTVHVHPSAPLYLVAHRAKRLRTVPLTVPPDQAAKAQWRTQRNDLGETFGTRKAKAQIKSEEKNRVDAGAMKDVKGHLMESIGELEEENDSVAPSEFIPNPNTDTADPTEVYTRESIITTQEWAAIDASRLLAIEDDKERASALPYKRSSWLQYKSRAVANIKDKTARKTQMKYLYYLSCLLTLLDFSPRLSKTPVHKLAPAFPQVPRQIIDGMLSRFAEPNGLKHNVTEKTKTKLLVWICLLYLILEGYSVEVAKVAKELKMEPAKVATLYKQLGCNVKLASPAEREAQGITLAQANAARRAVLVAPVRFPKLKRRGPVKR

SEQ ID NO: 82080 - protein, 285 aa, Melampsora lini
DDATLLRFLRARKFDLEKSKLMFTDCDKWRKEFKVDELYATFEYPEKKEVDAIYPQFYHKTEKDGRPIYIEQLGKLDLTKLYKVTTPERQLQRLVVEYEKFLRDRLPVCSVQQGKLVETSCTIMDLSGVGLSQFWKVKNYVQQASHLSQNYYPETMGKFYIINAPYLFSTVWSLVKPWLDEVTVKKISILDSSYHKTLLEQIPAESLPKSLKGTCDCPGGCSMSDAGPWKDEETVAKAKKLKAGEPAKEEAIPEVAATESEKKPEEAAATEAPATEAAPAETTTT

SEQ ID NO: 82081 - protein, 475 aa, Pseudomonas aeruginosa UCBPP-PA14
MSKVVLASQLPNKRNASLAPGLKQRHVTMLSIAGVIGAGLFVGSGHAIAAAGPAALLAYLIAGTLVVLVMRMLGEMAVASPDTGSFSTYADRSIGRWAGFTIGWLYWWFWVLVIPLEAIAAAAILNAWFPAIDTWIFALAVTFLLTVTNLFSVARYGEFEFWFALLKVIAIIAFIVLGAVAIVGGLPEREVSGLSSLMASHGGFVPNGYGAVLGALLTTMFSFMGTEIVTIAAAESKDPAKQITRATNSVIWRIGLFYLVSIFIVISIVPWNDPLLIQVGSYQRALELLDIPHAKLIVDLVVLVAVASCLNSAIYTSSRMVFSLAKRGDAPSVLKLTNTAHVPRPAVLASTAVGFLTTIVNYFAPEKVFTFLLASSGAVALLVYLVIAVAQLRMRKQLQVSGQPIEFRMWLYPWLTWAVILFIVAALSIMLIMPEHRHEVFATALLTIFTVCLGLLNARRKPRLGEDYAGKTARV

SEQ ID NO: 82082 - protein, 624 aa, Streptococcus pyogenes MGAS10394
MFRKVLVVLTWVRQRNQRFLTYRKNSIAFSLLLVSYIMAVEIIMPKLGVDMQEGEIIEWKKQEGDTVNEGDILLEIMSDKTNMELEAEDSGVLLKITRQAGETVPVTEVIGYIGAEGESVEVSSPAASDVNVARTTEDLEAAGLEVPKAPAQAASAAPKAALADDEYDIIVVGGGPAGYYAAIRGAQLGGKIAIVEKSEFGGTCLNVGCIPTKTYLKNAEILDGIKIAAGRGINLASTNYTIDMDKTVDFKNTVVKTLTGGVQGLLKANKVTIFNGLGQVNPDKTVNIGSQTIKGRNVILATGSKVSRINIPGIDSKLVLTSDDILDLREMPKSLAVMGGGVVGIELGLVWASYGVDVTVIEMADRIIPAMDKEVSLELQKILSKKGMKIKTSVGVSEIVEANNQLTLKLNNGEEVVAEKALLSIGRVPQMNGLENLNLEMDRNRIKVNDYQETSIPGIYAPGDVNGTKMLAHAAYRMGEVAAENAIHGNTTRKANLKYTPAAVYTHPEVAMVGLTEEQAREQYGDVLIGKNSFTGNGRAIASNEAHGFVKVIADAKYHEILGVHIIGPAAAEMINEAATIMESELTVDELLLSIHGHPTFSEVMYEAFADVLGEAIHNPPKRK

SEQ ID NO: 82083 - protein, 421 aa, Oryza sativa Japonica Group
RARASRRSRARRRRRRRRKRRSGRRDATPRRAAVCSTWTYEGGGPSRETSLAAVRSRAAGVRACSGGGGSVPTVGGAAGRRSCLCFDDKSENAWKSRVGVLYVMHPITFFTNIIGVVTIVLISIVSILGLICLCHSLNFQLLIKRRRRNYYQANDEQLSYFNGPWLTRITLILVALWWGVGEVLRLTFVNGEGRFISDQTWQANVCKFYIVSNLGFAEPGLFLLLAFLLSAALQNQEVGALNRKWNQRTICAVFMLCSPSLIWEACVVFIGPHIASNDGQTSKVAKYWYSASSVHDGDVACTYPLLSSIFLGTFYTVLTLYVIFVGGQILSLVINKGLRRRIYMLIFATGILLPRAMFLGFSVLPWPGEIVHESLVFVSFLVLMIAAMLGIVILVYFPVAETFEVRNQEHIELQTSHSIAL

SEQ ID NO: 82084 - protein, 448 aa, Pseudomonas aeruginosa UCBPP-PA14
MNQPLNVAPPVSSELNLRAHWMPFSANRNFQKDPRIIVAAEGSWLTDDKGRKVYDSLSGLWTCGAGHSRKEIQEAVARQLGTLDYSPGFQYGHPLSFQLAEKIAGLLPGELNHVFFTGSGSECADTSIKMARAYWRLKGQPQKTKLIGRARGYHGVNVAGTSLGGIGGNRKMFGQLMDVDHLPHTLQPGMAFTRGMAQTGGVELANELLKLIELHDASNIAAVIVEPMSGSAGVLVPPVGYLQRLREICDQHNILLIFDEVITAFGRLGTYSGAEYFGVTPDLMNVAKQVTNGAVPMGAVIASSEIYDTFMNQALPEHAVEFSHGYTYSAHPVACAAGLAALDILARDNLVQQSAELAPHFEKVLHGLQGAKNVIDIRNCGLAGAIQIAPRDGDPTVRPFEAGMKLWQQGFYVRFGGDTLQFGPTFNARPEELDRLFDAVGEALNGIA

SEQ ID NO: 82085 - protein, 377 aa, Xylella fastidiosa 9a5c
MNSFAAVPVLIEEIRAGRMVVIVDDEDRENEGDLIMAAELVAPKDINFMVTHARGLVCLSLTRERCAQIGLSPMVQRNTTRFQTNFTVSIEAAEGLTTGISAYDRAHTIRTAVRPNAKPSDLHQPGHIFPLIAQPGGVLTRAGHTEAANDLPMLAGLEPAGVLVEIMNADGTMARRPQLEVFAQQHGLKIGSIADLIAYRLANEHTVERVDERVIETEYGSFLLVTYRDRIAHDLHFALVRGTLDASIPTLVRVQVENPLADMLHWRREDFGVAASDALRMIAAAERGVMVVLAAPRDSDALLARLRREPEVVSNVKDVGQWRRNGAGGQILADLGLGKLRVLGTPRRQIALAGFGLEVLEYVECRGGAPVAPQGVD

SEQ ID NO: 82086 - protein, 154 aa, Xylella fastidiosa 9a5c
MTHYEGDLRPAGARFVIVCSRWNARITDALVAGACRTLVDNGVSDDAVDVVRVPGAWEIPIVANLLAQVGQHAAIIALGCVVRGDTRHYEHVADLCAEGMMSVQMQTGVPVLNGVLAVECIKDAEMRAGGSHGNKGAETALAALEMVSLLEKLP

SEQ ID NO: 82087 - protein, 207 aa, Triticum aestivum
MTSVWKTKVLPGLNKIFDKDGKKAAAAEFLKSFNKEEIDKEIGDKKTELEPKLVETIEASPPEIKGLIKDKKTSKIKKNSVAVTKFLDDLAKIDFPGAKLVSDAVAKSGTTPLSPAIVFILDKVAPFVPAPKEEPKAEPEAAAPAEETTTREVAVEEKEEEAEPSAAPAEAAPVEAAAPAAEVVEEKKEEEKPAEAAAPAAEEPEKK

SEQ ID NO: 82088 - protein, 340 aa, Zea mays
MEKESKQGFFSALKGEVVRGLSPGRSRGKSLLLPRSRKTAAAEEVAPPEKLAQYAPDPLVTHSGSLRLAGEVLAPLMEGPDVAEDDTFAEDSGRRDGFGQWVRGHLTRAPLIAGGGDGSFRRSDLRLLLGVMGAPLAPVSVSTAEPLPLAPVKGAPIESSSAQYILQQYLAASGGAKVLRSVRNAYAMGKVRMVASEFETATRVVKNRGAAAAAAVEQGGFVLWRMSPDMWYVELAVGGSKVRAGCNGRLVWRHTPWLGAHAAKGPVRPLRRALQGLDPLSTAGLFAEARCVGEKKVGDEECFILKLSADAETLRQRSEGPAEIIRHVVFGYFSQRTGLL

SEQ ID NO: 82089 - protein, 665 aa, Arabidopsis thaliana
MVEGFSLSLMFLLVSHFFVSGVMSTNFTIENKCDYTVWPGFLTMTTAVSLPTNGFSLKKGESRVINVPPSWSGRLWGRSFCSTSSTGNFSCATGDCGSGKIECSDSGARPPTTLIDFTLDATDGQDFYDVSVVDGYNLPLVVVPQRLGSGRTCSNVGCVVNLNKTCPSELKVMGSSNKEHPIACMNACQKFGLPEFCCYGEYGKPAKCQPTLYSTNFKNECPLAYSYAYDNENNTFRCSNSPNYVITFCPNDISSMSQPSKETNGGTKQKSSWKLKLIVGVSAALTLMILIVVVIIVRTKNMRNSEWNDQNVEAVAMLKRYSYTRVKKMTNSFAHVLGKGGFGTVYKGKLADSGRDVAVKILKVSEGNGEEFINEVASMSRTSHVNIVSLLGFCYEKNKRAIIYEFMPNGSLDKYISANMSTKMEWERLYDVAVGISRGLEYLHNRCVTRIVHFDIKPQNILMDENLCPKISDFGLAKLCKNKESIISMLHMRGTFGYIAPEMFSKNFGAVSHKSDVYSYGMVVLEMIGAKNIEKVEYSESNNGSMYFPEWVYKDFEKGEITRIFGNSITEEEEKFAKKLVLVALWCIQMNPSDRPPMIKVTEMLEGNLEALQVPPNPLLFSPEETVPDTLEDSDDTSTFFNPSHFERGTLLASEDVLQHGSRSS

SEQ ID NO: 82090 - protein, 292 aa, Oryza sativa Japonica Group
MEQYEKVEKIGEGTYGVVYKGKHRHTNETIALKKIRLEQEDEGVPSTAIREISLLKEMQHRNIVRLQDVVHKEKCIYLVFEYLDLDLKKHMDSSPDFKNHRIVKSFLYQILRGIAYCHSHRVLHRDLKPQNLLIDRRTNSLKLADFGLARAFGIPVRTFTHEVVTLWYRAPEILLGARHYSTPVDMWSVGCIFAEMVNQKPLFPGDSEIDELFKIFSIMGTPNEETWPGVASLPDYISTFPKWPSVDLATVVPTLDSSGLDLLSKMLRLDPSKRINARAALEHEYFKDLEVA

SEQ ID NO: 82091 - protein, 1417 aa, Yarrowia lipolytica CLIB122
MGEFHINLIPTYDDAHNLTDDLQSVSSSPYSVTVPKNRLRSRSDLSEVADRSVSTGALERLVPNPNKIRVDRRVVSDTNGDSNANSGPSLTHHLSHANLNTYNNNSSTNNLQTPQKLKSSVSYSSLHRTPNNNNFDTSFQSLQSEQSFHTAPSPDGVLSSSPNETRLKFQKSRDILRQGAPSPLNLTPGNRSVNATSPHPPTPSAYLFENDSSHKNQEQPSKQSPIQYSSPHPIGNAISWKADEPNNWTLDRVLMFLDLYQFGPDWAQTFTERNIVEGRFLELVSYQKLKALGHLSLNNGEVDTSPSRFIHILRKTLNRGTSSGTIDVDALNSSQSSDGTTGRHAATSSPQAFTSPQMGSPVISQNSPVPHHSPAPSEPPPPPPPPTNSAPPPPASNSAPPPPTSTPSAVQAKAHIPNSPSTSSLTSPLVPTTSAPADKITPRPLKTNRPQRPMTAYEGLYRTMKSPVSPSGNFFRRTHHKSSSSESSILGEDGLPKEEERKSRNLFSRLRRRDRSSSKNRNSTIPPSPVDHDGAASLYSNESKDKTSSPTLTSSSGWAPPKPPKVPIPNPTYNPPPLPPRSGSQQTPTSASTHHSSLSGFSVNSQPAPSTPLDRYFTITQNDRMILVTLDNVHFVAADLKNVLSVPQATDVIAKALGLNTHDLRFRLTDVGSEASEKLDEEALSYFFSDNKVMLSNYKLLVESASPSATLAPAVAAQTSSSVTSSPGKSIYSLETPSGGTKYPATPSYLYTKTQEPPGDYFSSQPPSKPTRQPSQSSIQTASDDQDSFKVIRPPPKKEINFDNRRSSPYDTLSRNTSFVARREAPRRPESSSSVRVRSTAVNSYTPGESEKFIPRPYHGGSNRLVMRKPVSAASSPVDQQSNDPTAATTAVSAAPQPSRLNPKLSGNFTFGRSGLKFKVPNYQDKLQRRSTSSSVRVAPEQNFQENDISFDDIQFDDDDDESDDGLWSKKLTKPTEAVSSTVSSTRSSTSSSSDVWAVRPPAEVVYDNLERFFPNADLDKPIIDDVESPPTSPDKRETLDYVKPRSMIIDQSQNDRKATITPLTSKIKEEGTLEKEEKTPAAKFSRKTGTSRIKSIRVVAREASEARKRFSTSSTKSTMTNPALLRRRSTKMWGQKVVEATPNQIKKGHISTVRDQRGHLKKFVWVKGELIGVGTFGKVYLALNATTGDMMAVKQVEVRNKAAAEVGVGALHAEVGTMKNLDHFNIVQYLGFETMQDHTYNLFLEYVPGGSVGSCLRNHGRFEENIVRFLTRQILEGLAYLHGCGILHRDLKSDNLLLDLDGVCKISDFGISKKSRDIYSNDAEMSMQGTIFWMAPEVIHNVIHNEKQGYSAKVDIWSLGCVVLEMFAGRRPWSNDEAIGAMYKLGNSRLAPPIPEDTKTFVSEDAKDFLDKCFIM

SEQ ID NO: 82092 - protein, 315 aa, Shigella boydii
MPDMKLFAGNATPELAQRIANRLYTSLGDAAVGRFSDGEVSVQINENVRGGDIFIIQSTCAPTNDNLMELVVMVDSLRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVLVDDMIDTGGTLCKAAEALKERGAKRVFAYATHPIFSGNAANNLRNSVIDEVVVCDTIPLSDEIKSLPNVRTLTLSGMLAEAIRRISNEESVSAMFEH

SEQ ID NO: 82093 - protein, 487 aa, Arabidopsis thaliana
MESVALSRIGLAGLAVMGQNLALNIADKGFPISVYNRTTSKVDETLDRASNEGKLPVAGQYSPRDFVLSIQRPRSVIILVKAGAPVDQTISALSEYMEPGDCIIDGGNEWYQNTERRIVEAEKKGLLYLGMGVSGGEEGARNGPSLMPGGSFTAYNNVKDILEKVAAQVEDGPCVTYIGEGGSGNFVKMVHNGIEYGDMQLISEAYDVLKNVGGLSNDELAEIFTEWNRGELESFLVEITSDIFRVKDDYGDGELVDKILDKTGMKGTGKWTVQQAAELSVAAPTIAASLDCRYLSGLKDERENAAKVLEEAGLKEDIGSASRGVDKKRLIDDVRQALYASKICSYAQGMNLLRAKSLEKGWDLNLGEMARIWKGGCIIRAVFLDRIKKAYQRNPNLASLVVDPDFAKEMVQRQAAWRRVVGLAISAGISTPGMCASLAYFDTYRRARLPANLVQAQRDLFGAHTYERTDRPGAYHTEWTKLARKSQ

SEQ ID NO: 82094 - protein, 497 aa, Marinobacter sp. ELB17
MGATLATAAAKNTNGVAADTENPAENSAEQIGYTHAVFQKQQQAFRAQPMPTADERRDNLNRLKQALLSWQDLLIAAIDKDFGCRSKDETLIAEIMPSVQGINYTLKHLDSWMKPSKRHVSMLFRPASNQVHYQPKGVVGVIVPWNYPLYLAIGPLVASLAAGNRTMVKMSEFTPHTSALMKELVEATFDEDQVAVILGDAKVAADFSERPFNHLLFTGSTSVGKLVMQAAAKNLTPVTLELGGKSPAIVATDVPLEDAAQRIAFGKAFSAGQTCVAPDYVLCPADRVAAFVEEYRKQFSAMYPSLRDNTDYTAIINQRQYQRLQGYLDDARSKGAELVEINPANEILDAASHKLPLTLLLNTTADMRVMQDEIFGPILPVVAYETLDDALLFINDRPRPLALYYFGYNQDEQQKVVANTHSGGMCINDALMHVAQDDLPFGGIGDSGMGHYHGKEGFLTFSHQRGIFAKQKFNSGKMVYPPHGGVAHKLIYKLFIR

SEQ ID NO: 82095 - protein, 338 aa, Azospirillum brasilense
MNTPHTVLVTGGAGYVGSHCVAELLDRGFRVVVLDNLRQGHRVAVPSDAAFVEADLADMDALTRVFAEWRFDAVFHFAALSLVGESMRDPHLYLHGNTVNSLNLIRAATTAGVRKMVFSSTANLFGTPERLPIDEETTIDPGSPYGESKFFIERALHWADRCHGLRSACLRYFNAAGAHPNGTLGEDHAPETHLIPLVLDAPAAGRSHIEIFGDDYPTADGTCVRDYIHVCDLADAHLRVLPALETRSRFNLGNGTGYSVREVIAATERVTGLTVPVRVGPRRAGDPAVLIASSERIRGELGWSPRFPDLDSIIGSAWEWRRRHPGGYRGPAVAQAAE

SEQ ID NO: 82096 - protein, 213 aa, Marinobacter sp. ELB17
MDSDLTQKNLSFNSARFMVSASKLNECPADIGAEVAFAGRSNAGKSSALNTITVNGKLARTSKTPGRTRLINFFSLNRENARLVDLPGYGYARVSRDMKDDWQTHLGHYLNDRRCLRGLVLVMDIRHPLTEFDQTMVQWCQHNTMPLMILATKSDKLKFGQAKTAMLGIRQKLNEFSCVQHLIMFSSSNKTGLDECRQALTQWLEAEPEAAAG

SEQ ID NO: 82097 - protein, 503 aa, Arabidopsis thaliana
MEMLLGGRATNGALRSKTKIVCTLGPVSRSVEMIEKLLKAGMNVARFNFSHETLDNLRTAMNNTGILCAVMLDTKGPEIRTGFLKEGKPIQLNQGQEITISIDYKIEGDSNIISMSYKKLAEDVKPGDVILCSDGTISLTVLSCDKSFGLVRCRCENSTILGERKNVNLPGIVVDLPTLTEKDKEDIIQWGVPNKIDIIALSFVRKGSDLTEVRKLLGEHSKNIMLMSKVENQEGVMNCEKILENSDAFMVARGDLGMEIQIEKMFLAQKTMIKMANALGKPVVTATQMLESMTVSPRPTRAEATDVANAVLDGTDCVMLSGETAAGAHPEAAVLTMSRICKEAEDFIDYDILHKKTLGMLSLPLSPIESLAASVVSTAQSVFASAIVVLTKGGYTAELVAKYRPSVPILSVIVPEIAQGNDIEMSCSDSVAHVARRGLIYRGIIPVVATGSSARDSNKDATEEMINLAIGFAKTKGICKNGDSIVALHKIDGSSVVKIVSVE

SEQ ID NO: 82098 - protein, 285 aa, Melampsora lini
DDATLLRFLRARKFDLEKSKLMFTDCEKWRKEFKVDELYATFEYPEKKEVDAIYPQFYHKTEKDGRPIYIEQLGKLDLTKLYKVTTPERQLQRLVVEYEKFLRDRLPVCSVQQGKLVETSCTIMDLSGVGLSQFWKVKNYVQQASHLSQNYYPETMGKFYIINAPYLFSTVWSLVKPWLDEVTVKKISILDSSYHKTLLEQIPAESLPKSLKGTCDCPGGCSMSDAGPWKDEETVAKAKKLKAGEPAKEEAIPEVAATESEKKPEEAAATEAPATEAAPAETTTT

SEQ ID NO: 82099 - protein, 241 aa, Glycine max
MASSALISDTQQWKDLKAHVEDINKTHLRDLLSDDKRCQSMLVEFDDILLDYSRQQATPETIQKLFELAEAASLKEKIIRMYSGEHINSTENRSVLHVALRASRDAVIQSDGQNVVPEVWKVLDKIQEFSEQIRNGSWVGATGKALKDVVAIGIGGSFLGPLFVHTALQTDPEAVESARGRQLRFLANVDPIDVARNITGLNPETTLVVVVSKTFTTAETMLNARTLREWISSALGIENGE

SEQ ID NO: 82100 - protein, 434 aa, Oryza sativa
  misc_feature (109)..(109): Xaa can be any naturally occurring amino acid
  misc_feature (122)..(122): Xaa can be any naturally occurring amino acid
  misc_feature (145)..(145): Xaa can be any naturally occurring amino acid
  misc_feature (346)..(346): Xaa can be any naturally occurring amino acid
MSAYCGKYKDELIKNAAYIGTPGKGILAADESTGTIGKRFASINVENVEENRRSLRELLFTTPGALQHLSGVILFEETLYQKTKDGKPFVDVLKEGGVLPGIKVDKGTXEVAGTNKETTTQXGHDDLGKRCAKYYEAGARFAKWXRAVLKIGPNEPSQLSIDLNAQGLARYAIICQENGLVPIVEPEILVDGSHDIERCAYVTEKVLAACYKALNEHHVLLEGSLLKPNMVTPGSESKKVSPQLIAEYTVRALQRTVPAAVPAIVFLSGGQSEEEATVNLNAMNKLSTKKPWALSFSLRPCLSSRGTLKAWGGKTENVVKAQKAFITRCKANSEATLGTYQGDAVXLGEGASESLHVKDYKNSYGGCDGRDEAAAGAWRAGSRNGESARFACGGVAEAVRVPRLWSQQHGWVGGGGGGQLKMALAGWLLYIDKA

SEQ ID NO: 82101 - protein, 463 aa, Streptococcus pyogenes str. Manfredo
MTIFRKKKKYSNKTEMQRHFKVIDLVFLGLGSMVGTGIFTVTGIGAAKYAGPALTISIIISAITIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWSHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGILIYLAYGYTHSIENK

SEQ ID NO: 82102 - protein, 379 aa, Zea mays
  misc_feature (232)..(232): Xaa can be any naturally occurring amino acid
PYPALICQLLALIISFLLIRRGVSLIPPKPDNLFEKGKNDKLNLGLSFFQGWQPPLENPLSPWLNFDTKTPFFGVFEGHGEKFFPKFWPKFLLGQALKTKPFSTGALGPVAHKPFLKRDKMIQGQKGWQNLFALGNKINNFRGLIKGLIWSPGGRVSNIQQNDGASKEGPPSDFVGPTWGSPACVPLIKNPQLVGANAGDPRCVFSGGGRASILSGDHKPNLASEKKRILKXGGFIHMGRVNGSLNLSRAIGDVELKQNKFLPPEKQIVTANPDINVVELCDDDDFVVVACDGIWDCMSSQQLVDFIHERINTESSLSAVCERVLDRCLAPSTIAGDGCDNMTMILVQFKKPVDRNKKAEAAGQSASNVDEAKSRVAEE

SEQ ID NO: 82103 - protein, 197 aa, Zea mays
  misc_feature (62)..(62): Xaa can be any naturally occurring amino acid
  misc_feature (114)..(114): Xaa can be any naturally occurring amino acid
  misc_feature (128)..(128): Xaa can be any naturally occurring amino acid
  misc_feature (136)..(136): Xaa can be any naturally occurring amino acid
  misc_feature (161)..(161): Xaa can be any naturally occurring amino acid
MFGTTRGTCTNELINMGIYIGTRGKPIVGANDSTGTIGKRICRINGSNSTETRRALRELLFXAVAALQNMSGAILCWETIYHKTRDGRAFCRILMDARTLLAMKADTDKIVAVXTDDDTTIHSHDNHXKRWTEYYXATHHYAKQRAGQQRPPRAPSQIDIXLIAHGLARYAIICQENGLVPIVEPEILVDGPHDIDR

SEQ ID NO: 82104 - protein, 344 aa, Sulfolobus solfataricus P2
MEAVILHGGQGTRLRPLTHTGPKQLIKVAGKPVSQWVLEQIRDAGIRDVIIVLGDNAPTRVVEYYGDGSKFGVRITYVYQGKARGLADAVYKVKDVVSDKFLVYLGDNLVPYDLSKFSSFKGSASILLAKVNNPNRFGVAVIKDGRVVKLIEKPKEQISDLALVGVYGFTREIFDVIESLKPSWRGELEITDAIQGLIDRGREVNYEIIQGWWKDTGTPKDILEANAFLLDRYAESRIEGVVDNSTVDGKVIIEKGAVIKNSVVRGPTYIGRDTKIINSYIGPFTSIGDQSEITDSEIEYSVILDGVKIRGVTLMDSLIGNNSTVEKGGRWQKLIIGENSSVIL

SEQ ID NO: 82105 - protein, 182 aa, Shewanella oneidensis MR-1
MAGPLRTYQGIHPQLGDNVYVDAASVLVGDIALDTDASIWPMVAARGDVNHIRIGKRSNVQDGSILHVTRKSASRPEGHPLIIGDDVTIGHKAMLHGCKVGNRVLVGMGAIILDGAILEDDVILGAGSLVPPGKVLESGYLYVGSPAKQARPLTEAELKFLPESADNYVRLKNEYLAEPQPN

SEQ ID NO: 82106 - protein, 278 aa, Zea mays
MMWPPSTTPWLPFLYPAPASAYVAAMSAVSFVSMANAGLAELRGDHMPYSKFWHAVAGAAGGDTRQQGGMPLLRSRDGMLLAYAPALLAAAASFAVPGAVEGARAELLSAALAAHFLKRVLEVLCVHRYSGSMPLGTAATISCSYLVSTATMVYAQHLSRGLPDPAVDLLCPGVLVFAVGLAGNLYHHRLLSGLRADDGTGYKVPRGGLFGLVACPHYLFEILAFFGFAMISQTLYALAVATGTAAYLAGRSCATRRWYRSKFQDFPPRIKALIPYVL

SEQ ID NO: 82107 - protein, 416 aa, Arabidopsis thaliana
MTTMSNLPAEVLEEILSRTPVTSLRTMRSTCKKWNNLSKKKIIPEAARKQQGLMLIKKKICSLSFSLHEIHKDDYVVPCINQVDIPRNIEVEKIFHCDGILLCVIEDNCSLLVWNPYLGQTRRIEVSSDADMNDRYALGYDNNNSSHKILRIKKDFKNSDGLGYEIYRFASNSWSLLDEEVMKPEWDVWSVQRSSVSLKGNTYFLLQGNDYDDQEDEEEEDDEEYEDDDDVLPKDNFLLCFDYTTERFGPRLLLPFNPHVEETVALSCIGEERLVMLYQSFKTYKGIEIWVTDKIDPKAVSWSKFLKVDITPLTGFPVDFYADSFVIDEEKKVAAVFDIHCSYQKAHIIGEDGYLKCVNMGRASDVGNGQPLVFSSYVPSLVKVPVKQPKGKRKGRSSETKSNKNKKGRKIKIIGG

SEQ ID NO: 82108 - protein, 209 aa, Rhodococcus sp. RHA1
MSPLCHKNREHEPIRSTRVTAAEPHGTPQWQHGGVTSPHQTATATLHTNRGDIKIALFGNHAPKTVENFVGLADGSKDYSTANAGGTDSGPFYDGAIFHRVIDGFMIQGGDPTGTGAGGPGYKFGDEFHPELQFDRAYILAMANAGPGTNGSQFFITTGPTPHLNRRHTIFGEVVDEESKKVVDAISTTATDRADRPLEPVVINSVTIA

SEQ ID NO: 82109 - protein, 527 aa, Zea mays
MAMAMMAMRRAVALGARHIPAAAASSFRVVSLRHMSADAGAAMEKIRAAGLLRTQGLIAGQWVDAYDGKTIEVQNPATGEVLANVSCMGSRETSDAIASAHSTFYSWSKFTASERSKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSEFTPLTALAAADLALQAGIPAGALNVVMGNAAEIGDALLQSTQVRKITFTGSTAVGKKLMAGSANTVKKVSLELGGNAPCIVFDDADIDVAVKGSLAAKFRNSGQTCVCANRILVQEGIYEKFASAFIKAVQSLKVGNGLEESTSQGPLINEAAVQKVEKFINDATSKGANVMLGGKRHSLGMSFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGVDEYLELKYICMGNLG

SEQ ID NO: 82110 - protein, 524 aa, Candidatus Kuenenia stuttgartiensis
MESFESLGLSESTLKVLKEKGYEEPTPIQQKTIPAILSGTKDIVGQAQTGTGKTAAFGLPVLELLPEKSKNVQALVLTPTRELAIQVAEELNSLKGKKRLSIVPIYGRQSMELQLRSLKKGIDIVVGTPGRVLDHLKRGTLKIGKISFLVLDEADEMLNMGFIDDVREIMENTGHEKRTLLFSATMPFEIMQIAKNYMRDFDVQKVNAGQLTVSQTDQIYFEVFAADKFEALCRIIDIEKDFYGLVFCRTKIDVDAVASHLIERGYDADALHGDISQSLREKILAKFKKRQINILIATDVAARGLDIHNLSHVINYSLPQDPESYVHRIGRTGRAGKGGIAITFITPEEYRKLQFIQKAAKTDIRKEKLPKIEDIIRTKKLKIKDHINEIVDLNAHNCYIEMAKELTEHKKPEDIISALLQYSFPDELNEKRYVEIEEAVVDKKGKTRLFVTQGKQEGLTHKKLVTYIKDISNIASEKIRDVQILDKYSFVTLPFREAEILLTSFKRRKKGSGLFITKAKKMRT

SEQ ID NO: 82111 - protein, 514 aa, Shewanella oneidensis MR-1
MTTTKRPIALLILDGWGYRENTHMNAVYHANTPVLDRLNAQYAHGLISGSGLDVGLPDGQMGNSEVGHINLGSGRIVYQELTRISKAIADHEFEQNPALCDAVDAAVKTGGAVHIMGLLSPGGVHSHEEHIEAMCRMAVARGATKVYLHAFLDGRDTPPRSAKSSLSHFDDLFTTLGHGRIASIIGRYFAMDRDNRWDRVSQAYDLITQGKSKFQYDNAVTALEAAYSRDENDEFVSSSAITDANGQVATLQDGDALIFMNFRADRARQITRSFINPEFDGFARAVTPKVNFVTLTEYAADIKAPIAYPSDNLVNTLGEVLQNRGRTQLRISETEKYAHVTFFFNGGKEEPFNGEDRILINSPKVATYDLQPEMSSTELTDKLVAAIESTKYDVIICNYPNGDMVGHTGNFDAAVKACEAVDACIGRVVEALAKVGGECIITADHGNAEQMTDETTGQAHTAHTSELVPFVFVGRDATIDKGGKLSDVAPTILHLMGESIPAEMTGKPLIHVKE

SEQ ID NO: 82112 - protein, 487 aa, Burkholderia thailandensis E264
MGIKHWIGGREVDSRETFTTFNPATGEPIAEVASGGAQEIDAAVRAAKDAFPKWANTPAKERAKLMRKLGELIERNVPALADLETQDTGLPISQTKKQLIPRASENFHFFAEVCTQMNGRSYPVDDQMLNYTLYQPVGVCALVSPWNVPFMTATWKTAPCLALGNTAVLKMSELSPLTADQLGRLALEAGIPAGVLNVVQGYGATAGDALVRHPDVRAVSFTGGTVTGKRIMERAGLKKYSMELGGKSPVLIFDDADFDRALDASLFTIFSINGERCTAGSRIFVQRTIYDKFVAEFARRANNLIVGDPADESTQVGSMITRAHWEKVTGYIRLGIEEGARLVAGGPDKPANLPAHLANGNFVRPTAFADVDNRMRIAQEEIFGPVACLIPFDGEEDGLRLANDTSYGLASYLWTQDVRRAHRLARGIEAGMVFVNSHNVRDLRQPFGGVKESGTGREGGEYSFEVFAEIKNVCISMGGHHIPRWGV

SEQ ID NO: 82113 - protein, 272 aa, Deinococcus radiodurans
FSRVHPHRYLDVGIAEEVAVTTAAGMALQGMRPVVAIYSTFLQRAYDQVLHDVAIEHLNVTFCIDRAGIVGADGATHNGVFDLSFLRSIPGVRIGLPKDAAELRGMLKYAQTHGRPFAIRYPRGNTAQVPAGTWPDLKWGEWERLKGGDDVVILAGGKALDYALKAAEDLPGVGVVNARFVKPLDEEMLREVGGRARALITVEDNTVVGGFGGAVLEALNSMNLHPTVRVLGIPDEFQEHATAESVHARAGIDAPAIRTVLAELGVDVPIEV

SEQ ID NO: 82114 - protein, 90 aa, Medicago sativa
YYEAGARFAKWRAVLKIGPNEPSPLSIHENAYGLARYAVICQENGLVPIVEPEILVDGSHDIAKCADVTERVLAACYKALSDHHVLLEGT

SEQ ID NO: 82115 - protein, 463 aa, Erythrobacter sp. NAP1
MAIELKMPALSPTMEEGTLARWLVKVGDEIASGDIMAEIETDKATMEFEAVDEGTLAAILVEEGTENVAVGTVIAMLAEEGEDVSDVSAPSGDAAPAPTPAPAPAPKSAPASSEGVKASPLAKRIAANEGVDLASVEGSGPKGRIVKADVEAAAGGSSSQPRSGDRVIASPLAKKMAGEQGIDLGDVSGTGPGGRIIKADIDNYEPTPAASPAPAPAASEEKTAKPAPQAPEHGAPFEEEKLSNVRKVIARRLTESKQTVPHYYLTMDIVLDPLLKLRKELNASLEPDGVKLSVNDLLIKALARALIRVPQCNVSYHGDTMRKYSRADISVAVAAPSGLITPVITEADTKGLAQISKEMKELAGKARDGKLQPHEYQGGTASLSNLGMFGIKQFDAVINPPQGMILAVGAGQQVPYVIDGEIKPATVLHASGSFDHRAIDGAEGAQLMEAIKQLVENPMGLLV

SEQ ID NO: 82116 - protein, 385 aa, Oryza sativa Indica Group
MAKIKIGINGFGRIGRLVARVALQSDDVELVAVNDPFITTDYMICEFGIWISVCRPVDQIVIDMSSDAFAHAKSQIVPVALKFRTAICFAVTYMFKYDTVHGQWKHHEVKVKDSKTLLFGEKEVTVFGCRNPEEIPWGETGAEFVVESTGVFTDKDKAAAHLKGGAKKVVISAPSKDAPMFVVGVNEKEYKPDIDIVSNASCTTNCLAPLAKVINDRFGIVEGLMTTVHAITATQKTVDGPSSKDWRGGRAASFNIIPSSTGAAKAVGKVLPALNGKLTGMAFRVPTVDVSVVDLTVRLEKPASYDQIKAAIKEESEGKLKGILGYVEEDLVSTDFQGDNRSSIFDAKAGIALNDNFVKLVSWYDNEWGYSSRVVDLIRHMYNTQ

SEQ ID NO: 82117 - protein, 357 aa, Campylobacter lari RM2100
MKEIEKLRNKIDTIDDKILALLNERMLHVKDIGVIKQNLGGSIYRPERERAIINRLKNYNHGLLDQNAIEAIYQEIFAVSRNLEMPQSIAYLGPEGSYTHQVARTRFGAMSRYTPLANIEDVFKELAHKEAKYGVVPIENNTAGAVGVTLDCLGKYEDVKIFAEIYMDIHHSFVSMSENLKDIKRIYSHPQGYNQCRNFLESHDLSEIEFVASKSTAHAAYLASQDVTSAAICSKIAAKLYNVPILFETIEDNLANRTRFLILSDIKIPQMPHCKTSILALAAHKPGGLSDLLYEFKKEGINLTKLESRPIKTREFVHSFYIDFEGHIDDENVQRVLKKAEHIKWLGSYLSGESNEI

SEQ ID NO: 82118 - protein, 312 aa, Vitis vinifera
  misc_feature (164)..(164): Xaa can be any naturally occurring amino acid
MGSSSGSDVEAGFAKLQGEDFEYYMQTYSIILGRNSKKSTVDVDLSSLGGGMNISRHHARIFYDFQRRRFALEVLGKNGCLVEGVLHLPGNPPVKLDSQDLLQIGDKEFYFLLPVRSILGGTGASVRHHHSAASLHLPPPPPAPIPGRISVASGIGGKKGRGGXLLSEYFDDDYDDEEGSGSGKKMRREGHEKAEARSRVDRDADNHQLLQLEEKDVVSSVATVLSDLCGPGEWMPMEKLHAELVEQYSSVWHHSRVRKYLTSEEWSSPESKGKPWFGLLMLLRKYPEHFVINTRSKGRITLEFVSLVSLLS

SEQ ID NO: 82119 - protein, 246 aa, Candida glabrata CBS 138
MVKPIIAPSILASDFANLGCECHRVINSGAEWLHIDVMDGHFVPNITLGQPIVTSLRRAVPRSQEEEKASGEVARPTAFFDCHMMVEEPEKWVADFAKAGADQFTFHYEATKDPLSLVKLIKENGIKAACAIKPGTPVDVLFELAPYLDMALVMTVEPGFGGQKFMPDMMPKVEALRTKFPHMNIQVDGGLGKETIGVAAKAGANVIVAGTSVFTASDPHEVISFMKEEVRKELKAKHILGDETKH

SEQ ID NO: 82120 - protein, 490 aa, Oryza sativa Japonica Group
MAGRKENPVLTACQAPSGRITRAQAAANRGRFGFAPSVSLPARTERKQTAKGKTKRGALDEITSASTATSAPQPKRRTVLKDVTNIGCANSSKNCTTTSKLQQKSKPTQRVKQIPSKKQCAKKVPKLPPPAVAGTSFVIDSKSSEETQKVELLAKAEEPTNLFENEGLLSLQNIERNRDSNCHEAFFEARNAMDKHELADSKPGDSSGLGFIDIDNDNGNPQMCASYASEIYTNLMASELIRRPRSNYMEALQRDITKGMRGILIDWLVEVSEEYKLVPDTLYLTINLIDRFLSQHYIERQKLQLLGITSMLIASKYEEICAPRVEEFCFITDNTYTKAEVLKMEGLVLNDMGFHLSVPTTKTFLRRFLRAAQASRNVPSITLGYLANYLAELTLIDYSFLKFLPSVVAASAVFLARWTLDQSDIPWNHTLEHYTSYKSSDIQICVCALRELQHNTSNCPLNAIREKYRQQKFECVANLTSPELGQSLFS

SEQ ID NO: 82121 - protein, 122 aa, Vitis vinifera
  misc_feature (20)..(20): Xaa can be any naturally occurring amino acid
MASKLQQLQSKAAQASQFVXKHGCAYHKQLLEQNKQYVQEPPTVEKCNLLAKQLFYTRLASIPGRYESFWKELDYVKHMWKNRQELKVEDAGIAALFGLECYAWFCAGEIVGRGFTFTGYYV

SEQ ID NO: 82122 - protein, 191 aa, Deinococcus radiodurans R1
MAHLGHGTAGRFAEREHERRLACTPGCGGYWVGGYRAGGQRFVSQSTAILTSGMERTFAMIKPDGVRRGLTPEILARIHNKGYRVVGLKQMMMPRETAEQHYGEHRERPFFGELVDFITGGPVVAIALEGENAIAGWRAMMGATNPANAAPGTIRADFATSTGENVTHGSDSPESAERELALFFGDGELLS

SEQ ID NO: 82123 - protein, 339 aa, Enterococcus faecalis V583
MNSVFQGRSLLAEKDFSRAELEYLVDFSIHLKELKKKGIPHHYLEGKNIALLFEKTSTRTRSAFTTAAIDLGAHPEYLGANDIQLGKKESVEDTAIVLGSMFDGIEFRGFSQEVVEDLAKYSGVPVWNGLTDQWHPTQMIADFMTVKENFGRLEGITLVYVGDGRNNMANSLLVTGAILGVNVRICAPKELFPSDEVVNYAKEFAKESGAELMITDDVAKGVKGANVLYTDVWVSMGEEDKFEERVNLLKPYQINMAMLEKTENMDGDLIVLHCLPAFHDTKTQYGEMVAEKFGITEMEITDEVFRSKYGRQFEEAENRMHSIKAIMAATLGNLFIPRV

SEQ ID NO: 82124 - protein, 598 aa, Campylobacter lari RM2100
MQIKELENLANNLREVIIDIVSKNGGHLSSNLGVVELSIAMHYVFDVQKDPFIFDVSHQSYPHKLLSGKINSFHTLRQFNGLSGYTKPDEGDYFIAGHSSTSISLAVGACKAIRLKNEDRLPVVLIGDGALSAGMAYEALNELGDREYPCVIILNDNEMSISKPIGAISKYLSQAMATQFYQKFKKRIENLLEYFPQGASYMAKRFEEGLRLITPGLLFEELGLEYIGPIDGHNLNEVINALNQAKAMKKPCVVHAQTIKGKGYALAEGKNAKWHGVGAFDVNSGESLKQGVSKKSATEIFSNTLLNLAQKYENIVGVTAAMPSGTGLDKLIEKYPERFWDVAIAEQHAVTSMAAMAKEGFKPFIAIYSTFMQRAYDQVIHDCAIMNLNVVIAMDRAGIVGEDGETHQGVFDISFLSVIPNITLAAPRDEAMMKNIMEYAYFHQGVFAFRYPRGNFLLDDEFNPCEIKLAKAQILSKAQSDKVFLGFGQGVAKAKLALDKLGLDYASLIDLIFAKPLDEELLREIAKNTKTWFVFSDSAKIGGVGSLITNFLQKENLYHIKVVSFEFEDQFIAHGKTSEVEKFLELDIDSLCQKIKIY

SEQ ID NO: 82125 - protein, 607 aa, Oryza sativa Japonica Group
MASAAAPKRCYYEVLGVPRDCSPADIKLAFRRLALSLHPDKQPPGSDVAAATAAFQELQHAHSVLSDPHERSYYDSHRSQILFSDHHPSSGPGRGGGVASASASPVPDLFAFFSSSAFSGFSDSGRGFYKVYGDVFDRVFAQELAYARRMGMPADAVPTPPVIGNLDSPHAQVAAFYSYWLGFGTAMDFGWAAEWDAARGESRRVRRLMEEDNKKATRKARREYNDAVRGLAAFCKKRDKRVVDMALKKKVEEEKRKAEEAARKKEEERRRKERAMAYQEPEWARVDEDEAAVFEDDEEEETRAKRKEELYCVACNKKFKSDKQWKNHEQSKKHRDKVSELRMVFEEEEEALKDAEEEEPEEVDVGFDFQPAQESEESEFSDAAEELADELSEGLEVRDEEEKGDKHLGNGEQKVGSYDETSVLEEMLSRSRRKNRKSGFVAPQEEASPAGAMDDDDDEDTSYEINNVKKKGRRRRAAKKGGTYADNGQGRKSENQPEESRHNNDENGADDKMEGPSSNEDSAAASKEDQQKGKTGNTKKNKKGTEKNTTISSEQKGTSKGKKQKEVSKAPSNDCETCGSTFDSRNKLFSHLEETGHAMLKTRQKNR

SEQ ID NO: 82126 - protein, 436 aa, Coccidioides immitis RS
MAPITADRSKRKATDEPSTPDSKQKVKKARTESPGSEIKVGIVIVLKVDDSASKPTLKIVPFAEKVRGAGTYRVYVEILLMEPPVQPAVLEERRGDIEFRVVNNDGSRESFIILTGLKCIFQKQLPKMPKDYIARLVYDRTHLSMAIVKHPLEVVGGITYRPFKGRRFAEIVFCAISSDQQVKGYGAHLMSHLKDYVKATSEVMHFLTYADNYAIGYFKKQGFTKEISLDKSIWMGYIKDYEGGTIMQCTMIPKIRYLESGRMLLKQKEAVHAKIRAFSKSHIIHAPPKEWRNGVCEIDPLSIPAIKESGWSPDMDELARQPRHGPNYNQLLHLLNDMQNHSAAWPFAQPVNRDEVPDYYEVIKEPMDLSTMEEKHEKDLYPAPQDFIKDAMLIFDNCRRYNNENTPYAKSANKLEKFMWQQIKNIPEWSHLAEGH

SEQ ID NO: 82127 - protein, 424 aa, Wolbachia endosymbiont of Drosophila simulans
MNVPRVTKLDNGLRIITEQVRDIDSVALSIRVGVGSRAESAKQNGISHFLEHMAFKGTKTRTAFEIAKAFDDIGGVFNASTGRESTTYYAKVLKKDIKTGIDILIDILMNSTFPEDELEREKGVVIQEIFQTNDSPSDIVFDKYFEAAYKDQPFGRSILGTQDTVKSFTRGDLDNYINEHYFGENMLFAVAGNVEHEEVVALTKDFFSKIHSKKLKKSQNATSHTGGEYLEHRKLDQVHLLIGLPSVSRHDDKYHTFQVLDSILGSGMSSRLFQEVREKQGLAYSVYSFNSSYTDTGMFSIFAGTDSSNLDKLLKSITTELKKLSTDDLREEEVNRVKERVKSQILMSRESVSSRAETLGHYYGNYNRYISKNELIEKISAVTTANVKKAAEELLSQHEKATLAAIGEIKSLPSYDKVVSMLKA

SEQ ID NO: 82128 - protein, 765 aa, Brassica oleracea
MTITSNISVQNDNLVVQGKTILTKIPDNIILTPVAGAGSDSGAFIGATFKQSKSLHVFPIGVLEGLRFMCCFRFKLWWMTQRMGASGKDIPLETQFMLLESKDEVNGDDAPTVYTVFLPLLEGQFRAVLQGNEKNEIEICLESGDKAVGTSQGTHLVYVHAGTNPFEVITQSVKAAERQMQTFHHREKKKLPSFVDWFGWCTWDAFYTDVTAEGVDEGLRSLSEGGTPPRFLIIDDGWQQIENKEKDSNCLVQEGAQFATRLVGIKENAKFQKNDPKDTQVSGLKSVVDNAKQRHNVKQVYAWHALAGYWGGVKPRASGMEHYDSALAYPVQSPGVLGNQPDIVMDSLAVHGLGLVNPKKVFNFYNELHSYLASCGIDGVKVDVQNIIETLGAGLGGRVSLTRSYHQALEASIARNFKDNGCISCMCHNTDGLYSAKQTAIVRASDDYYPRDPASHTIHIASVAYNTLFLGEFMQPDWDMFHSLHPTAEYHAAARAVGGCAIYVSDKPGNHNFDLLRKLVLPDGSVLRARLPGRPTRDCLFADPARDGTSLLKIWNMNKFTGIVGVFNCQGAGWCKDTKKNRIHDTSPGTLTGLVRAEDADLISEVAGQDWGGDSIVYAYKSGELVRLPKGASIPLTLKVLEYELFHISPLKEITASISFAPIGLLDMFNSSGAIQSMEINTVTDEKPELSSSSVVSENRSPTALISLGVRGCGRFGAYSSQRPLRCAVDGTETEFNYDAEVGLVTLNLPVTREEMFRWRVEILV

SEQ ID NO: 82129 - protein, 268 aa, Triticum aestivum
  misc_feature (199)..(199): Xaa can be any naturally occurring amino acid
  misc_feature (228)..(228): Xaa can be any naturally occurring amino acid
HYRTSLYKKAGWYRSGIPGISSTHAPGIERLHRPPILPAGDDEATGVTSKDVVLDADTGLSVRLYLPKLQEPSTKLLVLVYFHGGSFLIESADSSTYHNYVNALAAAAGVLAVSVDYRLAPEHPLPAAYDDSWAALQWAALAQDEWIREHGDTARLFLAGDSAGANIVHDMLMRVASNDGSPKVEGAILLHPWFGGSSXVEGEHPAAPMVTGMLWSYACPGAVCGADXPRMNPRAPGAPALEKVGWREEALERGVWRKGFPGRRPSVP

SEQ ID NO: 82130 - protein, 72 aa, Glycine max
MSQFMNKGCWSEDVVIHCGKGVTTIIGGGDSVAAVEKVGLADKMSHISTGGGASLELLEGKQLPGVLALDDA

SEQ ID NO: 82131 - protein, 145 aa, Streptococcus pyogenes MGAS10394
METSEELKQRIGDLSYEVTQHAATESPFTGEYDDFFEKGIYVDIVSGEVLFSSLDKFNSGCGWPAFSKPIENRMVINHDDSSYGMRRVEVKSREAGSHLGHVFSDGPKEAGGLRYCINSAALKFIPYEQMEKEGYAQWLTLFDET

SEQ ID NO: 82132 - protein, 338 aa, Shewanella oneidensis MR-1
MNNSADITVLGAGSYGTALAISLASNGHKTLLWGHDPAHMQTLAEDKCNQAFLPGIAFPECLHIEADLAKALAASNNVLVVVPSHVFGTVLAQAKPLLRQDARIVWATKGLEPETGRLLQDVARDVLGEQYPLAVLSGPTFAKELAMGLPTAISVAGTCPQFTAELVELLHSPKRLRVYANDDFIGLQLGGAVKNVIAIGAGMSDGIGFGANARTALITRGLVELTRLGEALGASTATFMGMAGLGDLVLTCTDNQSRNRRFGLALGKGCDVDTAQVEIGQVVEGYRNTKEVFTLAKRLGVEMPITEQIYQVLYQGKSPVDAAKELLGREKKSETPTQ

SEQ ID NO: 82133 - protein, 187 aa, Dechloromonas aromatica RCB
MSLINTQVQPFKVQAFHNGKFIEVTEASLKGKWSVMIFMPAAFTFNCPTEIEDAANNYGEFQKAGAEVYIVTTDTHFSHKVWHETSPAVGKAQFPLIGDPTHQMTRAFDVHIDEEGLALRGTFVINPDGVIKTVEVHSNEIARDVSETLRKLKAAQYTASHPNEVCPAKWKEGEKTLAPSLDLVGKI

SEQ ID NO: 82134 - protein, 471 aa, Erythrobacter sp. NAP1
MADTDYDVIVLGSGPGGYVAAIRASQLGLKTAIVERELLGGICLNWGCIPTKAMLRSAEVYHQMHRASEYGLKVAGEIEADLAAIVKRSRGVAKQLNQGVTHLMKKNKITVHMGEGVLTGPTSLTVKGEKGEEKLTAKHVIVATGARARDLPFAPADGKRVWTYRHAMTPPEQPTKLLVIGSGAIGIEFASFYNDIGVDVTVVEMLDRIVPVEDEEVSTFLEKSLTKQGITVMTGAGVEDLKVTDKGVTATIKDKAGKTETTEFSHCITAIGIVPNTEDIGLDGLAEMDRGFIQIDDYGRTKSAGLWAIGDCTPGPWLAHKASHEGVTAAEAIAQELGNTDVHPHPLNRDAIPGCTYCHPQIASVGMTEAKAKEAGYEVKVGNFPFIGNGKAIALGEAEGFIKTVFDAKTGELLGAHMIGAEVTELIQGYTVGMTLETTEEELMQTVFPHPTLSEMMHESVLGAYGKALHI

SEQ ID NO: 82135 - protein, 764 aa, Xylella fastidiosa 9a5c
MSNDTFKQAAIDYHCTQPAGKIKVVATKPMLTQRDLSLAYSPGVAFACQAIVENPQQASELTARGNLVAVISNGTAVLGLGNIGPLAGKPVMEGKGVLFQKFAGIDVFDIEIDESDPDKLVDIIASLEPTFGGVNLEDIKAPECFIVERKLRERMSIPVFHDDQHGTAIIVGAAVLNAMVITGKKIGEVKLATTGMGAAGVSCVNMLVSLGLNPDNILAYDREGVIHTGRTDLDPEKQRYARDTDKRTLAEIVEGADIFLGLSAAGILTPEMVATMAPDPVIFALANPIPEIMPEAVCAVRTDAIIGTGRSDYPNQINNVLCFPYLFRGALDVGATTINEEMKIACVKAIAALARCEASDLGAAYGGETPSFGREYLIPRPLDPRLLVELSSAVAQAAMDSGVATRPITDMSAYHDKLSQFVYRTSLMMKPVYDRARADKQRVVYAEGEEEVILRAVQNVIDEGLAFPILIGRPDVIESRIQRMGLRMKAGVDFEVTNIHDDPRFNDYWQYYHGVTERRGVTVSAAKELMRSRPTLIASVMVARGEADALLTGAVGRFHKRLGYARSVIPLEPRVSSTAAMTGVINQHGAFFFVDTHVQEDPSAEQIAEATLQACYRLKLFGIEPSVALLSHSNFGSHDSRDALKMRQVRELLLKRSPRLNIDGEMQADTAWDEVLRERIMPNTTLKGRANLFVFPNLEAANIAYNLVRVFTDGVAIGPILMGISKAVHILTSSTTSRRVMNMTAIAAVDAQIRKQFEGGKRGG

SEQ ID NO: 82136 - protein, 200 aa, Brassica napus
  misc_feature (105)..(105): Xaa can be any naturally occurring amino acid
  misc_feature (180)..(180): Xaa can be any naturally occurring amino acid
MDDWEDEQIAPLPAKVVLKSNWDDEDVDENEIKDSWEDDDDDQPAPPPPVKPAPQKAPPKKAVEKKGKAAEAPKEEPLDPLSEKLRMQRLVEEADYRATAELFGXKGEDKSLDMFIPKSESDFLEYAEMISHRLTPYEKSYHYIALLRAVMRLSVTNMKAADVKDVASSVTAIANEKLKXAEKEAAAGRRKTGGKKKQLI

SEQ ID NO: 82137 - protein, 201 aa, Bacteroides fragilis YCH46
MEITNAEFVISNTDVKKCPAGTFPEYAFIGRSNVGKSSLINMLTGRKGLAMTSATPGKTMLINHFLINNSWYLVDLPGYGYARRGQKGQEQIRTIIEDYILEREQMTNLFVLIDSRLEPQKIDLEFMEWLGENGIPFAIIFTKADKLKGGRLKINISAYLRELRKQWEELPPYFITSSEERLGRTEVLNYIESINKELNSK

SEQ ID NO: 82138 - protein, 315 aa, Shigella dysenteriae
MPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVADRDCVLVDDMIDTGGTLCKAAEALKERGAKRVFAYATHPIFSGNAANNLRNSVIDEVVVCDTIPLSDEIKSLPNVRTLTLSGMLAEAIRRISNEESISAMFEH

SEQ ID NO: 82139 - protein, 315 aa, Shigella dysenteriae
MPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPMVVSPDIGGVVRARAIAKLLNDTDMAIIDKRRPRANVSQVMHIIGDVAGRDCVLVDDMIDTGGTLCKAAEALKERGAKRVFAYATHPIFSGNAANNLRNSVIDEVVVCDTIPLSDEIKSLPNVRTLTLSGMLAEAIRRISNEESISAMFEH

SEQ ID NO: 82140 - protein, 501 aa, Zea mays
TCTKKQAGTGPEFPGSGFRRPARVLLDPTQPSPERGVFCSVIINQCTMASLIPPCLSVPTAPGRARLAAPGAPRRRRMAVVRAKIREIFMPALSSTMMEGKIVSWTAAEGDRVGKGDPVVVVESDKADMDVETFHYGIVAVVLVPAGGTAPVGAPIALLAESEEEVALARARAQALSQGQSQAPSPPHAAAALGPPPPAPVAPPATKGIATPYAKKLAKQHRVDIAGVVGTGPHGRVTAADVEAAAGIKHKRPPPPPPPASVDAAPLVPASAVLPPVPGGTVVPFTTMQAAVSKNMVESLRVPTFRVSYSMITDKLDALYEKVKSKGVTKTVLLVKAAAVALTQHPVVNASCRDGKSFSYNNDVNIGVAVALEGGLLTPVLEDADKMDIYLLARKWRVLLKKARMKQLQPNEYNSGTFTLSNLGMFGVDKFDAILPAGQGAIMAVGASRPTVVADKDGFFSIKSEMLVNVTADHRIIYGADLAAFLQTFAKIVEDPECLTL

SEQ ID NO: 82141 - protein, 233 aa, Campylobacter lari RM2100
MQKQEKIVKMFDDIAPTYDKANRILSFGTDVSWRKKACLDVFKFSNNELDIIDVACGTGDMIIEWQNQALRANKNIISIKGIDPSAGMLEVAKKKIPEATFVQAKAQELPLENESADIISISYGIRNVVDRKEAIKEFARVLKKDGILLVLEFTKREQGGFIAACRDFYLKNILPKVGGFISKNYSAYEYLPNSIDDFLSKEEFIKELREHFEMLEYKSFSFGVCSMFIARKK

SEQ ID NO: 82142 - protein, 214 aa, unidentified eubacterium SCB49
MTFVGRKFPNLNVDAIDKTGANVKINILEKAQQENKKVILFWYPKDFTFVCPTELHAFQQAMDEFEKRNTLVIGASCDTPEVHFAWLNTPKNNGGIEGVTYPLIADSNRNLSNQLGILDITNERFDEESGSVLVDGDNVTYRATYLIDEEGTVFHESVNHMPLGRNVSEFLRLIDAYTHVQTNGEVCPANWKEGETAMNADRTGVAEYLTTQLN

SEQ ID NO: 82143 - protein, 490 aa, Zea mays
  misc_feature (204)..(204): Xaa can be any naturally occurring amino acid
MVLSHAASAGSSDESVHSTFASRYVRASLPRFRMPENSIPKEAAYQIINDELMLDGNPRLNLASFVTTWMEPECNKLMMDSINKNYVDMDEYPVTTELQNRCVNMIAHLFNAPLGETETAVGVGTVGSSEAIMLAGLAFKRRWQNKMKAAGKPCDKPNIVTGANVQVCWEKFARYFEVELKEVKLSEGYYVMDPEKAVEMVDEXNTICVAAILGSTLTGEFEDVRRLNDLLAANNRRTGWDTPIHVDAASGGFIAPFLYPDLEWDFRLPLVKSINVSGHKYGLVYAGVGWVVWRSKEDLPDELIFHINYLGADQPTFTLNFSKGSSQIIAQYYQLIRLGFEGYKDVMQNCRDNAAVLREGINKMGYFDVVSKDSGVPLVAFSLKDSSKYTVFEVAESLRRFGWIVPAYTMPADAEHVAVMRVVIREDFSRGLAERLIADLGKTMADMDAHAGRKQAPEQPKKSVHDIEKEVTTFWRRLVANSKKKSSMVC

SEQ ID NO: 82144 - protein, 298 aa, Marinobacter sp. ELB17
MSLNRETAVQVASVLSKGLPYIQRFTGKTVVIKYGGNAMENEDLKSSFARDVVLMKLVGINPIVVHGGGPQIGELLARLNIESRFVNGMRVTDAQTMDVVEMVLGGQVNKEIVSLINAEGGTAIGLTGKDANLIRARKLEVVDRSPELERPEIIDIGRVGEVVSVNVSVIDMLTRGNVIPVIAPIGVGPDGKSYNINADLVAGKVAEAMKAEKLILLTNVSGLKSKDGKVLTGLTASQVNDLIEDGTIHGGMLPKIRCALSAVENGVRTSHIIDGRVANACLLEIFTDEGVGTLISRN

SEQ ID NO: 82145 - protein, 184 aa, Zea mays
  misc_feature (40)..(40): Xaa can be any naturally occurring amino acid
NNPGLPCATTVACLHPLRCARFPRAVRNLTWPCRRWWSTXVVFPPVARPPGSAGSHFLGGAGVRGLEIGGNFIKFTAIGVYLEDAAVPALAKKWGGKTADELASDAAFFRDVVTGDFEKFTRVTMILPLTGEQYAEKVTENCVAFWKAVGLYTHSPAGVLTVAFSKDSFVPAAGGVAIENKRLC

SEQ ID NO: 82146 - protein, 466 aa, unidentified eubacterium SCB49
MSVYDVAVIGSGPGGYVAAIRCAQLGMKTAIIEKYNVLGGTCLNVGCIPSKALLDSSHRYEDAIKHFEDHGIEIPGEVKVNFKKMVERKASVVDQTTKGIDFLMSKNNIDVFTGVGSFVDATHIEIKGEETQTIEAKHTIIATGSKPSTLPFITLDKERVITSTEALKLPEVPKHLVVIGGGVIGLELGQVYRRLGAEVSVIEYMDRIIPTMDSAQSKELTKALKKQGVKFFLSHKVSDVTRKGDEVTITATDKKDKEVTFTGDYCLVSVGRKPNTEGLGADKAGIKITERGQVEVNDHLQTNISNIYAIGDVIKGAMLAHKAEEEGVFVAETLAGQKPHIDYNLIPGVVYTWPEVASVGKTEEQLKETKVAYKVGQFPMRALGRSRASGDIEGFVKILTDETTDEVLGVHMVGARVADLIAEAVVAMEFRASAEDISRMSHAHPTYAEAVKEAALAATGDRALHI

SEQ ID NO: 82147 - protein, 677 aa, Candida glabrata CBS 138
MERVRLDRKSSNDSNHSLGGESTSRSGGSGIGVAPTSGNNGTVKRASSMSSNYSNINASLHARVKAFQEQRGLHRSSSLGKGDSEENIGNVGTSINPSPSLGSMKDEPVPAIQKIVNKPLPPLPGQNSSSLTPSQETINMISNASQQAPDGPLNNISPVPGFKEAMGGNVRRNDGQNLYGSTSPAVTASAPNMPAFNPNRKAPRPPQIPHNTVIPAKPMQSLSSRRGLKLPPGGMKLKLPSKGDAPASMPSTVPAASSVKPVVHQEFAATPSNKNHIKNNNGSTEGKRSNPGSLVNAVQTTSISSANDQQDTEGTEPKSNSNGTGLFANFSRYVDIKSGSLNFAGKLSLSSRGIDFSNGSSSRITLDELQFIEELGHGNYGTVSKVLHKPNNVLMAMKEVRLELDESKFRQILMELEVLHKCNSPFIVDFYGAFFIEGAVYMCMEYMDGGSLDKIYDENPEMGGIDEPQLAFITNAVIQGLRELKEVHNVIHRDVKPTNILCSAKQGTVKLCDFGVSGNLVASLAKTNIGCQSYMAPERIKSLNPDRGTYTVQSDIWSLGLSILEMALGRYPYPPETFDNIFSQLSAIVDGPPPKLPADKFSDEAQDFVSLCLQKIPDRRPNYSNLYEHPWLAKYRSIDVQMGPYITKRLEIRKRILAEKGEDGLHRTVPALHKGGL

SEQ ID NO: 82148 - protein, 97 aa, Triticum aestivum
ALRHRAGMGLPVGRHIVPDKPLPVNDELVWDNGTPFPEPCIDRLAPHIGKYEALAWLCGGLGFFAALGMAAVVNDKASNIPYTPKVYPYDNLRAELG

SEQ ID NO: 82149 - protein, 458 aa, Shigella flexneri 2a str. 2457T
MKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGYGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFVAFKTLRRK

SEQ ID NO: 82150 - protein, 575 aa, Triticum aestivum
  misc_feature (426)..(426): Xaa can be any naturally occurring amino acid
  misc_feature (433)..(433): Xaa can be any naturally occurring amino acid
MASKAVAEIVDDKQCSKSAAESSEAAPSRRQSEELIGGASKSGPASPRAVPPGDVATSSGVKEQDKDCSSVDGSVKLDEDEDAEKSSLRGSVKDSSVSAKFSDGASSLTKASGSTKVSGHADLVQSGKSSVYRASAGSDVSDDSTCSSICSSASKPHKSNDSRWEAIQVIRTKEGSLGLSHFRLLKRLGCGDIGSVYLSELSGTKCYFAMKIMDKASLAGRKKLLRAQTEREILQCLDHPFLPTLYTHFETDKFSCLVMEFCPGGDLHTLRQKQPGKYFPEQAAKFYVAEVLLALEYLHMLGIIYRDLKPENVLVREDGHIMLSDFDLSLRCDVNPTLLKSSNPGVDPNQKGNQAYCVQPVCIEPACIQPACVTTTTCFSPRFFSSKSKREKKEKKAKADMATQVRPLPELVAEPTDARSMSFVGXTHEYLAXPEIIKGEGHGSAVDWWTFGIFLYELLFGKTPFKGSGNRATLFNVVGQPLRFPESPVVGFAARDLIRGLLIKEPQHRLAYKRGATEIKQHPFFEGVNWALIRCATPPDIPKPVDIPRPGASTSQKATPSAEKGPDNYLEFDFF

SEQ ID NO: 82151 - protein, 338 aa, Streptococcus pyogenes str. Manfredo
MKAVVVNQASTGVEVVEHDLPNIGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGAAPGQWIVIFGAGGLGNLAVQYAKKVFNAHVVAVDINNDKLELAKEVGADILVNGKEIEDVPGYIQEKTGGAHGVVVTAVSKVAFNQAIDSVRAGGTVVAVGLPSEYMELSIVKTVLDGIKVVGSLVGTRKDLEEAFAFGAEGLVVPVVEKVPVDTAPEVFDEMERGLIQGRKVLDFIS

SEQ ID NO: 82152 - protein, 428 aa, Arabidopsis thaliana
MATRTLGFVLPTSLSSQPSFDRRGGGFRVSVIRCSTSPLTFPTSGVVEKPWTSYNARLVLEDGSIWPAKSFGAPGTRIAELVFNTSLTGYQEILTDPSYAGQFVLMTNPQIGNTGVNPDDEESGQCFLTGLVIRNLSISTSNWRCTKTLADYLTERDIMGVYDLDTRAITRRLREDGSLIGVLSTEQSKTDDELLQMSRSWDIVGIDLISDVSCKSPYEWVDKTNAEWDFNTNSRDGKSYKVIAYDFGIKQNILRRLSSYGCQITVVPSTFPAAEALKMNPDGILFSNGPGDPSAVPYAVETVKELLGKVPVYGICMGHQLLGQALGGKTFKMKFGHHGGNHPVRNNRTGQVEISAQNHNYAVDPASLPGGVEVTHVNLNDGSCAGLSFPEMNVMSLQYHPEASPGPHDSDNAFREFIELMKRSKQSS

SEQ ID NO: 82153 - protein, 603 aa, Xylella fastidiosa 9a5c
MSLFPRCFLLLCVFFSHVSAEQREVGLLREGVARVPPGAVIASSHYLATDAGLEILRQGGNAFDAAVAVSSTLSVVEPISSGLGGGGFFLLHDAKTGHDVMLDAREYAPASVNLGTFLNKDGQLDHDRSINGPWSAGIPGLPAALVELAEHYGKLPLRQTLAPAIRIASAGFPVYRRMVEGYRARREVMERYPGTREVYLRGGKPMDEGDIFKQPELARTLSLLANKGFDGFYKGETAQRLLAGVNRAGGRWTAEDLAGYRVKSRVPITFDYRGWKITTAPPPSSGGIALAEMLQILEGWDLNRLDDVHRVHLVVEAMRRAYRDRTFFLGDPDFVSIPQRVLTSQDYARGLRAAINPEKAMPSVLLSGHPTPLEDEETTHFSIIDAEGNRVGATQTVNLLYGSGLIPKGTGVLLNNEMDDFALQPGVPNVFGVMGYEANAPKPEKRMLSSMTPTFLESADKVAVIGTPGGSRIITMVLLGILGYDAGLDAQQVAALPRYHHQWLPDVIETEAATFPAEVIKGLETMGHTIKQPSDTIAGGRGSSHVWGNVQTVEWDRRSNVLIGGHDPRHVVGKAAVWLTDKAVVLPPTDHLPTPCLQDCHAQ

SEQ ID NO: 82154 - protein, 538 aa, Pseudomonas aeruginosa UCBPP-PA14
MLDFSAHALPYASQRSPVHARRGMVATSQPQAAQVGLEILRRGGNAIDAAIATAAALTVVEPTGCGIGGDAFALVWTRGRLHGLDASGRAPGLLDRERVRAAGHERMPLYGWTPVTVPGCPAAWAELSRRFGKLPFEQLLRPAIELARDGFPVSPVIARLWQSGLDKFRAALPQRPELRAWFDEFLIDGRAPRAGEVFRQPGQADTLDELARSQCESFYRGELARTIVGHAERSGGYLRAEDLAGYQAKWVEPISLNYRGYDVWEIPPSGQGLIALMTLNILKGFEFGERDCARTWHRQLEAMKLAYVDGLHYISQPQSMRVSVEELLHVDYAASRRALIGERALDPSPGQPKPGGTVYLACGDEEGNLVSFIQSNYHGFGSGVVVPGTGIALQNRGAEFSLDPDHVNCLEPGKQTFHTIIPGFLSKDGVPLGPFGVMGAYMQPQGHVQMVMNLVDFGLNPQAALDAPRWQWLGGLRVGIEHAAPRALAAELAQRGHQVEIAYDSTSYGRGQIVLRDPASGVLCGGTEPRTDSQIAVW

SEQ ID NO: 82155 - protein, 184 aa, Parvularcula bermudensis HTCC2503
MTAALILPFEGKSPQIHETAFIAPGAVVIGDVTIGPGASVWYGCVLRADTNRIEIGARANVQDGSILHVDAPSQGGTPVLIGEEALVGHRCLLHGCTIEEGGFVGMGSTVLDKAVIEEGAFLAAGAFLAPGKRVPTGEMWGGLPARKLRDLKGLEGKAARMGAAHYVEEAKAHRAALSDAREDA

SEQ ID NO: 82156 - protein, 275 aa, Vitis vinifera
MASSERTIMAIKAYQNQAEQLVKDYLLADPFIPYTSILSGLFACKMVYDLTQLISTFYFKSYAGLTKIQRIEWNNRSMSTVHAFFIAALSLYFVFWSDLFSDHRLAGLVTFRSSPLSTFGLGVSVGYFLADIGMIFWLYPSLGGIEYIVHHSLSAIAVAYAMMSGEGQLYTYMVLISEVTTPEINMRWYLDTAGMKRSSAYLINGIVIFFGWLVARVLLFVYMFYHVYLHYDQVKQMHIFGFFLVFMVPAVLGIMNLMWFGKIIKGLKKTLTKRQ

SEQ ID NO: 82157 - protein, 379 aa, Methylobacterium extorquens
MPGRNHLFVPGPTNIPDRVMRAMMVQSEDHRSVDFPSLTKPLFEDTKKVFGSTEGTIFLFPASGTGIWESALSNTLARGDKVLAARFGQFSHLWIDMAQRLGLDVVVQEEEWGTGAKPEKIEEALRADKNHEIKAVMVVHNETATGVTSNIGAVRKAIDAAGHPALLFVDCAIAGSQKGLMLPAGLGVICVSQKALKAAEGQSGRNDRLARVYFDWEDQKKQNPTGYFPYTPPLPLLYGLREALACLFEEGLENVYHRHAVLGEATRQAVAAWGLKTCAKSPEWNSDTVTAILAPEGVDAAKIIKHAYVRYNLALGAGLSQVAGKVFRIGHVGDLNELSLLGAIAGAEMSLIDNGVKVTPGSGVAAASSYLRENPLAKA

SEQ ID NO: 82158 - protein, 288 aa, Marinobacter sp. ELB17
MSKRHPVIAVTGSSGAGTSTTGRIFRRMFDSEGLSAAMVGGDSFHRYTREQMARLAAKGQFGARNHFALGANHIDRLESLFYDYSLTGNGRYRQYVHDEDFALVADGNKPGSFTPWQDLPPNTSLLFYEGLHGGVVSDAFNIAQYVDLLIGVVPIVNLEWIQKIHRDTHKRGYSQEAVVETILNRMNDYVHDIVPQFSHTHINFQRVPLVDTSNPFVVRDVPTEDESMLVIHFRDAREVDFPYLLQVIPNSVLSRHDTLAIPGTKMSLAMELIVRPMVQRLIAQKAFA

SEQ ID NO: 82159 - protein, 476 aa, Yarrowia lipolytica CLIB122
RMDPCVYHAAILTTAGLNIVRMNFSHGSYEYHQSVIENARESEQQFQGRPLAIALDTKGPEIRTGVTKDDKDWDVKAGHVMLFSTNPKYKDQCDDKIMYIDYTNIVKQIDIGKIIFVDDGVLSFKVLEKIDGETLKVETLNNGKISSRKGVNLPGTDVDLPALSEKDKADLKFGVEHGVDMIFASFVRTANDVQAIRDVLGEKGKGIQVISKIENQQGVNNFDEILKETDGVMVARGDLGIEIPAPQVFIAQKQLIAKCNLAGKPVICATQMLDSMTYNPRPTRAEVSDVGNAVLDGADCVMLSGETAKGTYPIESVKMMHETCLVAEKAIAYAPLFNEMRTLTVRPTETVETIAISAVSASFEQQARAIIVLSTSGTSARLCSKYRPNCPILMVTRNAQAARFSHLYRGVYPFIYHKARASNPAEWQHDVEERLKWGMDEAVALGILNKGDVVVAIQGWTGGLGHTNTLRVLECV

SEQ ID NO: 82160 - protein, 426 aa, Synechococcus sp. WH 8102
MTTSSAVKYRDDMGVLSDRYRADFPILDQRAPDGHPLIYLDHAATSQKPRQVLQALEQYYAADNANVHRGAHQLSARATESFEAARTVTAEFVRAASPREIVFTRNASEAINLVARSWGEANLREGDEVLLTLMEHHSNLVPWQLLAQRTGCVLRHVGITEAGELDLEDFRSKLTDRTRLVSLVHISNALGCCNPLDQVIPAAHAAGALVLVDACQSLAHKPIDVAGLDVDFLVGSSHKLCGPTGMGFLWAREALLEAMPPFLGGGEMIQDVFLDHSTWAVLPHKFEAGTPAIGEAVGMGAAIRYLQAIGLEAIQAWEAQLTRHLFGRLQAIEGVRVLGPTPEQQSDRGALATFLVDGVHANDIAALMDASGICIRSGHHCCQPLHRHYGVTASARASLSFISTFEEIDRFSEELTSTIGFLREHG

SEQ ID NO: 82161 - protein, 430 aa, Zea mays
MQRDTSSSDVSASHVGRVRRRKHPTEATTDGNRANGQPLLVNDQNKYKSMLTRTYSTVWMIGGFAFIIYMGHLYIWAMVVVIQIYMARELFNLLRKSSEEKQLPGFRVLNWHFFFTAMLYTYGRFLSRQLVNTVTSDHLLYKVVSGLIKYQMFICYFLYIAGFVWFILTLKKKTYKYQFKQYAWTHMILLTVFAQSAFTVANIFEGIFWFLLPASLIVINDIFAYLFGFFLGRTPLIKLSPKKTWEGFIGASVTTIISAFLLANVMGHSQWLTCPRKDLLTGWLYCDPGPMFKPEHYSLGEWVPHWFPWKELAIMPVQWHALALGLFASIIAPFGGFFASGFKRAFKIKDFGDSIPGHGGITDRMDCQMVMAVFAYIYHQSFIAPQNFSVEIILDQIIRNLTYEEQKYVYEQLGEMFRERQLAHWLKAES

SEQ ID NO: 82162 - protein, 335 aa, Campylobacter lari RM2100
MIRLILDTDIGNGIAGANTDDGLALGLILASKEIKLEMISTLSGNVQALTAYSVAKDLLSKLNLDIPLYLGAHEALYEDSKFWRQRLDDSAKKFNLSHLWDEIEPIKILENITPNACIKMGELIMQNPGEISICAIGPLTNIAIAMKLFKDFDKNVKEIFIMGGSFDMPYHIKDTNFGFDPEAASIVLNSRAKITLVPYNATMQTMLTHEDLNALENQNPLCDFLVQTLRVWINYASKTRGTNGTWIHDALTIAYMLDPNLASFDEYLVDVICDSTFARGSTIRCFKDAKMPMKNHELKNTIKVLKDIDNARLLNLLKSRLLNGICHENYKNITA

SEQ ID NO: 82163 - protein, 401 aa, Pantoea agglomerans
MKNVYLDNNATTRIDPMVLEAMMPYLRDYYGNPSSIHDFGGPCRAGLECAREQVASLLGAAYTSEIIFTSCATEATSTAIYSAIALAPERREIITTAVEHPATLAVCEHLERQGYMIHRIGVSEEGALDTAHYYDALSENVALVTMMWANNETGVLFPVSEMATAAHERGILFHCDAVQAVGKIPISLRATDIDMLSCSAHKIHGPKGCGCLYLRRNTRFRPLVRGGHQERGRRAGTENIAGIVGMGAACELADVHMPMMASVQEMRDRLETGLLTTIPHTLLMGANQPRTPNTVNIAFEYIEGEAILLLLNHCGIAASSGSACTSGSLEPSHVMRAMNIPYTAAHGSIRFSLSRFTREREIEWAIEQMPDIVARLRTLSPYWQQDKVQIAQGGLFAPTYG

SEQ ID NO: 82164 - protein, 262 aa, Enterococcus faecalis V583
MSYPYYIVDAFAEEVFKGNPAAVYVLEKWLPEAVMQNIAIENNLSETAFTVKEGQSYALRWFTPEREIDLCGHATLATAFVLFNYYSVAEETLHFTSQSGPLAVTKKEEYYYLDFPYILPERIPILPEYEAALGTKIYEAYLGRDLFFVLKDEETVAKITPDFSALKALDLGVGVIVTASGDSVDFVSRTFFPKLRINEDPVCGSAHANLIPYWGKRLNQTTLSAYQVSPRGGFLTCEVKENRVIIGGTAKLFAKGEAYLPV

SEQ ID NO: 82165 - protein, 325 aa, Triticum aestivum
MGEASSPAIAKDVTELIGNTPLVYLNKVTDGCVGRVAAKLESMEPCSSVKDRIGYSMITDAEEKGFIVPGKSVLIEPTSGNTGIGLAFMAAAKGYRLVLTMPASMSMERRIILKAFGAELILTDPLLGMKGAVQKAEELAAKTPNSYILQQFENAANPKIHYETTGPEIWKGTGGKIDGLVSGIGTGGTITGTGKYLQEQNPNIKLYGVEPTESAILNGGKPGPHKIQGIGAGFIPGVLDVDIIDETIQVSSDESIEMAKSLALKEGLLVGISSGAAAAAAIKVAQRPENAGKLFVVVFPSFGERYLSSVLFHSIKKEAESMVVE

SEQ ID NO: 82166 - protein, 356 aa, Aspergillus nidulans FGSC A4
MAADVGALFNAGPEVVKGATFEEGLGFQDLGGPMIHCTNGTIDNMAANEAECFEQLRTVLSYLPNCGRYNAPPVIPCDDQEIREDESLRRIIPRKQTRMYNPWTIIRSVVDNGSFFEIGALWGRTAITGLARLGGRPVGIISLNCEVNSGALDAAGSQKLARLLKLCDVMNLPVLQFVDVPGYAIGTVAERTATMRWGIELAKAYFSTTTPIFSVITRRAYGVAGGVMLGARDPHVQVAWPSGQWGSLPLDGGIEVGHRHELREAEKQGRKKELYAELEEEYRRLMNPVRTANAFGVEEIIDPKDTRKVVCGWARHVYDVLMPIILSFALGQISLHILSLVLSAETLHNVHDLGID

SEQ ID NO: 82167 - protein, 2211 aa, Candida glabrata CBS 138
MTTPVAPITPPMETTGDRLVTLELKDGTTLQGYSFGAEKPVAGELVFQTGMVGYPESITDPSYEGQILVITYPLVGNYGVPDFNLRDEFIESLPRYFESNRIHVAGLVISHYTEDYSHYLAESSLGQWLKREGVPAVYGIDTRALTKHLRNCGSMLGRLALQEASAKLEVATSESWKSVFDVPEWVNPNVENLVAKVSLKEPKLFTPPSDNKYVEVKKGADGKTIRILAIDVGMKYNQIRCFVKRGVELLVVPWDYDFTKEDYDGLFISNGPGDPSVLNDLANRLSKALEKKKTPIFGICLGHQLLARASGASTLKLKFGNRGHNIPCTSTISGRCYITSQNHGYAVDVDTLTPGWKPLFVNANDDSNEGIYHTELPYFSVQFHPESTPGPRDTEFLFDVFINAVLEHKNSGVLKPVEFPGGKIENNRKENPRVEAKKVLVLGSGGLSIGQAGEFDYSGSQAIKALKEEGIYTILINPNIATIQTSKGLADKVYFLPVTAEFVRKVILHERPDAIYVTFGGQTALSVGIEMKDEFESLGVKVLGTPIDTIITTEDRELFANAIDEIDEKCAKSQAANSVEEALAAVKDIGFPVIVRAAYALGGLGSGFANNEQELIDLCNVAFASSPQVLVERSMKGWKEVEYEVVRDAFDNCITVCNMENFDPLGIHTGDSIVVAPSQTLSDEDYNMLRTTAVNVIRHLGVVGECNIQYALNPFSKEYCIIEVNARLSRSSALASKATGYPLAYTAAKLGLNIPLNEVKNSVTKSTCACFEPSLDYCVVKMPRWDLKKFTRVSTELSSSMKSVGEVMSIGRTFEEAIQKAIRSTEYSNLGFNATDLEIDIDYELQNPSDLRIFAIANAFDKLGYSVEKVWEMTNIDKWFLNKLYDLVKFASKVSSCGGIEGLSPTVLRQAKQLGFDDRQIASFTSSNEVAIRRLRKDYGIIPFVKQIDTVAAEFPAYTNYLYMTYNAAEHDVEFNDHGVMVLGSGVYRIGSSVEFDWCAVTAVRTLRANNIKTIMINYNPETVSTDYDEADRLYFETINLERVLDIYEAEASNGVVVSMGGQTSNNIAMSLHRENVKILGTSPDMIDSAENRYKFSRMLDQIGVDQPAWKELTSMDEAEDFAEKVGYPVLVRPSYVLSGAAMNTVYSKNDLESYLNQAVEVSRDYPVVITKYIENAKEIEMDAVARNGELVMHVVSEHVENAGVHSGDATLIVPPQDLAPETVDRIVVATAKIGKALKITGPYNIQFIAKDNEIKVIECNVRASRSFPFISKVVGVNLIELATKAIMGLPFAPYPVEKLPDDYVAVKVPQFSFPRLAGADPVLGVEMASTGEVATFGHSKHEAYLKSLLATGFKLPKKNILLSVGSYKEKIELLPSVQKLYNMGYKLFATAGTADFLTEHGLSVQYLEVLNEDEPEKKEYSLTQHLANNEIDLYINLPSANRFRRPASYVSKGYRTRRMAVDYSVPLVTNVKCAKLLVEALAQNISLNVSERDAQTSHRTVTIPGLINITTYVPNITNVVEGPAELKETTRLFLESGFSYCQIMPRASRGPVINDAASIKVATSVSNNSCHTDFAFTIAGTAHNAQQIAQSADKANALYLPLHELKNKVSTISELLSNWPSNKQVITEAKTSDLASVLLLASLQNRSIHITGVSKKEDLSLIMTVKEKDPKVTCDINVYSLFVTQEQWPEAMFLPTEEDQEFFWKNLSAIDAFSIGSVPTQLAEITGNKVEVGLGIKDALPLLLSAVEEGKLTVDDIVEKLHDNPAKIFNIPTQNSLVELDLDFSFASKKRWTPHSNTSLRGGIERVVVNDETLVLSGELVATEPKGTLKMKSELVQASVENAPAIQSTGRRMTIHDDKLMDVDSAENSIPDAPIQQKLMSSKPPRELTAPSALQNLIRGNNPFQGRHILSIKQFSRADFHALFAVAQELRAAVAREGVLDLMKGHIITTIFYEPSTRTCSSFIAAMERLGGRVVNINPNVSSVKKGETLQDTIRTLACYTDAIVMRHSEEMSVHIAAKYSPVPIINGGNGSREHPTQAFLDLFTIREEIGTVNGITVTFMGDLKHGRTVHSLCRLLMHYQIRINLVSPPELRLPESLREELNSKGQLGVESVALTPEIISKSDVLYCTRVQEERFKSTEEYERLKDFYIVDNKILSHAKQNMAVMHPLPRVNEIKEEVDYDHRAAYFREMKYGLYVRMALLAMVLGVNN

SEQ ID NO: 82168 - protein, 152 aa, Yarrowia lipolytica CLIB122
MSNTEQTFIAIKPDGVQRGLISPILHRFEQRGFKLVAIKLTNPDEKLLREHYEDLQEKPFFPSLLKYMQSGPVLATVWEGKDVVKQGRNILGATNPLQSAPGTIRFDYAIDIGRNVCHGSDSVESAKKEIGIWFKPEELASYTPANIGWIYE

SEQ ID NO: 82169 - protein, 332 aa, unidentified eubacterium SCB49
MKTKIAINGFGRIGRIAFRIAAQSDKVEVVAVNDLLEVDHLAYLLEYDSVHGRYQGDVSVKDGNIIVDGKVIRVTNERNPENLKWDEVQAEIVLDCTGIFTETTNADAHIKAGAKKVVISAPSKTAPMFVMGVNHLEVKATDTIVSNASCTTNCLAPMAKIINDNLGIEEGLMTTIHALTATQSTVDMPSRKNYRLGRSGVANIIPSTTGAAVAVTKVIPSLVGKLTGMAFRVPTVDVSVVDLTVRTKKPATAQEVKQLFKDAANGEYKGIVGYTEEPVVSMDYRSNPHTCNFDAEAGIALNDNFFKLVAWYDNEYGYSAKLIDLTAHVASL

SEQ ID NO: 82170 - protein, 501 aa, unidentified eubacterium SCB49
MPIPKINPTTTNAWQKLEAHFEAIYDVHIQELFASEKGRRKSMSFVWEDVSLDYSKNRISAETFQLLLQLAEECKLKEAIDAQYNGETINETEGRAVLHTALRDFKNLKPEVEAALEKMRDFSEKIISGDWKGHTGKAITDIVNIGVGGSSLGPAMTTEALSFYKNHLNIHYVSNVDGDHVMETLKKLDPETTLFIVVSKSFTTQETLTNANTIRKWFVKNISETAIANHFVAVSANNTEAQKFGISEDNIFPMWDWVGGRFSLWSAVGLSTCCSVGYEHFEALLKGAHAMDEHFKDTSFDKNMPVIMAMLSVWYNNFFQTETEMVLPYSQYLSKLVNHLQQAVMESNGKSIDRNGAPVEYQTGTVIWGSTGVNAQHAFMQLLHQGTKLIPTDFICFETSLYEVEEHQEKLLANCYAQADALAKGTFGKQVENNFKRFEGNSPSNMLKIEKLTPNSLGKLIALYEHKLFVQGVIWNIYSYDQWGVELGKKMANDILSKSRI

SEQ ID NO: 82171 - protein, 180 aa, Triticum aestivum
  misc_feature (12)..(13): Xaa can be any naturally occurring amino acid
  misc_feature (18)..(18): Xaa can be any naturally occurring amino acid
  misc_feature (31)..(31): Xaa can be any naturally occurring amino acid
TENAKQKSNEDXXENNPXYRTVYVGNLPHEXVTQDVLHRFFHALGAGAIEEVRVQHGKGFGFVKYSNHAETALAIQTGNGRILGGKPVKCSWGNKPTPPGTTSAPLPPPAAPGHPAAADLMAYQRAIAMSKMASTQALMQAQHLRQAAMGMGVGASQAMYDGTFQNVGASQQQQQQLMYY

SEQ ID NO: 82172 - protein, 387 aa, Bradyrhizobium sp. BTAi1
MISQNKVFADLPVTIFEQMSQLARDNNAINLGQGFPDDPGPEDIRRAAADAVLNGYNQYPSMMGLPELRQAIAAHYKHWHKLDLDPMSEVMVTSGGTEALTSAILSVVEPGDEVICFQPVYDSYLPIIRQAGGIPRLVRLEPPHWRLSEEMLRQAFSPKTKAVLFNNPLNPAAVVYPREDLELLARFCQEFDAVAICDEVWEHVVFDGREHIPLITIPGMRDRTIKVGSAGKIFSLTGWKIGFVCAAPQLLRVAAKVHQFLTFTTAPNLQMAVAYGLGKSDDYFLDMRAELARSRDRLTAGLERLGFPVLKAQGTYFLTVDLSPLGLNETDEQFCRRIVHDYKVAAIPVSAFYEKDAVTSVVRFCFAKKDATLDTALERLSDAIHRR

SEQ ID NO: 82173 - protein, 484 aa, Candida maltosa
MYKTVLKNSGRIQRNFIFRNVSSTLQRSLATSASTSSSTTTSNAETGELHVSTPLDSPSVHPPDGSSISLKSATRDASLFGTRPIYLDVQATTPVDPRVLDKMLEFYTGLYGNPHSSTHAYGWETDKEVEKARGYIADVINADPKEIIFTSGATETNNMAIKGVPRFYKKTKKHIITTQTEHKCVLDSARHMQDEGFDITYLPVNSEGLINLDDLKKAIRKDTVLVSVMAVNNEIGVIQPLKEIGQICRENKIFFHTDAAQAYGKIPIDVNEMNIDLLSISSHKIYGPKGIGACYVRRRPRVRLDPIITGGGQERGLRSGTLAPPLVAGFGEAARLMKQESAFDKKHIEKLSTKLKNGLLSIPSTQFNGCNNPTYQYPGCVNVSFAYIEGESLLMALKDIALSSGSACTSASLEPSYVLHALGADDALAHSSIRFGIGRFTTEAEVDYVIQAINERVDFLRKMSPLWEMVQGGIDLNSIEWSGH

SEQ ID NO: 82174 - protein, 292 aa, Shewanella sp. MR-7
MSDFPTIEACIGQTPLVRLQRLDCGSSTVLLKLEGNNPAGSVKDRAALNMIFQAELRQEIAPGDTLIEATSGNTGIALAMAAAIKGYKMILIMPSNSTQERKDAMQAYGAELLLVDNMEAARDLALDLQAQGKGKVLDQFNNQDNANAHFQTTGPEIWQQSQGKITHFVSSMGTTGTIMGVSKYLKSRNPDVTIVGLQPADGSSIPGIRRWPQEYLPGIFDAARVDAVMDIEEQDAKAMARTLAREEGICAGVSSGGAVFAALEIARQNPGSVVVAIVCDRGDRYLSSGLFS

SEQ ID NO: 82175 - protein, 631 aa, Kluyveromyces lactis NRRL Y-1140
MKVSTHHFLPSLLVALWSWATVAQAATHTFNWTTGWGNYNVDGNFERPVITCNGEFPWPDLKVKRGDRIQVYLTNGFDDRNTSLHFHGLSQNGTNMMDGPEMITQCPIAPGDTMLYNFTIDDNDGTYWYHSHTGGQYQDGMKGTLVVEPEDSLPFDYDEEVVVQLAEWYYDNVDTLDRKFMNVYNPTGAEPIPQNLIINNTRNMTWNVEPDTTYLLRIVNTGGFVSQYFWIEDHDMTVVEVDGVYVEKNTTSMLYITVAQRYSVLIHTKNDTSKNYAIMQKFDDTMLDVIPNDLMLNATSYMMYDKDGEKPEQSYVDSIDDFLDDFYLTPLDKVELYEDPDYTITVDVVMDNLKNGVNYAFFNNLTFTAPKVPTLMTALSAGKDALNPLVYGTNTNAFVLKKDEIIEIVLNNNDTGKHPFHLHGHIFQLVDRERGYDDAIGEGPHPFDPEDHNPFPDYPMMRDTVYVNPQSSIVLRFKADNPGVWFFHCHIEWHLKQGLALLLIEAPEEMQNTESQQLTDNHKQVCENVGLSWEGNAAGNTNDFLDLVGQNVQVANIPDGFTAKGIVAMTFSCLAGVLGLISLSTYGLMGVKKSEEEIIRDLGMDPDAVEKVDVSDINSDEDSSRTSKNIE

SEQ ID NO: 82176 - protein, 303 aa, Zea mays
  misc_feature (54)..(54): Xaa can be any naturally occurring amino acid
MEDLSVEELASNLSTYKEQLREVKKLIKEKKDDAGISEYIDMEKELQEEPCPAXVITLTEEILATAKQTESAQNVAGLSPPSYSAGVQSEGLDDLSHSHKFAVGTRVQAVWSEDGEWYNATVEALTPNGYYVAYDGWGNSEEVDPDNVRLLEEEAADALGQAEKEAEATKMAIKRKIEQAATSDFQARSLPAKLRIEPSDPEDVKAAKRKKIHAFKSKSRFEQLEFAQNKRQNAWQQFQTKGKAKKVGFFSGRKKESIFKSPDDHRGKVGVTGSGKGLTDFQRREKHLHLKGGSGDAADDDEE

SEQ ID NO: 82177 - protein, 490 aa, Vitis vinifera
MPRTRASAAAAAQNPNVSENPIECEKPAEPEERVDLDGDNEDTKEEEVESEEVEEEVEEIEEEEEEEVEEEVEEDEEEEDTYFADAQKDPDGDDEIKSAKGEVDNENRRHAELLALPPHGSEVYLGGIPNNASEEDLRGFCEPVGEVTEVRILKGKDSAETKGYAFVTFRTKELASKAMEELNNAEIKGRKIKCSASQVKHRLFISNVPRTWEEEDMKKVVTEIGPGVNLVDLWKDPQNSSRNRGFAFIEYYNHACAEYSRKKMSNPKFKLDNNASTVSWADPKNVESSAASQVKAVYIKNLPKYMTQDQLRELFGQHGKITKVVIPPAKAGQENCRFGFVHFAERSSAMKALKNTEKYEIDGHILGCSLAKPQADKKFSGGSNSQKSALLPSYPPWVGYGLLGGAPGAGYGAAGFGQPLTYGRGLTSAGTAMMPMLLPDGRIGYVLQQPGMQPYTPPSQPRSDRSGGGSTSGGRHSGDRGYGRRWYNPY

SEQ ID NO: 82178 - protein, 123 aa, Arabidopsis thaliana
MGFVLICTCPPSSGVVVSQLHHHQFSAGVKSNELWFRPTRRTLISKSSCFNLPQEPILSESLKEPIAFLGGMFAGLLRLDLNEEPLKDWVTRTVEASGITEEEVDADGVVSNDEDSPQQIEIE

SEQ ID NO: 82179 - protein, 253 aa, Vitis vinifera
MASELEEVPFSYAGQMGPANWGKLHPQFQECVVGKSQSPVDIITNKTELNPNLKPLSRNYRPGKSTLVNNGFNVGVRFDEDVGVLLVDGKNYSLKQMHWHSPSEHRIDGLQYPAELHLVHRTDDGNIAVVGILYQYGDADPLLSKLKNKLDELAKDVCASNEQSQVSLGTMDTKLIRRNTRRYYRYMGSLTTPPCSEKVAWHILGKIRDISKDQVAALKAPLNSDCKDNSRPLQPLNGRRIQLYDETPDGSDF

SEQ ID NO: 82180 - protein, 119 aa, Streptococcus pyogenes MGAS10394
MDKIVLESCRFYGYHGAFKEEQTLGQIFLVDLELSVDLQAASLSDQLTDTVHYGMVFDSVRQLVEGGKFILIERLAGAICEQLFNEFPPIEAIKVAIKKENPPIAGHYKAVGIELERQR

SEQ ID NO: 82181 - protein, 307 aa, Sulfolobus solfataricus P2
MFRGKSLLCLLDFQTHEIEKMLEVSFLMKSYVYYNKVPNSLSGKRVALLFEKPSTRTRVSTELAVSLLGGIPIVLNKQDLQWSRGELIEDTGRVLGRVVNGIGARVLNHLTLVKLKESSGVPVFNLLSDLSHPLQALADLMTIRERFGNNLVKIAFVGDGSDNVLLSLMAIVAKLGLELHVATPKELKPRDDLYKIISEIAEDTGSVIEFHEDPYEAVRGVHVVYTDVWVSMGQENIAEQKKRMLQNYRVTADLMKYAVKDAIFMHCLPANRGEEVDPEVIDGSKSAVWDQAENRLYTTMAVFSLFI

SEQ ID NO: 82182 - protein, 172 aa, Triticum aestivum
MGDRERRVVFVTVGTTCFDALVKVVDSEELKQALLQKGYTDLLIQMGRGTYKPSKASGNSSLQVEHFTFSPSIADNIREASLVISHAGSGSIFETLRLGKPLIVVVNEDLMDNHQSELAEELAERNHLFCAHPHTLRETVEAMDLKTLQPYVPGEAKPVVALINRFLGFPVD

SEQ ID NO: 82183 - protein, 306 aa, Vitis vinifera
MEPQPLQAQVILELLQNATRKFQYLYLLIRFTYVKPLRLSVRCAVRFRPCIDIHKGKVKQIVGSTLRDTKEGGSTLVTNFESDKSAAEFAKLYKEDGLTGGHVIMLGADPLSTSAATEALHAYPGGLQVGGGINSENALRYIEEGASHVIVTSYVFNNGQMDLERLKDLVHLVGKQRLVLDLSCRKKEGKYAIVTDRWQKFSDVCLDQEILDFLASYSDEFLVHGVDVEGKKLGIDEELVALLGKYSPIPVTYAGGVTVMADLERIKVAGSGRVDVTVGSALDIFGGNLAYRDVVNWHAQQEALTV

SEQ ID NO: 82184 - protein, 446 aa, Sulfolobus solfataricus P2
MALIVKIGGSIQKDEKDYELIVKKIQDFSKKSDKIIVVTSAIKNVTNELISATSNTDNSPNIVTEIYERHIKLLSKLADGKEFENSFKDISRLSDELFRVAWSIRVLDEVTPRVRDYILSFGERMATLLLSAILRSNGIEAEGIITPPFLTDENYGEANVIEDLSKNEIANILENAKANVIVLPGFIGRTREGRYTTLGRGGSDYTATLLGKLVGVREVRLVTEVPGIMTGDPKKFENAKTISRLSLEEAIELSQLGAKRLHPRTFDPVFGSDMKVIVESLYEDGFTIINGECQNNDGLKGISLLDNAKLITVESTKIVGKIGSAARITNEAKEAGVNIISISQPASETTIQLVVDSLSANRLLSKLEEIRGTLVKDIEVNDINIVGIVGCGIKKKEISTKVLSIASSYDPLAISRGISNVSMTFIVNKDEGEKLAKELHKVIVSG

SEQ ID NO: 82185 - protein, 453 aa, Schizosaccharomyces pombe
MLRLQNLPKLVRRFATTALPKTETTTLKNGLTVATEHHPYAQTATVLVGVDAGSRAETAKNNGAAHFLEHLAFKGTKNRSQKALELEFGNTGAHLNAYTSREQTVYYAHAPQNAVPHAVAVLADILTNSSISASAVERERQVILREQEEVDKMADEVVFDHLHATAYQGHPLGRTILGPKENIESLTREDLLQYIKDNYRSDRMIISSAGSISHEELVKLAEKYFGHLEPSAEQLSLGAPRGLKPRFVGSEIRARDDDSPTANIAIAVEGMSWKHPDYFTALVMQAIIGNWDRAMGASPHLSSRLSTIVQQHQLANSFMSFSTSYSDTGLWGIYLVTENLGRIDDLVHFTLQNWARLTVATRAEVERAKAQLRASLLLSLDSTTAIAEDIGRQLLTTGRRMSPQEVDLRIGQITEKDVARVASEMIWDKDIAVSAVGSIEGLLDYTVFVAVFL

SEQ ID NO: 82186 - protein, 386 aa, Erythrobacter sp. NAP1
MDQATTLPPFAAIVVAAGKGLRVGGDTPKQYRNWRGKPLIRHSVETLRAAGADPLLVVIATGAEDDAEDALKGLTGFRFEEGGASRQDSVRAGLEALAEEPPAKVLIHDAARPDLPLEVIQRLLAALDEHQGAIPTLPVVDSLAVASDASTMAGKADRETLRRVQTPQAFRFEDILAAHREWNSQTDAGDDAQVLAAMQGSVALVQGDERLKKITFAEDLMDTAGIAPFRIGQGYDVHRLAEGEELWLCGVKLEHTHGLAGHSDADVALHAITDAVLGAIGNGDIGTHFPPSDDQWAGARSGQFLEHAVKLAEEAGYALGNIDLTLICEAPKIGPHRPAMRAEVARITGLGEDAVSIKATTTEKLGFTGRGEGIAAQAIVALHAAN

SEQ ID NO: 82187 - protein, 396 aa, Sulfolobus solfataricus P2
MKCLNCGYETEIDQSQILCPRCGGLLEIILEPPKDFSFSKLRGRGVWRYKELIAGRYKNIVSINEGNTPLIRSSNINDNLYFKFEGLNPTGSFKDRGMTVAVSSAVSLNYKTVIAASTGNTAASAAAYAARAGIKSFIVLPKGKVALGKLAQSILYGSVILEVDGSFDVAMDAVMRLYKDLKVVYPLNSFNPWRLEGQKTIAFEIAEELGVPDNVIVPVGNAGNIYAIWKGFNELVKTGVINTIPRMIGIQAEGASPIVTAIIKGKDSPDFIENPDTVATAIRIGKPVNWQKAMKAIRESNGTAIAVSDSEILDAQKTLARKEGIGAEPASAAALAGYIKAINEKVVDKDEKTVLILTGHSLKDPDSMTKAEAKRILVNPLHMEKIILGEINGSNS

SEQ ID NO: 82188 - protein, 81 aa, Glycine max
MKFNIASPTTGCQKKLEIDDDQKLRAFWDKKISQESAEMHLVRKFRVMASNSLKFGTTRFPDEPERLTPGRVRFLLSGGTP

SEQ ID NO: 82189 - protein, 447 aa, Schizosaccharomyces pombe
MSTPYEPEFQQAYKEIVGSIESSKLFEVHPELKRVLPIISIPERVLEFRVTWEDDKGNCRVNTGYRVQFNSALGPYKGGLRFHPSVNLSILKFLGFEQIFKNALTGLPMGGGKGGSDFDPKGKSDNEIRRFSQAFMRQLFRYIGPQTDVPAGDIGVTGFVVMHMFGEYKRLRNEYSGVVTGKHMLTGGSNIRPEATGYGVVYYVKHMIEHRTKGAETLKGKRVAISGSGNVAQYAALKCIQEGAIVKSISDSKGVLIAKTAEGLVPEEIHEIMALKEKRASIADSASLCKKHHYIAGARPWTNVGEIDIALPCATQNEVSGEEAAALIKQGCRYVAEGSNMGSSAEAVEVFEKSRASGEGCWLAPGKAANAGGVAVSGLEMAQNAQFSTWTHAEVDAKLAGIMQNIFEQSTDVASKYCDSGSNNIPSLVDGANIAGFLKVATAMQAV

SEQ ID NO: 82190 - protein, 46 aa, Gossypium arboreum
TNLCLRACMTCCDRCKCVPPGTYGNREMCGKCYTDMRTHRNKHKCP

SEQ ID NO: 82191 - protein, 748 aa, Shigella flexneri 2a str. 301
MLTRLREIVEKVASAPRLNEALNILVTDICLAMDTEVCSVYLADHDRRCYYLMATRGLKKPRGRTVTLAFDEGIVGLVGRLAEPINLADAQKHPSFKYIPSVKEERFRAFLGVPIIQRRQLLGVLVVQQRELRQYDESEESFLVTLATQMAAILSQSQLTALFGQYRQTRIRALPAAPGVAIAEGWQDATLPLMEQVYQASTLDPALERERLTGALEEAANEFRRYSKRFAAGAQKETAAIFDLYSHLLSDTRLRRELFAEVDKGSVAEWAVKTVIEKFAEQFAALSDNYLKERAGDLRALGQRLLFHLDDANQGPNAWPERFILVADELSATTLAELPQDRLVGVVVRDGAANSHAAIMVRALGIPTVMGADIQPSVLHRRTLIVDGYRGELLVDPEPVLLQEYQRLISEEIELSRLAEDDVNLPAQLKSGERIKVMLNAGLSPEHEEKLGSCIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLNILLPMVTSLDEVDEARRLIERAGREVEEMIGYEIPKPRIGIMLEVPSMVFMLPHLAKRVDFISVGTNDLTQYILAVDRNNTRVANIYDSLHPAMLRALAMIAREAEIHGIDLRLCGEMAGDPMCVAILIGLGYRHLSMNGRSVARVKYLLRRIDFAEAENLAQRSLEAQLATEVRHQVAAFMERRGMGGLIRGGL

SEQ ID NO: 82192 - protein, 430 aa, Schizosaccharomyces pombe
NTSSTEQIEVLENEYAAHNYHPLPVCFSKAKGAKVWDPEGREYLDFLAAYSAVNQGHCHPKIIEALVEQAQRVTLSSRAFYNDKFGPFAKYITEYFDYEMVIPMNTGAETVETACKLARLWGNKAKKIPTDEAIILSCVDNFHGRTMGIISMSTDPDARDNYGPYLPNVGPKISGADRVLRYNNIEDLKYYLDTFGPKVAAFLVEPIQGEAGVMVPDDGYLEEAYKLCKAHNVLFIADEVQTGVARTGKMLCIEHSNVKPDVVILGKAISGGVYPVSAVLSSREIMLNFEPGTHGSTYGGNPLGAAVSIAALEVVKEEKLTERAAVLGEKFRTALIECKSPIVQKVRGRGLLNAVVIDESKTNGRTAWDLCLIMRSRGVLAKPTHGNIIRFSPPLVITEEDLMKGIEVIKKSLNDLPTIDMTPYAEKPIH

SEQ ID NO: 82193 - protein, 312 aa, Triticum aestivum
MADRSKKPYVVAVAIQAIYTGLFVVSKAAFDSGINTYVFIFYRLAAATALLLPIALIDSTCRRSRSTTATPAPALSCRLLFKLFLYALLGNTFTLNMYNVSLKQTSATVGSAATNSMPVATFLLAVLLRMEAVKLRSRSGLGKLAGVALCLAGVLVIAFYAGPSIRPLAHNPVFAHKPKSVSSGAEWIKGTFLLILACATWSLWIVLQVPLLKEYPNKLMATALQCMFGALQSFVVAVVVERDFTKWKLGLDIGLLAVLYSAFLGTGALMYLQAWCAEMRGPVFVAMWSPLALIFTIFCSSFFLGEAVHLGR

SEQ ID NO: 82194 - protein, 271 aa, Kalanchoe daigremontiana
  misc_feature (257)..(257): Xaa can be any naturally occurring amino acid
GRIGRLVARVALQRDDIELVAVNDPFINTDYMTYMFKYDSTHGQWKHHEVKVKDANTLLFGDKPVAVFGLRNPEEIPWGEVGAEYVVESTGVFTDKDKAAAHLKGGAKKVVISAPSGNAPMFVVGVNEKEYTSDIDIVSNASCTTNCLAPLAKVINDRFGIVEGLMTTVHAMTATQKTVDGPSMKDWRGGRAASFNIIPSSTGAAKAVGKVLPALNGKLTGMAFRVPTVDVSVVDLTVRIEKKASYDQVKAAIKEEXEGPLKGILGYTEDD

SEQ ID NO: 82195 - protein, 266 aa, Acidobacteria bacterium Ellin345
MRTITTFALALIAVASFAQDKPAATPAKVPPLNVRVKPAAAPAIPAVADKDITPELAHTTLGTPEQPVAVIETTKGTFRCVLFKMEAPLTVENFIGLARGTKDWTDPGTGFKKHNVPLYTGTQFHRVIPNFMVQGGDPMGTGMGDPGYKFKDEFNSDLNFDRPARLAMANSGANTNGSQFFITEVPTPHLNQKHTIFGQCDNVDLVQQMARVPRDERNDKPTESISITGIKFEGVKPPAAKAPVKKTTGTATKSTTTKPKPKPTPQ

SEQ ID NO: 82196 - protein, 137 aa, Campylobacter lari RM2100
MEKTLSIIKPDAVKKGVIGQILTRFESNGLRIAATKKIQLSEKEAQEFYAVHKDRPFFKDLVEFMISGPVVVSVLEGKNAVLKNRELMGATNPKEAAAGTIRADFADSIDANAVHGSDSLENAKIEIEFFFSKTEIL

SEQ ID NO: 82197 - protein, 407 aa, unidentified eubacterium SCB49
MKNPLKDIGPGTLVAAAFIGPGTVTVCTVAGVQYGFTLLWAMALSVIATIVLQEMAARLGIVTQKGLAETITSEISNKWLRGAAVLLVVSAILIGNAAYEAGNISGGALGLASVLPTSILELGSLNIPFIPLLIGIVAFCILYFGNYKTIERALVSLVIVMSLSFLIAAVLTQPSISEFLKGLLIPSIPDESLLLIVGLIGTTVVPYNLFLHASLVKERWKTVGDLKAARKDVYVSIVLGGLVSMGIIVCGAAIQQSEITNAADLAKGLEPLFGAYAKYFLSIGLFAAGITSAITAPLAAAYVASGCFGWEDAIKSAKFKAVWITILLIGVVFSSVGFKSIEVIQFAQFANGLLLPIVAIFLLWIVNKKSILGEYKNTKPQNILGFIIVITTIGLGLRGLLKVFGVI

SEQ ID NO: 82198 - protein, 196 aa, Marinobacter sp. ELB17
MLLMIDNYDSFTYNVVQYLAELGADVQVHRNDEITVEQIEALNPERLVISPGPCTPSEAGISMDVIRHFAGKIPILGICLGHQAIGQVFGGQVIRAGRVMHGKVSPVYHHSKGVFRGLNNPLQATRYHSLVIEQATLPDCLEVTAWTRNNDGSVEEIMGVRHKTLAVEGVQFHPESIMSEQGHELLRNFLRTEQKG

SEQ ID NO: 82199 - protein, 198 aa, Campylobacter lari RM2100
MIVTKKAIDFTAPAVLGNNQIVEDFNLYKNIGPKGAVVFFYPKDFTFVCPSEIIAFDKRYQDFKDRGIEVIGVSCDNEFSHFAWKNMPVNQGGIGQVKFPLVADLTKQIARNFDVLFGEAVALRGSFLLDADGTIRHAVINDLPLGRNIDEMIRMVDTMLFTNEHGEVCPAGWNKGDEGMKADPKGVADYLSKNEGKL

SEQ ID NO: 82200 - protein, 228 aa, Marinobacter sp. ELB17
MNPYLIAPSILSADFARLGEEVDNVLAAGADVVHFDVMDNHYVPNLTIGPMVCEALRKHGVTAPIDVHLMVSPVDDLIRKFMDAGASYITFHPEASQHVDRSLQLIRDGGCKAGLVFNPATSLQYMDYVMDKLDMVLVMSVNPGFGGQKFIPGTLDKLREARKRIDASDYNIRLEIDGGVKTDNIREIAEAGADTFVAGSAIFNTDDYKATIDAMRAELEHASKILGF

SEQ ID NO: 82201 - protein, 77 aa, Glycine max
  misc_feature (60)..(60): Xaa can be any naturally occurring amino acid
  misc_feature (75)..(75): Xaa can be any naturally occurring amino acid
MNQTAIANFEKAIGCYSPSVQELIVIDDVLSAMVGIEGRYILIKTFCGKSDDFPFLGDPXLDLALQELAKRIFPXCK

SEQ ID NO: 82202 - protein, 398 aa, Wolbachia endosymbiont of Drosophila simulans
MNIPSIENCDLHNKAVLLRVDFNVPIKDGEIRDVTRILRALPTIQYLVNASAKIIIISHFGRPKARDNNLSLKNVIDTLSQLLNKKVKFIDDCVGEKVQKAVSAMDAGDIILLENLRFYEGEKENDANFARQLASLADIYVNDAFSCSHRAHASISRITEFLPSYAGFCLQDELKYLEKAVSFKAKPITAIVGGAKISTKIKVLMKLTEKVDYLVLGGAIANNFLSFSKVNIGKSFFQNGVDDLLHNIVETANKNNCKIVVPEDVLVAVNSDYSTSISRKTESILDGDIILDIGSQTLSTISSIIASSKTLLWNGPIGVFEHSAFASGTIGVMKIVSDLTHKGKLTSIIGGGDSLSAISAAGLTDKDFTYVSTGGGAFLDWLSGDEMPGVAALQKRLD

SEQ ID NO: 82203 - protein, 325 aa, Opitutaceae bacterium TAV2
EAARGVVTASAGNHAQGVALAARTLGIHARIYMPRSTPRVKQNAVLHHGGDHVRIILSGDSYDEAVTAAREDERTTRAVYVHAYDDLQVMAGQGTLADEIVLSGHGPFDAVYLQIGGGGLAAAVSNWLKLYWPHMAAIGVEAIGQASMRAALAAGHPVALDEVDIFCDGTAVRKADELPYLICKDTLDRVETVTNAEVSAAIRVLWETIRCISEPSGALGLAAVLKNRAALAGRRVLIIVSGSNIDFQQLGHIAQTAGSASTATRTLRIRIPEKPGSMLRLLDDAFAGLNVAEFQYGKQHPTEAWPIFTVNAVNVRATRCDSRPP

SEQ ID NO: 82204 - protein, 566 aa, Blastopirellula marina DSM 3645
MSTDQALSPVDEFKRDSNYLRGEIAQEFVDGSDHFGKSSIQLMKHFGVYQQDDRDARSANRAAGGGKSYIFMIRTRIPAGVLTSDQMLVELDLCDELGNETLRITSRQGLQHHGVMKEGLQPLAQKLKQVGLSTLGACGDVNRNVMCCPAPLFGDSVRREMQETASKLADHLAPRTGAYREIFLQDPETGEKEKIATGEVVEPLYGKQYLPRKFKMGMALPEDNCIDVYTHDLGMICVHENGQILGYNILVGGGQGRTPSADKTFPALGQRLTFVTTEQLIPVIEAIVKVQRDFGNREDRKVARMKYLIHNWGLEKFKAKVEEYYGSSLPEPHPADVHGFDDHKGWHAQGDGKWFYGLNVENGRIKDDETMQLKTAIRKICRQFNPGIRLTAHQDIIFSDINEADKEALIEILKSHQVPLTEDISNVRRWSMACVAWPTCGLSITESERALPGIIDGLEAELAKLGLAAEEFTVRMTGCPNGCARPYNSDVGLVGRAKEKYTLFLGGRLLGNRLSFIYKDMVPAGDVTPELTKVFAFFKAAREEGESFGDFCHRQGKEAIEAAVGQ

SEQ ID NO: 82205 - protein, 799 aa, Sulfolobus solfataricus P2
MGSFLLVEAISSEEDLILDVSQVTKDMVQLAGGKGANLGELTSIGVRVPPAFILTSKAFKYFLEYNNLFDKIRDTLSSSETSEEASEKIKQLIKNAKMPDKLSSMIYQAYDELSKKVGKEILVAVRSSATAEDIETASFAGQQDTYLNVTKDELIDRIKDVWASLYNARAMEYRKSKGIDDLSILIAVVVQKMVNSRSAGVMFTLHPVTGDEKYIMIESNWGLGESVVGGKVTPDEVLIEKSTLRIVEKKVSNKNIKIVYDKQLKKNVTITLDEKESRLMSITDEEAIELAKLALKIEEHYKRPMDIEWAIDNDLSFPENIFIVQARPETFWSSKRKENKNIAEKSAPIGGKVLVRGLAASPGIAFGKAKIILDIKDPKVHEFQKGEILVTKMTDPDWVPLMKIAGAIITDEGGMTSHAAIVSRELGIPAIVGSREATKIIRDNQEITVDAIRGIVYEGKVLQTSETVSQQAQPSIGIQGISREVLLSLYPVTATKIYMNLGEPDVIDKYLDLPFDGIGLMRIEFIVSEWVRYHPLYLIKIGNAELFVDKLAEGIAKVASAIYPRPVVVRFSDFKTNEYKKLIGGEEFEPDERNPMIGWRGVSRYVSKEYEPAFRLEAKAIRKVREEMGLKNVWVMFPFVRTTWELEKAIKIMEEEGLRRDSDFKVWIMAEVPSVVVLAEEFAKIVDGFSVGSNDLAQLTLGVDRDSELLARMGYYDERDPAVLESIRKLIKAAHKYGKTVSICGQAPSVYPAVVEYLVKAGIDSISVNPDAVINVRRQVASIEQQIILRNLNGKRKNK

SEQ ID NO: 82206 - protein, 388 aa, Streptococcus pyogenes MGAS10394
MKNQLGQLALEQAKTFGGKLEVQPKVDIKNKHDLSIAYTPGVASVSSAIAKDKTLAYDLTTKKNTVAVISDGTAVLGLGDIGPEAAMPVMEGKAALFKAFAGVDAIPIVLDTKDTEEIISIVKALALTFGGINLEDISAPRCFEIEQRLIKECHIPVFHDDQHGTAIVVLAAIFNSLKLLQKSLDEVSIVVNGGGSAGLSITRKLLAAGATKVTVVDKFGIINEQEAAQLAPHHLDIAKVTNREFKSGTLEDALEGADIFIGVSAPGVLKAEWISKMAARPVIFAMANPIPEIYPDEALEAGAYIVGTGRSDFPNQINNVLAFPGIFRGALDARAKTITVEMQIAAAKGIASLVPDDALSTTNIIPDAFKEGVAEIVAKSVRSVVLKS

SEQ ID NO: 82207 - protein, 268 aa, Haemophilus somnus 129PT
MNPMLNIAIRAARKAGNIIAKGYERRDEIQTMQKGINDFVTNIDKASEAAIIEVVRKSYPEHTIVTEESGVHEGQKNDIQWVIDPLDGTTNFVKGLPHFAVSIAVRVKGRTEIGVVYDPIRNELFTAVRGEGAKINELRLRVDSSKRDLQGAILATGFPFKKPSLMPTQFAMMSNLAENVADFRRAGSAALDLCYVAANRVDGYFEMGVKPWDITAGDLILREAGGLVCDFYGGHKYFTDSHIVAATPRLVKEILNKIQPCLAPDFKV

SEQ ID NO: 82208 - protein, 310 aa, Streptococcus pyogenes MGAS10394
MNWLITSQPYKELNMKAATYLSTGNLQLIDKPKPVIIKPTDAIVQVVKTTICGTDLHILGGDVPACKEGTILGHEGIGIVKEVGDAVTNFKIGDKVIISCVTSCHTCYYCKRGLSSHCEDGGWILGHLINGTQAEYVHIPHADGSLYHAPDTIDDEALVMLSDILPTSYEIGVLPSHVKPGDNVCIVGAGPVGLAALLTVQFFSPANIIMVDLSQNRLEAAKTFGATHTICSGSSEEVKAIIDDITNGRGVDISMECVGYPATFDICQKIISVGGHIANVGVHGKPVDFNLDELWIKNITLNTPIQLKCY

SEQ ID NO: 82209 - protein, 318 aa, Zea mays
MEAWRSLLASFVLAVLAAQALGAGVESRTGPVEQASEGDDVKNPDCVPGMDPRSFPGTGGGHGITPVTPSHGGSSSPTPSHGGGGGYVPTPSHGGTLPFPSHGGSGSGSSPTSPSTGGGAYGGSPSTPGGGAYGGSPPSTPSGGGAYGGSPSTPSGGGAYGGGSPSPAHGAGGAYGSSPTPAYGDSPLHGGIGTSSPTTFVPMDPHSFGTCDYWRSHPMEIWSAVGGRFPSTSSSMGHFFGAAAGSVGGADVMSIQDAVGNTRADGTGALLREGAAALLNSMTRAGFPYTTEQVRDAFAAAAAAGSDGAAALEYPSRG

SEQ ID NO: 82210 - protein, 591 aa, Physcomitrella patens subsp. patens
DLGADTRALLVFSNFHDPKGTKLRWTNASWTCNWRGITCFGNRVTEVRLPGKGFRGNIPTGSLSLISELRIVSLRGNWLTGSFPGELGNCNNLESLYLAGNDFYGPLPNDLHAVWPRLTHLSLEYNRLNGVIPESLGLLPQLFMLNLRNNFFSGSIPPLNLANLTIFNVANNNLSGPVPTTLSKFPAASYLGNPGLCGFPLESVCPSPIAPSPGPIAVSTEVAKEGGDKPLSTGAVAGIVVGGVAALVLFSLALIFRLCYGKKGQLDSAKATGRDVSRERVRDKGVDEQGEEYSSAGAGELERNKLVFFDGKKYSFNLEDLLRASAEVLGKGSVGTAYKAILEDGTIMAVKRLKDVTTGKKDFESQIQAVGKLLHKNLVPLRAYYFSKDEKLLVYDYMPMGSLSALLHGNRGSSRTPLDWLSRVKIALGAARGLAYLHAQGGSKFAHANIKSSNILLSRDLDACISDYGLAQLLNSSSAASRIVGYRAPEVTDARKVTQKSDVYSFGVLLLELLTGKAPTQAALNDEGIDLPRWVQSVVREEWTAEVFDLELMRYQNIEEEMVSMLQIAMQCVDPVPERRPKMNNVLLLLE

SEQ ID NO: 82211 - protein, 283 aa, Bacteroides fragilis YCH46
MDFKELNNGVKMPIQGFGVFQIPDATECERVVTDALAVGYRLIDTASVYGNERAVGMAIRKSGIPREELFITTKAWISEMGYERTLRALDTSLARLGLDYLDLYLIHMPFGDYYGAWRAMEKLYAKGRVRAIGVCNFEPDRLLDLCHNANVIPAVNQIEVHPYTPQTDAIRTMQELGIQAEAWGPLAEGRNGLFTDDILTGIARKYDKSAAQVVLRWHLQRGVVAIPKSVHRQRMQENFNIGDFMLTPEDMAAIASMNMGYDMILDLHAPEEVQRLYGIECPA

SEQ ID NO: 82212 - protein, 151 aa, Bacteroides fragilis YCH46
MKHAIGLRYRLVDAAQGYDNEAEVWYGIKESGIGRSEVFIISKVSPDAVRSGKVRESLDRTIEAFGGTYVDLMLIHWPVARKVKERWRIMEKYVDVGKIRAIGVSNFNPHHVDELLAYARIKPVVNQIKIHPYMEHQEVVGNTFAKGIQVQ

SEQ ID NO: 82213 - protein, 115 aa, Vitis vinifera
MEEFQEAEVMFADKHDYREIPSQASHNHKFAKKKKKKSVPMNIPTSASLCGDSDESQEDFDFEDEEMVPPHVITSRRVAGKMAFSVRTGTGRTLKGRDLSRVRNSILRMTGFLET

SEQ ID NO: 82214 - protein, 168 aa, Chlamydomonas reinhardtii
VEDDEDEELSEDDDDEDLEGDEEGGAGRGKQSRSEKKSRKAMQKLGMKPVTGVTRVTIKKSKNILFVIQSPDVFKSPASDTYIIFGEAKIEDLSAQTQAAAAEQFKMRPEAMAGAAALAGEGEVDDSGVEQKDIELVMTQANVSRSKAVKALKNAEGDIVSAIMELTM

SEQ ID NO: 82215 - protein, 340 aa, Synechococcus sp. WH 8102
MSLTPPANDAQAGVPSDRLWLRSELMGTQVITRDTGRRLGVVGEVIVDIDRREVVAVGLRDNPLTRFLPGLPRWMPLDRIRQVGDVILVDSADSLSDGFNPERYGRVINCQVITESGRQLGRVLGFAFDIETGELTTLVMGALGVPLLGEGVLSTWEMPVEEIVSSGPDRIIVYEGAEDKLKQLNSGVLEKLGVGGPSWEEQERERYRVNLVPVENQLSSGQPVEEEQRRLTASETARFEPEEDLEYVELEEQRRDEMPQRRYLDQEPEDPYPLPRRSMPVSRRAMPPEREPMDVEPMDVEPMDVEPLNREPMGREPMEREQPQRRSRPTASDDDLDDPW

SEQ ID NO: 82216 - protein, 432 aa, Physcomitrella patens subsp. patens
MKKVTQLSCRLATIERKWLVPLVASIITSIMLLFLVAFKVGSGEHHSSGDSIVPIIPARDGTQSQNVVESIAQDPTAELPPPPRLAYLISGTKGDGLRMQRTLQALYHPWNYYLLHLDLDAPPRERLDLARYVKNEVVFKEGGNVYVVGKTNLVTYRGPTMIAATLHGAAILLRKAKDWDWFINLSAADYPLVTQDDLLHVFSYLPRDLNFIQHTSDIGWKEFQRAKPIIIDPGLYQNKKTDIFWATQRRALPTAFRLFTGSAWFALTRSFMEYCNLGWENLPRTLLMYYTNFVSSPEGYFHTVLCNAQEFRNTTVNHDLHYIKWDHPPKQHPLSLTLKDMENMTISGAAFARKFDKDDPVLDRIDETLLNRKKGQFTPGGWCIGRRHATDPCALRGNHSLLRPGPGSRRFENLVVRMLSAESFRTQQCASV

SEQ ID NO: 82217 - protein, 196 aa, Yarrowia lipolytica CLIB122
MATKILASTLFLFGLVVAGYLLFQGEGESFNVGEFLSTTSPLMWANLGIGMCITLSVIGAAWGIFITGSTIIGAGVKAPRITTKNLISIIFCEVVAIYGLIMAIVFSAKLASVEDVYTKSNMYTGFSLFWAGLTVGLGNLVCGICVGITGSTAAVADAADSALFVKILVIEIFGSVLGLFGLIVGLLMAGKASEIS

SEQ ID NO: 82218 - protein, 573 aa, Oryza sativa
  misc_feature (11)..(11): Xaa can be any naturally occurring amino acid
  misc_feature (61)..(61): Xaa can be any naturally occurring amino acid
MPDWRVGEFAXGSSSDGFARSNNSEHENGAGTVSISSKKSKHGVASEKKPHVDISGLIDSXSQKCNSEQIHSANGIVSRDVNHDHIENCKVESNDFPLNTISETRYPTDNWNSSQFALSNDGSPVLNNQSTPQTGHGYGDNDLTYIDWPAIDNFEDVDNLFRRCDSTYGQQQLPNTDELSWIPSSDAMYSSDVAMQPGFESSYSDYGILDDLSAFNCTEDKSLTTADPSSAVCDEQFDDSYLFNEQKTEDVYGEQAYQRDAMELLSSDQICTGQENLDMIGNRYSSENAMEQPEDQKFSIASGSQLSSSQNLLNQKNHLDSTSPSNITSESYPERNCQIIPSGASFAERNLKVQKKVASSASGQLISDNVTGHPGHQTLTRRASYPCENHEIGKRSLGKRGLGHSDVAMGTSMVVDGSFVSSISSDNSVEENSFRQLQDAVSQLDVKTKMCIRDGLYRLARSAQNRQVFPNTMNNNGDSHNVKDMQNAETSGKFVDPGSIETQTNPIDRSIALLLFHQPSEHVTGAVDEAASLKSHNDNHQAAAKNQRVMHASSVHSPRGQGDPMDAKSCRNN

SEQ ID NO: 82219 - protein, 790 aa, Arabidopsis thaliana
MEMGVMENLMVHTEISKVKSQSNGEVEKRGVSVLENGGVCKLDRMSGLKFKRRKVFAVRDFPPGCGSRAMEVKIACENGNVVEDVKVVESLVKEEESLGQRDASENVSDIRMAEPVEVQPLRICLPGGDVVRDLSVTAGDECSNSEQIVAGSGVSSSSGTENIVRDIVVYADESSLGMDNLDQTQPLEIEMSDVAVAKPRLVAGRKKAKKGIACHSSLKVVSREFGEGSRKKKSKKNLYWRDRESLDSPEQLRILGVGTSSGSSSGDSSRNKVKETLRLFHGVCRKILQEDEAKPEDQRRKGKGLRIDFEASTILKRNGKFLNSGVHILGEVPGVEVGDEFQYRMELNILGIHKPSQAGIDYMKYGKAKVATSIVASGGYDDHLDNSDVLTYTGQGGNVMQVKKKGEELKEPEDQKLITGNLALATSIEKQTPVRVIRGKHKSTHDKSKGGNYVYDGLYLVEKYWQQVGSHGMNVFKFQLRRIPGQPELSWVEVKKSKSKYREGLCKLDISEGKEQSPISAVNEIDDEKPPLFTYTVKLIYPDWCRPVPPKSCCCTTRCTEAEARVCACVEKNGGEIPYNFDGAIVGAKPTIYECGPLCKCPSSCYLRVTQHGIKLPLEIFKTKSRGWGVRCLKSIPIGSFICEYVGELLEDSEAERRIGNDEYLFDIGNRYDNSLAQGMSELMLGTQAGRSMAEGDESSGFTIDAASKGNVGRFINHSCSPNLYAQNVLYDHEDSRIPHVMFFAQDNIPPLQELCYDYNYALDQVRDSKGNIKQKPCFCGAAVCRRRLY

SEQ ID NO: 82220 - protein, 378 aa, Zea mays
MKEEGGGGGDAGFVRADQIDLKSLDEQLERHLTRAWTMEKRKEEASAGAGAGARQHQQSRRPRREDWEIDPAKLVVKGVIARGTFGTVHRGIYDAHDVAVKLLDWGEDGHRSEQDIAALRAAFSQEVSVWHKLDHPNVTKFIGAIMGARDLNIQTENGHIGMPTNICCVVVEYLPGGALKSFLIKNRRKKLAFKVVVQIALDLARGLSYLHSKKIVHRDVKTENMLLDKTRTVKIADFGVARLEASNPSDMTGETGTLGYMAPEVLNGNPYNRKCDVYSFGICLWEIYCCDMPYPDLSFSEVTSAVVRQNLRPEIPRCCPSSLSNVMKRCWDANPDKRPEMAEAVSMLEAIDTSKGGGMIPVDQRPGCLACFRQYRGP

SEQ ID NO: 82221 - protein, 397 aa, Desulfovibrio vulgaris subsp. vulgaris str. Hildenborough
MSQSQFPRMHRLPPYVFAVVNELKMQLRRQGVDIVDLGMGNPDMPTPQHIVDKMVEASMKGNNHRYSVSRGIPNLRKAICDWYTRRFGVYLDPDTEAVVTMGAKEGLSHLSLAMLSPGDVVFAPDPTYPIHTYAPVIAGADVRRIPIGRGRDFFEDLLVATRQTWPQPKLLFLSYPHNPTTELATPEFFQKVVDFAKEHKIYVIHDFAYADLAFDGHMPPSFMQADGAKDVGVEFFSMSKSYSMAGWRVGFCVGNREMVNTLTRIKSYLDYGIFQPIQIAATVALNGPQECMTEIVDTYRKRRDVLIEGLNRSGWEVPAPKGTMFVWAQIPEPFRAMGSVEFSKLLLREAHVAVSPGLGFGAHGDDHVRFALIENEQRTKQALRGIRHLLSGKPCGE

SEQ ID NO: 82222 - protein, 386 aa, Bacillus megaterium
MEFVLSLALILFATKIAGHLSVRLGQPSVLGKLLIGIILGPAVLGWIHNDQFVHYFSEIGVLLLMFLAGLETDLEQLKRNWKAAFAVAVLGIILPFIGGFGVGELFGLGATYSLFIGVLLCATSVSITVQVLKDMNRLNSREGSTILGAAVVDDVLVVVLLAIMISFLGTGEEVSLGLLVGKKLIFFIGAVLAGWLVVPKVLDWLTNLKVTEPVVSIGLAICFGYVYFADLMGMAGIIGAFAAGIAISQTSYRHTIESKVEPIAYAVFVPVFFVSIGLNVSFEGVGDQIGFILLLSVIAVITKLVGGALGAKVTGFSTRSSLLIGSGMVSRGEVALIIAATGLQESLLLPEYFTSAVIVIIITTLVAPPLIKYIIQSESKITQMEK

SEQ ID NO: 82223 - protein, 521 aa, Oryza sativa Japonica Group
MAATTHAASLSFLLSHPHPTSPNPNPNPNLPLRRAPHRVRCATDAAATRHRRAADENIREEAARHRAPNHNFSAWYAPFPPAPNGDPDERYSLDEIVYRSSSGGLLDVRHDMDALARFPGSYWRDLFDSRVGRTTWPFGSGVWSKKEFVLPEIDPDHIVSLFEGNSNLFWAERLGRDHLAGMNDLWVKHCGISHTGSFKDLGMTVLVSQVNRLRRAPLSRPIAGVGCASTGDTSAALSAYCAAAGIPAIVFLPANRISLEQLIQPIANGATVLSLDTDFDGCMRLIREVTAELPIYLANSLNSLRLEGQKTAAIEILQQFDWEVPDWVIVPGGNLGNIYAFYKGFEMCRVLGLVDRVPRLVCAQAANANPLYRYYKSGWTEFTPQVAEPTFASAIQIGDPVSVDRAVVALKATDGIVEEATEEELMNAMSLADRTGMFACPHTGVALAALFKLRDQRIIGPNDRTVVVSTAHGLKFSQSKIDYHDSKIEDMACKYANPPVSVKADFGAVMDVLKKRLKGKL

SEQ ID NO: 82224 - protein, 278 aa, Marinobacter sp. ELB17
MSDSVSLHEITDFAQALALEAGEMIRHERDHNTLRTDYKQQTELVTHADVMADEFITSAIRKRFPEHRILSEETMPDLTQAEHIDTPLWVIDPIDGTVNYAYGHPQVAVSIAYAERGQVQAGVVHAPFAGQNGKGETFRATRGEGATLNGQAIRHSNASELRQALFATGFPYTKDALEPLLKRLDAMIHQCRDLRRIGSAALDICWVACGRLDVYYENVSPWDFAAARLIAIEAGARAGHFGEVPENQPADLWGKDILISSPKLWQPVREILRKASGY

SEQ ID NO: 82225 - protein, 321 aa, Calystegia soldanella
KGQNPVFPRILGHEAAGIVESVGEGVTDLKAGDHVLPVFTGECKECRHCKSDESNMCDLLRINTDRGVMLEDQKSRFSINGKPIYHFVGTSTFSEYTVCHVGSVAKINPLAPLDKVCILSCGISTGLGATLNVAKPPKGSTVAVFGLGAVGLAAAEGARMAGASRIIGVDLVPSRFELAKKFGVTDFVNPKEHSKPVQEVIVEMTDGGVDRSVECTGNVNAMISAFECVHDVWGVAVLVGVPHKDAEFKTHPMNLLNERTLKGTFFGNYKPRSDLPSVVDKYMNKELELEKFITHEVPFAEINKAFDLMLKGEGLRCIITM

SEQ ID NO: 82226 - protein, 325 aa, Opitutaceae bacterium TAV2
MPESTDSISAPGSFRWQIYDDITAAIGRTPLVRLRRLAPPGGAELVAKVEGTNPLGSVKDRIGAAMIAAAERDGKLQPGGTVIEPTSGNTGIGLAFACAARGYRLILTMPESMSIERRKLVQMLGAELVLTPADKGMAGSVDKARELHRRIKGSFLPMQFENPANPQAHRETTAEEIWADTAGRVDLFVAGVGTGGTITGVAEVLKSRKPSVRAIAVEPEASPVLSGGRPGPHRIQGIGAGFVPPVLNRKIVDEVIAVRNEDAFATAQRVGLEEGILCGISSGAAVWAALQLAARPENTGKLIVVILPDSGERYLTTQLADVSRE

SEQ ID NO: 82227 - protein, 234 aa, Glycine max
  misc_feature (218)..(218): Xaa can be any naturally occurring amino acid
  misc_feature (227)..(227): Xaa can be any naturally occurring amino acid
MPKPHSEAGTAFIQTQQLHAAMADTFLEHMCRLDIDSAPITARNTGIICTIGPASRSVEMLKEMIKSGMNVARLNFSHGTHEYHAETIKNVREATESFASDPILYRPVAVALDTKGPEIRTGLIKGSGTAEVELKKGATLKITLDNAYMEKCDENILWLDYKNICKVVEVGSKIYVDDGLISLQVKEKGADFLVTEVENGGSLGSKKGVNLPGAAVDXPAVSEKDIXDLKLGWS

SEQ ID NO: 82228 - protein, 326 aa, Blastopirellula marina DSM 3645
MSDTLTLAGGGKLPMVGLGTWKIDTAILPDLIVAAVAAGYRHFDCACDYGNEKEVGAGIRQAIDQGLCRREDLWITSKLWNTYHRPEHIRAAAERSLKDLQLDYFDLYHIHFPIALEFVPFEKRYPPEWFFDPDAAEPKMHPIAVSQAETWGALQALKTAGMARHLGVCNFNVALIREITAATSQRPDVLQVELHPYLSQERLLRFCKQAGIAVTAYSPLGAPSYVPLGMAAEDEDLLAEQTIRTIAEAHGKSPGQISLRWNVQRGAAVIPKTSRVERLAENIALFDFELSESEMTSIGQLNRDRRFNDPAQFGEAAFNTFFPIYD

SEQ ID NO: 82229 - protein, 352 aa, Opitutaceae bacterium TAV2
MPIARAYSATRPDAALAPFSLRRREPLPHDVEIAILYCGVCHSDLHQARNEWRDTVYPCVPGHEITGRVARIGEKVTKFQPGDSVAVGCMVDSCRTCPSCREGLENYCENGSTGTYNDPDRHSGEVTQGGYSECIVADEAFVLRVPPGLDLAAAAPLLCAGITTWSPLRHWKIGPGHRVGVVGLGGLGHMAIKLARALGAQVTLFTTSPGKAEDARRLGAHDAVVSKNPDALSAHRNRLDFILDTVSAPHDVNVWLDLLRRDGTLALVGAPLEPHPLAAFSLLTHRRQVAGSMIGSIRETQELLDFCAARGIAADIERIPIQRINEAFVRLLAGEVKYRFVIDMKSLASAPS

SEQ ID NO: 82230 - protein, 264 aa, Synechococcus elongatus PCC 7942
MISSLGIIGGGVMGEALLARLLAQGQVAATAVTVSEPFAARCEFLNDRYGVRCVDDNAEAAQADWVLLAIKPQVFDPAVAGLADLRSDRLILSILAGVPLAKLEAAFPHEAVIRAMPNTPATVGAGVTAIAAGQQVTADQLSQAQEFFAAVGRVVTVPESQLDAVTGLSGSGPGYVALIVEALSDGGVAAGLPRAIATELAIQTVRGTAELLQETGWHPGELKDRVCSPGGTTIAGVATLEQNGLRSALIEAVKAAALRSQQLG

SEQ ID NO: 82231 - protein, 455 aa, Mycobacterium avium 104
MTTPKTFADLGVPARIVDALTARGITSPFPIQAETLPDTLAGRDVLGRGKTGSGKTLAFSIPLVGRLSTGNRRPARPTGLVLAPTRELATQITATLEPLAAACGLRVSTIFGGVSQHRQVTALKAGVDIVVACPGRLEDLMRQRLITLEAVRVTVIDEADHMADLGFLPGVTRILAATPNDGQRLLFSATLDNGVDKLVTRFLRDAVLHSVDEANSPVSEMTHHVFHVDSAQAKKELVHRLASGTGRRILFLRTKHQARKLARQLTESGVPSVDLHGNLSQPARERNLAMFAAGSARVLVATDIAARGVHVDEVELVVHIDPPSEHKSYLHRSGRTARAGSAGDVVTVVLPEQREHTRALMRKAGIDVAPQRVTAGSEAVHALVGPIAPPKPPAAAGVPSHPAGPHRPAAAGQRRRRSGRSARTTAAHAAVPHRPAAPARRPDRRRASRAQGSAG

SEQ ID NO: 82232 - protein, 671 aa, Oryza sativa Japonica Group
MTSSSRVRVGNLVPLNEGNASSSNGSVSSIPIYLGANVVGRNHLVVVDKRVSRKHLSLHASADGSIEAVVEGPNPIIVRSEGQRRKVCAQERVKIAHDDVLELIPGEYFVKYLNVGDNHKSSTSMGSSDFKKGKRLCEDDTVVIKRNRQIMEDEALARSLQKSFAEESSTISGLGCDQMLSSLDSAGFSERNNERIHSVDYLKDVLSLTFRLMRVQGLPSWTNTSSVTIQDVIQGEVLLAVLSNYMVDMEWLLTACPSLRKVRHVLVIHGEDGASVELLKKVKPANWILHKPPLPISFGTHHSKAMLLVYPQGIRVVVHTANLIHVDWNNKTQGLWMQDFPWKDAKDVNRSVSFENDLVDYLSAIKWPEFRVNLPVVGDVNINAAFFRKFDYKSSSVRLIGSVPGYHVGPNIKKWGHMKLRSVLEGCTFEQQFCKAPMIYQFSSLGSLDEKWMSEFAFSLSAGKSDNGSPLGIGKPLIVWPTVEDVRTSIEGYAAGSCIPSPQKNVEKDFLRKYWARWKADHVGRCRAMPHIKTFTRYNGQDIAWFLLTSANLSKAAWGALQKNNTQLMIRSYELGVLFLPKTHQSVPQFSCTGKNNSNLNNLAPGKEIKTKLVTLCWKSDEEKEQSTEIIRLPVPYQLPPKPYGTEDVPWSWDKRYTKKDVYGSVWPRHG

SEQ ID NO: 82233 - protein, 402 aa, Sulfolobus solfataricus P2
MVSLLDFNGNMSQVTGETTLLYKEIARNVEKTKKIKIIDFGIGQPDLPTFKRIRDAAKEALDQGFTFYTSAFGIDELREKIAQYLNTRYGTDVKKEEVIVTPGAKPALFLVFILYINPSDEVILPDPSFYSYAEVVKLLGGKPIYANLKWSREEGFSIDVDDLQSKISKRTKMIVFNNPHNPTGTLFSPNDVKKIVDISRDNKIILLSDEIYDNFVYEGKMRSTLEDSDWRDFLIYVNGFSKTFSMTGWRLGYIVAKREIIQKMGILAANVYTAPTSFVQKAAVKAFDTFDEVNQMVSLFKKRRDVMYDELTKVKGVEVSKPNGAFYMFPNVSKILKTSGFDVKSLAIKLIEEKGVVTIPGEVFPLNIGKEFLRLSFAVNEEVIKEGIQKIREFAEQMMNSR

SEQ ID NO: 82234 - protein, 341 aa, Salinibacter ruber DSM 13855
MSSITLFGAGSWGTAMSVHLASAGRDVVLWARRPEVADEIRRTSHNPTYLPELLIPSSVYITTDLEKAAEASDLWGMAVPSQQLRGRAEHLRPHAHSGVRLVALSKGIENETLLTMSQVLDDVFESVPSDQIGALYGPSHAEEVAEGRPTAVVAAAPDEGEARHIQKVFMTERLRVYMNTDVLGVEIGGSAKNVLAIAAGIADGVSYGDNAKAALVTRGLAEIRRLGQALGADPQTFAGLAGIGDLVVTCMSPHSRNRYLGEQISTGKSLDEVLNDMAMVAEGVRTTRSVYNLAKHHGVEMPITEAVHAILFDDKSPRKMVKRLMTRSAKHENWLPTTLQQ

SEQ ID NO: 82235 - protein, 375 aa, Streptococcus pyogenes MGAS10394
MTYFDNAATTPLSPNVIRAMTAAMQDNFGNPSSIHFYGRRANKILRECRQAIARNLGASEQQIIVTSGGTESNNMAIKGYALAHQAKGKHLITTTIEHHSVLHTMAYLEERFGFEVTYLPCQNGQINLSDLKQALRDDTILVSIMYANNETGDLLPIKDIGNLLKDHQAAFHVDAVQAVGKLKIIPSELGIDFLSASAHKFHGPKGCGFLYSNGQPIDPLLHGGDQEGKRRASTENMLGIIGMAQALTDAMTCLDQSTDHIICLRHHLISLLEGLPYYINQGTHYLPHVLNIGFLGYQNTILLTQLDLAGIAVSTGSACTAGAVNPSHVLAAYYGDDSSRLKESIRISFSDQNSIEDVNQLAQTLKNILGGTDGF

SEQ ID NO: 82236 - protein, 326 aa, Streptococcus pyogenes MGAS10394
MTERYADKQIKLFSLTSNLPIAEKIAKAAGIPLGKMSSRQFSDGEIMINIEETVRGDDIYIIQSTSFPVNDNLWELLIMIDACKRASANTVNIVLPYFGYSRQDRVAKPREPITAKLVANMLTKAGIDRVVTLDLHAVQVQGFFDIPVDNLFTVPLFAERYSKLGLSGSDVVVVSPKNSGIKRARSLAEYLDSPIAIIDYAQDDSEREQGYIIGDVSGKKAILIDDILNTGKTFAEAAKILERSGATDTYAVASHGLFAGGAAEVLETAPIKEIIVTDSVKTKNRVPENVTYLSASDLIAEAIIRIHERRPLSPLFSYQPKGKNNA

SEQ ID NO: 82237 - protein, 508 aa, Schizosaccharomyces pombe
PTHNQTFINHTTKRRIMSQKEVADFGLIGLAVMGQNLILNGADKGFTVCCYNRTTSRVDEFLANEAKGKSIVGAHSLEEFVSKLKKPRVCILLVKAGKPVDYLIEGLAPLLEKGDIIVDGGNSHYPDTTRRCEELAKKGILFVGSGVSGGEEGARYGPSLMPGGNPAAWPRIKPIFQTLAAKAGNNEPCCDWVGEQGAGHYVKMVHNGIEYGDMQLICETYDIMKRGLGMSCDESTDVFEKWNTGKLDSFLIEITRDVLRYKADDGKPLVEKILDAAGQKGTGKWTAQNALEMGTPVSLITEAVFARCLSSLKSERVRASKKLTGPNTKFTGDKKQLIDDLEDALYASKIISYAQGFMLMREAAKEYGWKLNNAGIALMWRGGCIIRSVFLKDITEAFREDPNLESILFHPFFTNGVEKAQAGWRRVVAQAAMLGIPVPATSTGLSFYDGYRSAVLPANLLQAQRDYFGAHTFRVLPEAADKSLPADKDIHINWTGHGGNISATTYDA

SEQ ID NO: 82238 - protein, 611 aa, Glycine max
MSRLQKSTGQQQMFHSLHQILSPYMSSVVVSVLLWHVIAVLLVSNLAFASSLEETNGHPKHKGEVIYAHNGAVATDDRRCSRIGKDVLREGGHAVDAAVASSLCLGVVSPASSGLGGGAFLLLRLNNGVAKAFDMRETAPALASKDMYAGNTTLKAKGGLSVAVPGELAGLHEAWKQHGKLPWKRLVKPAEILARRGFKVSPYLHKQMEETESDILEDKGLRSIFAPNGKLLKIGGICYNKKLAKTLRTISESGPKAFYEGLIGLNLVKDVQNAGGILSMKDLKSYTVKQKEPISNDVLGLKLLGMPPPSGGHPMMLLLNILDQYKLPSGLSGALGFHREIEALKHVFAVRMNLGDPDFVNITGVLSDMLSHRFANVLKNDINDNKTFGPSHYGSRWNQIHDHGTSHLSIIDPERNAISMTSTVNAYFGSKILSPSTGIVLNNEMDDFSMPRNVTKDVPPPAPANFIMPGKRPLSSMSPTIALKDGKLKAVVGASGGAFIIGGTAEVLLNHFVKGMDPFSSVTAPRVYHQLLPNVVNYENWTTLGEHFELPADIREALKSKGHVLKGLAGGTICQFIVLDNSVPSRQNKGIGNGKLVAVSDPRKGGFPAGF

SEQ ID NO: 82239 - protein, 355 aa, Oceanicola granulosus HTCC2516
MSRTTSGRGRLYESVTDTIGDTPVIRLNRIAPEHVTIYVKVEAFNPAGSVKDRLAVSIIEEAEASGALAPGQTVVEATSGNTGIGLAMACAATGHPLVVTMADSFSIERRKLMRFLGAKVVLTPRADKAVGMYKKAVELAEANGWFMARQFETPANALIHANTTAREILADFDGQRLNYFVTGYGTGGTFNGVAKVLKAERPDVKIVLTEPANAALVGSGTAQARGEGGSPASGHPAWEPHPIQGWTPDFIPAVLQEALDRGDHDALIPVTGADGMTWAQRLAREEGIFVGISAGATLAAAVAAAGEAPEGSVMLVMLPDTGERYLTTPLFEAIPEEMTGEEQALSRSTPGYQLA

SEQ ID NO: 82240 - protein, 272 aa, Oceanicola granulosus HTCC2516
MAAPHPKPTELDPVWQRIRQEATAAIDAEPLMGGLVHATILHHQTFENALAYRVALKLASAEMSEQILREIADDAYARAPDLTAAARADLTAVFERDPACHRFMQPLLYFKGYQAIQAYRLGHWLWEQGRKDIAYFIQMRVSEIFGVDIHPNALVGRGIMIDHAHSIVIGETAVVGDNVSMLHSVTLGGTGKEDDDRHPKIEDGVLIGAGAKVLGNIRIGHCSRIAAGSVVLHEVPPCKTVAGVPARIVGEAGCDQPSLSMDHLIRSGSVGP

SEQ ID NO: 82241 - protein, 329 aa, Physcomitrella patens subsp. patens
FGSGGSGNSTLRDEAEQQRYLELERLHASTRAAKHFQRDVVKAVEGIISTGAKQLEVTTKLAEDCRKYGSEAPSGITEALSRATLQYSSARNRMDTERDNMHRALAAQVSEPLKTMVAGSPLVDARHLKQKYDRLHESADAQAAEVNRRRSKEGGGNSDNAAKLQSAEQKLDQITAAMNTMGTSAIFAMNKVESQQQTVTLHRMLAMVEAERAYFQTVCSVLDQLHADIQSEVSMAPAESSSVATAPPTPPQIFQRTKNVADDDKAPVTPEFQSYKAIVTMDHDGVDEGELTISVGDEVLVRHEDPSGWSEGVCNGNEGWFPSSYVERR

SEQ ID NO: 82242 - protein, 362 aa, Vitis vinifera
MAESSSFPSVPPILSVQELAKEPMTAVPQPFILDDPELPLDLSKRASLPTIPTIDMKHLIMSETTDFELENLHSTCREWGAFQLVNHGVSSSLMEKLKSEIGKFYRLPLEEKMKYKIRPGSVEGYGLSLIRSQDQKLDWGDRFYMITNPFHRRNPHLLSELPPSLRDTLESYLSEMQKLAMTLLGFMAKALNLDKRDMEELFDDGMQSVRMTYYPPCPQPELVMGLTPHSDASGITVLLQVNGVDGLQVKKDGVWIPVNFLPDAFVVNLGDILEIVSNGIYNSIEHRAVANSVTERISIAMFFNTKFSAEIGPAIGLINPQNPPLFKRVGMEKYFRDFFARKLEGKAYLEYMKIKNGEGDTA

SEQ ID NO: 82243 - protein, 440 aa, Oryza sativa Japonica Group
MPVNMISKLLEKAVLPALDVAPPVKIGGPRRTSVLRNPNMEKLQKGYLFPEISIKREEHLKKYPDAKVISLGIGDTTEPIPSIVTSAMAEYALALSTPEGYQGYGPEQGHKNLRKEIADKVYPDMGIKESEVFISDGAQCDIARLQTLFGPNVTIAVQDPTFPGYVDNGVIMGQTGKADDGGRYAGIEYMRCAPENAFFPDLSRVRRTDVIFFCSPNNPTGHAASREQLRQLVELARRNGSIIVFDSAYSSYISSSSSSSTPRSIYEIPGAREVAIEVSSFSKFAGFTGVRLGWAVVPDELLYSDGVPVARDFDRVVCTCFNGASGIAQAGGVACLSTEEGRGAVARVVGVYRENARVLVETFRSLGKEVHGGGDAPYVWVRFPGRRSWDVFAEILEKTHVITVPGSGFGPGGEGFIRVSAFNSRDKVLEACQRLKSFLA

SEQ ID NO: 82244 - protein, 168 aa, Glycine max
  misc_feature (89)..(89): Xaa can be any naturally occurring amino acid
  misc_feature (140)..(140): Xaa can be any naturally occurring amino acid
YQEGGGNSTQAPIPSLVIRLPPDLPKLASPSDPGMKENIESFTFADDISSMIADRRFLPQFRPEIMPLLSSIRRKINILGTILDSLKSXFGQFLQRTMRVNEMRKLQHMLSILKCKFQHMGKIFHMFNFPNREDLLGQSXMPHDMCRISGLDNQGIVGPQRKIPKNGI

SEQ ID NO: 82245 - protein, 528 aa, Zea mays
MNLGDVMALLTASVSCILMLGGDGCCADHGWAGSGWGGCSTPTGLVPRAPASWSVGLELLPGIRRSLPAPQLSLGYGDTFSPAPFPTFMASSWPFDIIQELVVCRYEHGKKVDARLVIFDFAWRAWRGRDEFGYGSRVAYFISGTCDDDLTKLLEEYDEATKDRLQSLKIRYPFYVSLLNSKSNKQQKKIRGKYYLVDAGYTNGPGFLAPYRSTRYHLNEWAIQGNNPSTARELFNLRHATARNVIERTFGLLKMRWAILRTSSYFDLENQDKKTRGYVPWNDEMDKVLLDTFVDYYNKGDRCQNGWKFHVYTAAVKNVCEKCNVTITKENISSRSKTFDKHYNIINGLLSTSGFGWDWEKNKLKVDSDTVWDEYVERNKEAKGYRHKVVKFWDLLSLVYNKDQANGEGAKTAAESSKEMAKENDTGGKDAPYSVSSSSSLKRQRSDDSFNSIWCDKFDMLTSALKDDGPKLPSSAEVLAALQEVEGLDEDTELELYDILTSNARKFESMMALPMERRKRWLMMQLRK

SEQ ID NO: 82246 - protein, 435 aa, Zea mays
  misc_feature (297)..(297): Xaa can be any naturally occurring amino acid
MTIGNVLNSLKQFQSFILNYYYAIKESSELFDSDVNDINPTSCNGIMKFTDELFAKSSSVHFKAERLWMLRLLSAGSNLADDAKIYKRGRVLELALAFCSSPVSDFESKVLVLKVLENCVKLPSSSSSSRKLESSIVAVNSSDSSHIVYVCQQHRGTTDPLRQSWGQVATMIGIANIFDEALSSSKESCSSASASVKVRALCSFFEEKTSTSAIAKLVDQALASGKIYDGDGFNYIKESFENGTLHLIRLLSDGGVQLSYKRTTRFTFICSIQLLLKGVSERGAKKIRVHNLTDGRXFLDGSNVGFVETLENDLLELRGKGIDAQIASGGGRMYVTMDRYEVLGEAPYKFKSALEAVKTLRAQPKANDQYLPPFVIVDDIGKAVGPVLDGDAVVTINFWADRMVMLAKALTEWSFDFDGTRSQHPLSSHMASLFS

SEQ ID NO: 82247 - protein, 290 aa, Zea mays
  misc_feature (85)..(85): Xaa can be any naturally occurring amino acid
  misc_feature (176)..(176): Xaa can be any naturally occurring amino acid
MGGGRVMATAAKVAGIGVAKGGFRGGFGVPAAANDQFIVRNTSASKPVSASISSAVHPSVEEDAVVMRKPVWEDEWEFAEVETKXSPRVVFDKPPSLQEAKEATDDLKDALNMACMEGSNEVGSVSRMFSSFQPSENRAVESAVPQVALKAFAFLSENTAAQSVVTSIASDPKVWXDAVMENKDLMKFLETNTASTKDEADNDDKSELSSETESEEDSEEKPIQLMEILRDMKLKAVQMMENVSSYFGGLFRTETFTEGGQERKRMLLNDPTTLFGLAVCVIFMVVLKRA

SEQ ID NO: 82248 - protein, 454 aa, Actinobacillus pleuropneumoniae serovar 1 str. 4074
MTIKTPVQAVLASNQYFLDRQDAMESNVRSYPRKLPFAYQKAQGVWVTDVEGNEYLDFLAGAGTLALGHNHPVLMQSIKDVLDSGLPLHTLDLTTPLKDAFTEELLSFFPKDQYILQFTGPSGADANEAAIKLAKTYTGRGNVIAFSGGFHGMTHGALSLTGNLSAKNAVQNLMAGVQFMPYPHEYRCPFGIGGEVGAKAVEHYFENFIEDVESGVVKPAAVILEAIQGEGGVVPAPISFLQKVREVTQKHGILMIVDEVQAGFCRSGKMFAFEHAGIEPDVVVMSKAVGGSLPLAVLAIRKEFDAWQPAGHTGTFRGNQLAMATGYASLKIMREENLAQNAQERGEYLTNALRELSKEFPCIGNVRGRGLMMGIDIVDERKPQDATGAYPQDGELAVAIQKACFNNKLLLERGGRGGNVVRVLCAVNINQAECEEFIKRFKQSVADALKAVRG

SEQ ID NO: 82249 - protein, 321 aa, Calystegia soldanella
KGQNPVFPRILGHEAAGIVESVGEGVTDLKAGDHVLPVFTGECKECRHCKSEESNMCDLLRINTDRGVMLEDQKSRFSINGKPIYHFVGTSTFSEYTVCHVGSVAKITPLAPLDKVCILSCGISTGLGATLNVAKPPKGSTVAVFGLGAVGLAAAEGARMAGASRIIGVDLVPSRFELAKKFGVTDFVNPKEHSKPVQEVIVEMTDGGVDRSVECTGNVNAMISAFECVHDVWGVAVLVGVPHKDAEFKTHPMNLLNERTLKGTFFGNYKPRSDLPSVVEKYMNKELELEKFITHEVPFAEINKAFDLMLKGEGLRCIITM

SEQ ID NO: 82250 - protein, 364 aa, Chlamydomonas reinhardtii
MTASTVATEQAAEADSAELLSQHADSMPVAPSPSTRPRLQTSPAMQLPPNPAAARPLLSVAPIWRSGHVWISCVGSRCRLGVDECDSYAQLHEFVKGLSPHQNRTVPPLRHQWAWALARDFPHLQFSLNGGLQTCHDARAALLTAHPEVPYTRPRLPHPGDPRAVAAAVCATATPTFTPLAIPPSLPPSSSSPAPAPSSTTGTGTEAQPAASTSNGSSQSPAGNGGGGVEGGHGSSQFPAGNGGGLEGVMIGRGAYNDPWGCLADADRCLWGDDSNAAPNRRCGSKRWKAAVDEVLKANPATFGEVLDKTLHLIPDELPELELAQQSNSASVMAGLFEPGPAGFRRQQTMRQDALPVSHALCCC

SEQ ID NO: 82251 - protein, 461 aa, Dehalococcoides sp. VS
MLENAKYIKTEELLDQTQKLYDEGAIFCTASCIDLGDEFEVIYHYNLENGLRMKHLRLKIDKNETVPSISNIYLCASLIENEMQELYQLKLSKIAIDFSGGFLVTKETPKSYMIKAPDYKLIPVERLTAPCQRTCPAGIDVSRYVRLCGEGNYDAALAVIKQAMPFPGILGRVCLAPCESACRQGKCGESISIKQLKRAAYEYGHYTDTITAKPTGKKVAVVGSGPAGLAATYFLTKKGHKVTVFEALPKAGGYMRVGIPEYALPRQILDAEIENVAKLGVEFKLGTAVNSLHSLKEMGFDATLLALGANQGVRRSNIIAAFSGAADVFKKFGLAVENINGSNVLKVDDDTLSTSQEGVFACGDAVNGPTSVIHAVASGKKAAASIDKYLGSDGKWVYENIVAHEPISRDTFLERILPKSKPLSVKYDIKQAKERNEETAGYSREVAAAEGKRCWRCDLEE

SEQ ID NO: 82252 - protein, 349 aa, Actinobacillus pleuropneumoniae serovar 1 str. 4074
MMKMRAAVVAPQCDGTVEIVERDIPEIKNGEALVEVEYCGVCHTDLHVAAGDYGKKPGRILGHEGIGIVKSIAPDVTNLKVGDRVSIAWMFESCGSCEYCTTGRETLCRSVKNAGYTVDGGMATHCVVTADYAVKVPDGLDPAQASSITCAGVTTYKGIKVSGVRAGQWIAIYGAGGLGNLAVQYAKKVFGARVIAIDINDDKLAFAKEVGADLTINPLKEDSVQVIQEKVGGAHAAVVTAVSKVAFNAAVNCVRAGGRVVAIGLPPETMDLSIPRIVLDGIEIVGSLVGTRQDLAEAFQFGAEGLVVPLVQLRRLDEANDIFQEMRDGKIQGRMVIDMKKGCGCGCSH

SEQ ID NO: 82253 - protein, 321 aa, Calystegia soldanella
KGQNPVFPRILGHEAAGIVESVGEGVTDLKAGDHVLPVFTGECKECRHCKSEESNMCDLLTINTDRGVMLEDQKSRFSINGKPIYHFVGTSTFSEYTVCHVGSVAKINPLAPLDKVCILSCGISTGLGATLNVAKPPKGSTVAVFGLGAVGLAAAEGARMAGASRIIGVDLVPSRFELAKKFGVTDFVNPKEHSKPVQEVIVEMTDGGVDRSVECTGNVNAMISAFECVHDVWGVAVLVGVPHKDAEFKTHPMNLLNERTLKGTFFGNYKPRSDLPSVVEKYMNKELELEKFITHEVPFAEINKAFDLMLKGEGLRCIITM

SEQ ID NO: 82254 - protein, 355 aa, Zea mays
MVSAVLRTILVTGGAGYIGSHTVLQLLQQGFRVVVVDNLDNASEAALARVAELAGHDGANLVFHKVDLRDRHALVDIFSSHRFEAVIHFAGLKAVGESVHKPLLYYDNNLVGTITLLEVMAANGCKKLVFSSSATVYGWPKEVPCTEEFPLCATNPYGRTKLVIEDICRDVHRSDPDWKIILLRYFNPVGAHPSGYIGEDPCGVPNNLMPYVQQVAVGRLPHLTVYGTDYSTKDGTGVRDYIHVVDLADGHIAALRKLYEDSDKIGCEVYNLGTGKGTSVLEMVAAFEKASGKKIPLVFAGRRPGDAEIVYAATAKAEKELKWKAKYGIEEMCRDLWNWASKNPYGYAGSRDNSK

SEQ ID NO: 82255 - protein, 313 aa, Wolbachia endosymbiont of Drosophila simulans
MSFSSLQDKKMKSSEFLKGEVSFEQKAEILFEVLSNIPSFVGETFVIKCGGTIILDETLFNTFVHNVVLLKQLGINPVIIHDGEYEINSVLKVLGMDSKFVNGIRLTDRDTMKIIEMALCGSVNKKIVQHINSAGGSAIGLCGKDGNLIKVEKITATLREDRSNNIEKILDMGFIGRPTEINPDILFFIEESDFIPVIAPIGHGKDGETYHIDADSTASAIAIAVSASKMIILSDTDEEIDKIGGRKISVKNLNASIDCGKIKGEKFIERLMAYVKMAEECAGVVHIVDGRIPNIMLDLFTESNSSISIVSDL

SEQ ID NO: 82256 - protein, 579 aa, Coccidioides immitis RS
MAARRAVSRTIPTLSSRTLSSPRSSLSYLSSRTTSSSQALRPMAAARRLHATAQQLMPAATTSAASTATEYPTTHERIASPIDTCNFIDNKFVPSKATQWIDLHDPATNNLVTRVPQSTSEEMKAAVESAQKAFPAWRTTSIMARQQIMFKYVNLIRANWDRLAASITLEQGKTFADAKGDVLRGLQVAETACGITTQMTGELLEVAKDMETRTYREPLGVVAAICPFNFPAMIPLWCIPIATMTGNTLILKPSERDPGAAMILVELAKEAGFPDGVINVIHGAAKAVDFILDEPAIKAISFVGSNRAGEYIYTRGSANGKRVQANLGAKNHAAVLPDCNKNHALNAIVGAAFGAAGQRCMALSTLVMVGETKEWLPEIAERAKALNVNGGFEEGADLGPVITPASKQRIEEIIASAEKEGAKILLDGRGYKPAKYPNGNWVGPTIITGVKPHMTCYREEIFGPVLVCLEVDTVDEAIALINANEYGNGAAVFTRSGPTATRFQHELEAGQLGINVPIPVPLPMFSFTGNKKSIAGGGANTFYGKPGLNFYTQLKTVTSLWRSEDAINTKASVVMPTHQ

SEQ ID NO: 82257 - protein, 579 aa, Coprinopsis cinerea okayama7#130
MAGSLDSVAQQIFRLLDDVTDGQLKSSLSTPSNSTEPAILPIPTSFSITSILTLLLSFSALRNYIKFAFLGTILETARRWAFYYWYKISNAFFINVHLEDDDEPYDWMMVWLSRQPEWRSAKHIEVTTDDWGLDTNASHIEGEEDDPTDALHRTSGLNFIPTISTPTTLWYKGRYWMYVSRQIREAKGPYDSATKILDLRIMAWDSRKVLNDLLREAKKLYKESQENNVCIYTADLSNYWKLLACRPKRPLDSIVLDPGVKTLILDDALDFMLSKNWYIKRGIPFRRGYLLHGPPGTGKTSIIHALAGELGLNVYIISLSRCGMDDNTLGDIISRLPERCIALMEDIDAAFSRTLNRDGGSDSGSDDGEKSTPTSRVSLSGLLNALDGVGAQEGRILFATTNKYGTLDPALTRPGRMDVHVEFKLASRLQAKELYKRFYLPDEEATRISEEGLIKGSEADSPEVDGKTLPIGGDEKTGASEEPLPIAPHKRRAPKLSLEQVEGLSTEFASFIPERELSMASIQGYLMIYKTRPFEAVKDAPEWVVKERKAAALREESEKRRKDNEPEAKDSTEKGSDES

SEQ ID NO: 82258 - protein, 232 aa, Dechloromonas aromatica RCB
MRSKPFRSITMTQDELKQAVAQAAADYVAQTAPAGSIIGVGTGSTANFFIDALAPLKDKYKGAVASSEATRKRLEGHGIAVYDLNDVEDIPVYVDGADEIDAGLNMIKGGGGALTREKIVAAVAREFVCICDGSKLVDTMGKFPLPVEVIPMARAHVARELAKLGGTPVLREGFVTDNGNIILDVKGLSITDPKGLEAQINQITGVVTNGLFAVRPANLLLLGTADGVRTIR

SEQ ID NO: 82259 - protein, 331 aa, Streptococcus pyogenes MGAS10394
MSIRSLFGGLREKILGKNMKIVFPEGNDERVVRAAARLKFEGLLEPIILGQSEEVRNLLTKLGFADQDYTIINPNEYADFDKMKETFVDVRKGKATLEDADKMLRDVNYFGVMLVKMGLADGMVSGAIHSTADTVRPALQIIKTKPGISRTSGVFLMNRENTSERYVFADCAINIDPTAQELAEIAVNTAETAKIFDIDPKIAMLSFSTKGSGKAPQVDKVREATEIAKGLNPDLALDGELQFDAAFVPETAAIKAPDSAVAGQANTFIFPDLQSGNIGYKIAQRLGMFDAIGPILQGLNKPVNDLSRGSSAEDIYKLAIITAAQAIESQG

SEQ ID NO: 82260 - protein, 373 aa, Sulfolobus solfataricus P2
MMLIPGPVNVPYSVLQASLNLVNHRSEKFRETVKTLEFLMNKHFGSTRVALLSGSGTLAVESMVYSLVKREEKVITFPYGEFGHRLEESLIRRGAKVISYQKKLGESFTVEEIKKAIEENKDATTVALVHNETSTGIAFRDLKKIADVVKGVGLKLLVDSVSGFAAYPLYVNQWKIDCVVTGSQKALASIPGVGFAALSEEGVNELVESDLPSYLDLSFHLKFQDKGETPFTPTVGAFFASRRAAELLDKEGIENRWKRHEACARYLREVMLEMGFKLLGNDTNFSNTVVAAFPPIPLDTFMSELKKRNIEISKGMGELRDKIVRIGILGVVDDRAIRRLVGSMGEILKKNVEFEVPRECKLPEELKVEVLWD

SEQ ID NO: 82261 - protein, 364 aa, Vitis vinifera
MASTGSLSFGSAPLILSVQELAKEPMAAVPQPFLLNDQELPVDLPKSTSVITIPTIDMKHLTMSETTDFELEKLHSTCKEWGLFQLVNHGVDSSLVDKLRSEIEEFYKLPLEERMKYKMRPGDVEGYGLSLIISGDQKLDWGDRFYMITNPIHRRKPHLLPELPPSLRDALERYLSELQKLAMTLLGFMAKALKLDDGEMEGLVDDGMQAVRMTYYPPCPQPDLVMGLTPHSDATVITILLQVNGVDGLQIKKDGFWRPVNFLPDALVVNVGDILEMVSNGVYTSIEHRAIVNSARERISMAMFFNPKFSAEIGPAVSLINPQNPPLYRRVGMEKYFKDFFSRKLDGKSFLEHMKIKNGEGNNA

SEQ ID NO: 82262 - protein, 359 aa, Vitis vinifera
MASTQFSSIRAAPVQSVQELIKEPIPAVPQPFILDDPQPPILSASTPLPQLPTIDMKHLIMSETAGSELEKLHSTCKEWGFFQLVNHGVSSSFMEKLKSEIGEFYKLPLEERMKYKMRPGDVEGYGLSPIRSEDQKLDWGDRFYMTTNPIHTRKPYLLPELPPALRDSLECYLAELQKLAMMLLGFMAKALKLEKGEMEELFDDGMQSVRMTYYPPCPQPELVMGLTPHSDATGITILLQINGVDGLQIKKDGVWIPVSFLPDALVVNVGDILEILSNGVYTSIEHRATVNAAKERISIAMFFNPKSSAQIKPAASLINPQNPPLFKQVGMEKYFKDFFSRKLDGKSYLEHMKIKNEEA

SEQ ID NO: 82263 - protein, 362 aa, Vitis vinifera
MASTQSSSFRAAPIQSIQELIKEPIPAVPQPFILDDPQPPILSANTPLPLLPTIDMKHLIMSETAGSELEKLHSTCKEWGFFQLVNHGVNSSLVEKLKSEIGEFYKLPLEERMKYKMRPGDVEGYGHLPIRSEDQKLDWADRFYMITNPIHTRKPYLLPELPSSLRDSLECYLAELQKLAMMLLGFMAKALKLEKGEMEELFEDGMQSVRMSYYPPCPQPELVMGLTPHSDATGITILLQINGVDGLQIKKDGVWIPVSFLPDALVVNVGDVLEILSNGVYTSIEHRATVNAAKERISIAMFFNPKFSAQIKPAPSLINPQNPPLFKQVGMEKYFKDFFSRKLDGKLYLEHMKIKNEEDYST

SEQ ID NO: 82264 - protein, 362 aa, Vitis vinifera
MASTQFPSFRAAPVQSVQELIKEPIPAVPQPFILDDPQSPILSASTPLPLLPTIDMKHIIMSETADAELEKLHSTCKEWGFFQLVNHGVSSSLVEKLKSEIGEFYKLPWEERIKYKMRPRDFEGYGLSPIRSEDQKLDWGDRFYMTTNPIHTRKPYLLPELPPSLRDSLECYLAELQKLAMMLLGFMAKALKLEKGEMEELFEDGMQSVRMTYYPPCPQPELVMGLTPHSDATGITILLQINGVDGLQIKKDGVWIPVSFLPGALVVNIGDILEILSNGVYTSIEHRATVNAAKERISIAMFFNPKSSAQIKPATSLINPHNPSLFKQVSMEKYVKDFFSRKLDGKWYIEHLKIKNEEEYRT

SEQ ID NO: 82265 - protein, 264 aa, Solanum tuberosum
MAELREKWSLKGTTALVTGGSKGIGYAIVEELANFGARVYTCSRNENELQECLDIWRKKGLKVEGSVCDLLSRTEREKLMKTVEDVFDGKLNILVNNAGVAIHKEAKDFTKEDYNIIMGTNFEAAYHLSQIAYPLLKASQNGNVIFVSSIAGFSALPSLSLYSASKGAINQMTKNLACEWAKDNIRVNSVAPAVILTPLVETAIKKNPQQKEEIDSFVVKTPLGRAGKPEEASAVIAFLCFPAASYITGQIIWADGGFTANGGF

SEQ ID NO: 82266 - protein, 120 aa, Brassica napus
MALRTAVLRHLRVPVTGSNQSQIGFLGPIRAFSSHDDHLSKQEVVDRVLDVVKCFPKVDPAKVTPDVHFQKDLGLDSLDTVEIVMAIEEEFKLEIPDKEADKIDSCPLAIEYVFNHPMSS

SEQ ID NO: 82267 - protein, 534 aa, Parachlorella kessleri
MAGGGVVVVSGRGLSTGDYRGGLTVYVVMVAFMAACGGLLLGYDNGVTGGVVSLEAFEKKFFPDVWAKKQEVHEDSPYCTYDNAKLQLFVSSLFLAGLVSCLFASWITRNWGRKVTMGIGGAFFVAGGLVNAFAQDMAMLIVGRVLLGFGVGLGSQVVPQYLSEVAPFSHRGMLNIGYQLFVTIGILIAGLVNYAVRDWENGWRLSLGPAAAPGAILFLGSLVLPESPNFLVEKGKTEKGREVLQKLCGTSEVDAEFADIVAAVEIARPITMRQSWASLFTRRYMPQLLTSFVIQFFQQFTGINAIIFYVPVLFSSLGSANSAALLNTVVVGAVNVGSTLIAVMFSDKFGRRFLLIEGGIQCCLAMLTTGVVLAIEFAKYGTDPLPKAVASGILAVICIFISGFAWSWGPMGWLIPSEIFTLETRPAGTAVAVVGNFLFSFVIGQAFVSMLCAMEYGVFLFFAGWLVIMVLCAIFLLPETKGVPIERVQALYARHWFWNRVMGPAAAEVIAEDEKRVAAASAIIKEEELSKAMK

SEQ ID NO: 82268 - protein, 703 aa, Debaryomyces hansenii CBS767
MSGTSTPRKRTLGDLNDGEVPNFEDPLDVVNAVISTLQTPVEKTNVAMTYANDKNLATEVQAYAKIAGQDWTYYVKSLSIPIGRNTDNPGGSSQPLVDIDLGPAKVVSRQHAMITYNLDLRYWELKVLGRNGARVDGQKVPFGENHSTPLHSGAILDIGGTQMMFILPDSPPNILQKMLSTCLAKYNANLNKSKRKSISDFPQQHTIPINPSNQIKSFQMFDKAQLTQSPSSASATSLQNNLDQDLSKEEAKDIKPPYSYATMITQAILSNDDGVMSLSEIYNWIASHYAYYKYSKTGWQNSIRHNLSLNKAFEKVPRRPNEPGKGMKWQISESYKEDFLTKIQSGSLLKARRGSSVSRQLQLHLATHQNLPESQKYYAKDDPSRSNSFDQRFNHERNSSLPKLGQPMQYQQAPSNPMQHNPLSYISNQQPQNGSFGVPPPRSYGYQHPPPPQLMYGSHMMHQNQNDSPSIQQVPGNKNELSSPIRQLSDINTTTPKLPKVSGNHLFNLPPPPPSTHSMGTSAPQAHHSRLNSYNHQHQLTENNSNSYNTSGNNQTSESNTTNTNAQNVSSGPTTNTSDLALGFTSPKKIAPLEAFTPERGSKSSSNKLGVANGVNTNQSSPAFWNFVQFSTPNAQTPLKGNDQNNQLSPTLNRRVFGSNGYAKEKSEKGDLSPLKSRNSHDDNSKADNADELNTQKNEEINA

SEQ ID NO: 82269 - protein, 359 aa, Vitis vinifera
MASTQFSSIRAAPVQSVQELIKEPIPAVPQPFILDDPQPPILSASTPLPQLPTIDMKHLIMSETAGSELEKLHSTCKEWGFFQLVNHGVSSSFMEKLKSEIGEFYKLPLEERMKYKMRPGDVEGYGLSPIRSEDQKLDWGDRFYMTTNPIHTRKPYLLPELPPSLRDSLECYLAELQKLVMMLLGFMAKALKLEKGEMEELFEDGMQSVRMTYYPPCPQPELVMGLTPHSDATGITILLQINGVDGLQIKKDGVWIPVSFLPDALVVNVGDILEILSNGVYTSIEHRATVNAAKERISIAMFFNPKSSAQIKPAASLINPQNPPLFKQVGMEKYFKDFFSRKLDGKSYLEHMKIKNEEA

SEQ ID NO: 82270 - protein, 355 aa, Vitis vinifera
MALTQSSSFRAPIQSVQELIKEPIPAVPQPFILDDPQPPILSASTPLPLLPTIDMKHLIMSETAGSELEKLHSTCKQWGFFQLVNHGVSSSLVEKLKSEIGEFYKLPLEERMKYKMRPGDVEGYGHLPIRSEDQKLDWADRFYMITNPIHTRKPYLLPELPSSLRDSLECYLAELQKLAMMLLGFMAKALKLEKGEMEELFEDGMQSVRMTYYPPCPEPELVMGLTPHSDATGITILLQINGVDGLQIKKDGVWIPVSFLPDALVVNVGDVLEILSNGVYTSIEHRATVNAAKERISIAMFFNPKFSAQIKPAPSLINPQNPPLFKQVGMEKYFKDFFSRKLDGKSYLEHMKIKK

SEQ ID NO: 82271 - protein, 383 aa, Candidatus Kuenenia stuttgartiensis
MIYLDNAATSYPKPEIVYTSMDTFYRTMGANPGRSGHRMAVTVEREIENTRKIIADFLAIKDPNRFVFTFNATDAINMGIKGLLKTGDHAITSYLEHNAVSRALNGLAQDNKITVTKVKNSSDGFINPDDVKNAITPKTRLIVLTHATNVLGTIQPIKEIGLIAKERDIVFMVDAAQTTGVCEIDVNECNIDMLAFTGHKAPFGPTGTGGLYIHERIKLRPWREGGTGFEPASLTQPEEMPFRLESGTPNTVGIVGLKAGIEYVVSKGTHTIRAHERKLIQKIINALQNDERFILYGTKDVSRKVGILSINIKGYTAAEAGAILDQSFTIAVRPGLHCAPFVHQQMGTYPDGTIRISPGFFNTEEEIDILISALNDIANETIH

SEQ ID NO: 82272 - protein, 429 aa, Vitis vinifera
MDLENSIYGYLHEGGEIVPKEDKQIQYKGGQQKGMYIGQGMSYAEFVSKACERLDINSNGYTFHYTLEFDPSALQQLDDDEDMHMIVQELIKEPIPAVPQPFILDDPQPPILSASTPLPQLPTIDMKHLIMSETAGSELEKLHSTCKEWGFFQLVNHGVSSSLMEKLKSEIGEFYKLPLEERMKYKMRPGDVEGYGLSPIRSEDQKLDWGDRFFMVTNPIHTRKPYLLPELPPALRDSLECYLAELQKLAMMLLGFMAKALKLEKGEMEELFDDGMQSVRMTYYPPCPQPELVMGLTPHSDATGITILLQINGVDGLQIKKDGVWIPVSFLPDALVVNVGDILEILSNGVYTSIEHRATVNAAKERISIAMFFNPKSSAQIKPAASLINPQNPPLFKQVGMEKYFKDFFSRKLDGKSYLEHMKIKNEEA

SEQ ID NO: 82273 - protein, 430 aa, Candidatus Kuenenia stuttgartiensis
MSILVVGLNHKSAPVDIREKLAFNNNSVSNALSLFSQKYPSSEAVILSTCNRVEMYASSASDAVKLEDILSFLAEFHKIEENEFSQYMYHYKDDRAVMHLFHVSSSIDSMVIGESQILSQVKEAYTLASMEQSTGKILNQLFQQALNISKTIHTNTSIGQGKVSISSVAVEFAEKIFQDFAGKMVLVVGAGEMCELLLKHLYEEGARTIIVANRTFERAQAIADAFQGEAIKYELLGEYLSKTDIIITSTSAPHYVIHSDQVKDAIKHRRGNPMFLIDIAVPRDIEPSVGNIDNVYLYNIDDLQSVVNQNLDDRTREIEKCRAIIEKEVEHFMAKLEQIKIEPAITLLRNSFHTIGKDELSRLKPKLRNINDEEWNQVVYTMERTLNKLLHHPAKIAKQEASNGGGYRYVETIKKLFGVFHHHSSEDSNK

SEQ ID NO: 82274 - protein, 616 aa, Streptomyces avermitilis MA-4680
MNTRQLTELGQQLRVDSVRAADAASSGHPTSSMSAADLMAVLLAHHLRYDFDRPAHPGNDRFILSKGHASPLLYAAYKAAGAIDDAELLTFRELGSRLEGHPTPRRLPWVETATGSLGQGLPVGVGIALSGKRLERTGYRVWVLCGDSELAEGSVWEAAEHAGYEHLDNLTAIVDVNRLGQRGPTRHGHDLDAYARRFQAFGWHTIEIDGHDVDAVDRAYGEAESTSGQPTVILARTLKGKGVAAVEDREGLHGKPLPDAEEAIAELGGVRELRIEVQDPPAARVLHAVAAPGQVELPRYDKGDEVATRDAYGQALTALGGAREDVVAIDGEVGDSTRSEYFAKEYPDRYFECYIAEQQMVAAAVGLAARGWVPYAATFAAFLTRAHDFVRMASISGAGINLVGSHAGVSIGQDGPSQMGLEDLAMFRSVYDSTVLYPCDANQTAKLVAAMAGLDGVRYLRTSRGASPVLYGPDEEFPVGGSKVLRSSGEDRLTLVAAGVTVHEALAAADSLAEAGIRARVIDLYSVKPVDRDTLRQAAEDTGCLLTVEDHREEGGIGDAVLDAFLDGRPVPRLVRLAVRTMPGSASPAEQLHAAGIDAESIATAARLLVEQAVVR

SEQ ID NO: 82275 - protein, 366 aa, Listeria monocytogenes str. 1/2a F6854
MVFGELIGWLLGWALILEYGLAVASVASGWSSYLNALLSGFHISIPEAISGPFNPEVGTFINLPAIIIVLVIAFLLTLGIKESTRVNTIMVVIKVGVILLFLVVGVFYVKPDNWQPFMPFGISGVMNGAALVFFAYLGFDAVSSAAEEVKDPQRTMPIGIIGSLLICTVLYVAVSAVLTGMVPYTDLNVTDPVAYALQVINQDWVAGIVSLGAVVGMITVILVMSYGATRLIFAMGRDGLLPKVLAEINQKYQTPVKNTWIFAVIVAIISGLVPLDRLAELVNIGTLLAFMMVSIGIIFLRKNKDIQSRGFKVPLYPVLPIVSFLLCAFLISRLSVHTWILCGIWFVIGLIVYFAYGRKHSELLKK

SEQ ID NO: 82276 - protein, 295 aa, Zea mays
MSPATMLLLPSTDLVLNLTLRLIVIWTRGAAEAVASVLRRADREATEATCGCSRCSTASRRKARGRLVKSVVVSGSGSTAHHGMAELENEECFSHNVEYEGDTVHVSFVVIKADTPWHYSEEGVDLVVKDPNGAQVRDSRDKTSDKFEFIVQKRGVHRFCFTNKSPYHETIDFDVHVGHFSYFEQHAKDEHFAPLFEQIAKLDEALYNIQFEQHWLEAQTDRQAICVEFKVKAVLNFCCGELNKPHAFVGPVNENMSRRAVHKALFESAALIVASVIQVYLLRRLFELKLGTSRV

SEQ ID NO: 82277 - protein, 261 aa, Vicia faba
AHIITAVIGSGVLSLAWAIAQLGWIAGPSMMLLFSFVTYYTSTLLSACYRTGDQLNGKRNYTYTDAVRAYLGGFKVKICGLVQYVNLFGVAIGYTIAASISMMAIKRSNCFHSSGGKDPCHMNGNLYMISFGIVEIFFSQIPDFDQLWWLSTLAAVMSFTYSTIGLGLGVGKVIENKGIKGSLTGITVGTVTQTQKVGRSFQALGNIAFAYSYSMILIEIQDTIKSPPSESKTMKAATLISVVVTTIFYMLCGCLGYAAFG

SEQ ID NO: 82278 - protein, 321 aa, Calystegia soldanella
KGQNPVFPRILGHEAAGIVESVGEGVTDLKAGDHVLPVFTGECKECRHCKSEESNMCDLLRINTDRGVMLEDQKSRFSINGKPIYHFVGTSTFSEYTVCHVGSVAKINPLAPLDKVCILSCGISTGLGATLNVAKPPKGSPVAVFGLGAVGLAAAEGARMAGASRIIGVDLVPSRFELAKKFGVTDFVNPKEHSKPVQEVIVEMTDGGVDRSVECTGNVNAMISAFECVHDVWGVAVLVGVPHKDAEFKTHPMNLLNERTLKGTFFGNYKPRSDLPSVVEKYMNKELELEKFITHEVPFAEINKAFDLMLKGEGLRCIITM

SEQ ID NO: 82279 - protein, 1118 aa, Hordeum vulgare subsp. vulgare
MDCLRLAVAAAALLLAALAAAADDAQLLDEFRMALPSQAPLEGWTAREGACRFPGAVCRGGRLTSLSLAAVTLNADFRAVANTLLQLSAVERLSLRGANVSGALAAARCGGKLEELDLSGNAALRGSVADVAALAGSCGALRTLNLSGDAVGAAKPAGGGGGGQGFAALDALDLSSNKIAGDADLRWMVGAGLGSVRWLDLAWNKISGGLSDFTNCSGLQYLDLSGNLIAGDVAAAALSGCRSLRALNLSSNHLAGAFPPNIAGLTSLTALNLSNNNFSGEVPADAFTGLQQLQSLSLSFNHFSGSIPDSVAALPDLEVLDLSSNNFSGSIPDSLCQDPNSRLRVLYLQNNYLSGSIPEAVSNCTDLVSLDLSLNYINGSIPESLGELSRLQDLIMWQNLLEGEIPASLSSIPGLEHLILDYNGLTGSIPPELAKCKQLNWISLASNRLSGPIPSWLGKLSNLAILKLSNNSFTGKIPAELGDCKSLVWLDLNSNQLNGSIPPELAEQSGKMTVGLIIGRPYVYLRNDELSSQCRGKGSLLEFSSIRSEDLSRMPSKKLCNFTRMYMGSTEYTFNKNGSMIFLDLSFNQLDSEIPKELGNMFYLMIMNLGHNLLSGAIPTELAGAKKLAVLDLSHNRLEGQIPSSFSSLSLSEINLSSNQLNGTIPELGSLATFPKSQYENNSGLCGFPLPPCESHTGQGSSNGGQSNRRKASLAGSVAMGLLFSLFCIFGLVIIAIESKKRRQKNDEASTSRDIYIDSRSHSGTMNSNWRLSGTNALSINLAAFEKPLQKLTLGDLVEATNGFHNDSLIGSGGFGDVYKAQLKDGRVVAIKKLIHVSGQGDREFTAEMETIGKIKRRNLVPLLGYCKIGEERLLMYDFMKYGSLEDVLHDRKKIGVRLNWAARRKIAIGAARGLAFLHHNCIPHIIHRDMKSSNVLVDENLEARVSDFGMARMMSVVDTHLSVSTLAGTPGYVPPEYYQSFRCTTKGDVYSYGVVLLELLTGKPPTDSTDFGEDHNLVGWVKMHTKLKITDVFDPELLKDDPTLELELLEHLKIACACLDDRPSRRPTMLKVMTMFKEIQAGSTVDSKTSSVATGLSDDPGFGVMDMTLKEAKEEKD

SEQ ID NO: 82280 - protein, 396 aa, unidentified eubacterium SCB49
MNLHEYQAKQILNSFGVEIQRGIVATTPEEAVAAAKKLTEDTGTGWHVLKAQVHAGGRGKGGGVKLAKSLDDVERIAGEIIGMDLVTPQTSAEGKRVHQILVTEDVYYPGDSEPEEYYMSVLLNRATGRNMVMYSTEGGMDIETVAEETPHLIFHEEIDPATGLLPFQARKIAFNLGLSGMAFKQMTKFVTALVSAYEKSDSALFEINPVLKTSDDKIIAVDAKVTLDANALYRHKDYIEMRDKREENPVEVEAGEVGLNYVDLDGNVGCMVNGAGLAMATMDLIKQAGGEPANFLDVGGTADAERVEAAFKLILKDPNVKAILVNIFGGIVRCDRVAQGIVDAYKNMGNIEVPIIVRLQGTNADIAKELIDGSGLDVQSAIEFQEAADKVQAVLA

SEQ ID NO: 82281 - protein, 478 aa, Arabidopsis thaliana
MWALLIWVSLLLISITHWVYSWRNPKCRGKLPPGSMGFPLLGESIQFFKPNKTSDIPPFIKERVKKYGPIFKTNLVGRPVIVSTDADLSYFVFNQEGRCFQSWYPDTFTHIFGKKNVGSLHGFMYKYLKNMVLTLFGHDGLKKMLPQVEMTANKRLELWSNQDSVELKDATASMIFDLTAKKLISHDPDKSSENLRANFVAFIQGLISFPFDIPGTAYHKCLQGRAKAMKMLRNMLQERRENPRKNPSDFFDYVIEEIQKEGTILTEEIALDLMFVLLFASFETTSLALTLAIKFLSDDPEVLKRLTEEHETILRNREDADSGLTWEEYKSMTYTFQFINETARLANIVPAIFRKALRDIKFKEFVNDTDYTIPAGWAVMVCPPAVHLNPEMYKDPLVFNPSRWEGSKVTNASKHFMAFGGGMRFCVGTDFTKLQMAAFLHSLVTKYRWEEIKGGNITRTPGLQFPNGYHVKLHKKRD

SEQ ID NO: 82282 - protein, 1101 aa, Arabidopsis thaliana
MATLISVDFQHCFMYIILLCLFSLLCYSLFFRKPKGTRVGCDLPPSPPSLPIIGHLHHLLSSLTHKSLQKLSSKYGPFLHLRIFSVPIILVSSASVAYEIFKAHDVNVSSRGAAAIDESLLFGSSSFIYAPYGDYWKFMKKIFATKLLRPQVLENSRGVRAEELKRFYRRILDKARKNENIEISKESAMLMNNILCRMSMGRSFSEENGEAERVRGLVGESYALVKKIFFAATLRRLLEKLRIPLFRKEIMGVSDRFDELLERIIVEHKDKLEKEHQVMDMMDVLLAAYRDKNAEYKITRNHIKSFFVDLFVGGTDTSVQTTQWTMAEIINNPNILQTLRKEIDSVVGKSRLIHETDIPNLPYLQAVVKEGLRLHPPGPLLIRTFQERCEMKGFYIPEKTTLVINAYAVMRDPDSWEDPDEFKPERFLSYSRSGQEDEKEQTLKYLSFGGGRRGCPGVNLGYIFVGTAIGMMVQCFDWKIEGDKVNMEETYGGMNLTMAKVSVNKSWIPLTSLVAAKTFSGGVATELVNSLSLASSQAPSQDPKKVIEIYVPLTVLANHVIFAYTCLSIFDVSQDLSILTKTFQLLIAMTTTEFQSCFIFLLLCLFSLVCYSLFFRKPSSRRDAHGCDLPPSPPSLPVIGHLHLILSSLVHKSFQKISSNYGPLLHLRIFNVPIVLVSSASVAYDIFRVHDLNVSSRGSPPFEESLLFGSTGFISAPYGDYFKFMKKHLVTKLLGPQALERSRLIRTNELERFYINLLDKATKKESVEIGKEAMKLSNNSICKMIMGRSCLEEKGEAERVRGLIIESFYLTKKFFLAFTLRGLLEKLGISLFKKEIMGVSRRFDDLLERYLREHEEKPDNEHQDTDMIDALLAAYRDEKAEYKITRNQIKAFLVDIFIAGTDISALTTQGTMAEIINNPNIFVRIREEIDSVVGKSRLIQETDLPKLPYLQAVVKEGLRLHPPTPLMVREFQEGCKVKGFYIPASTTLVVNGYAVMRDPNVWEDPEEFKPERFLASSRLMQEDEIREQALKYIAFGSGRRGCPGANVAYIFVGTAIGMMVQCFDWRINGEKVDMKEAIGGLNLTLAHPLKCTPVARFPKPF

SEQ ID NO: 82283 - protein, 542 aa, Coccidioides immitis RS
MSYGGGYSSSRDHYGGGHHSGGRSGGYGGSNGYSHGNSNGYGSYGGNSHGSGVGSHGGGHHGDRMSNLGSGLKQQEWDLNALPKFEKHFYKEHPNVTNRSAQDVEAFRKEHEMTVYGKNVPRPVETFDEAGFPQYVISEVKAQGFAKPTPIQSQGWPMALSGRDVVGIAETGSGKTLTYCLPAIVHINAQPLLGPGDGPIVLVLAPTRELAVQIQAEITKFGKSSRIRNTCVYGGVPRGPQIRDLSRGVEVCIATPGRLIDMLEAGKTNLRRVTYLVLDEADRMLDMGFEPQIRKIIGQIRPDRQTCMWSATWPKEVRQLAHDFLHDYIQVYIGSQDLSANHRITQIVEIVSDFEKRDRMINHLERIMDDKKSKILIFTGTKRVADDITRFLRQDGWPALSIHGDKQQNERDWVLNEFKTGKSPIMVATDVASRGIDVRDITHVLNYDYPNNSEDYVHRIGRTGRAGAKGTAITLFTTDNAKQARDLVNILTESKQQIDPRLAEMARFGGGGGGGGRWGGRGRGRGGFTASNAAPLGHNRRW

SEQ ID NO: 82284 - protein, 422 aa, Wolbachia endosymbiont of Drosophila simulans
GKPCICSVSGLYIDKDGTLFSVGDTKVNKGEPITINGGTGEVMLGILPTISPELSQEFKTVINWIDEIKTVKVRANADTPKDAKIAKEFGAEGIGLCRTEHMFFASDRIEFIQKLIIADDENERANALIKLEEMQKSDFKEIFSIMEGREVTIRLLDPPLHEFLPNDQSTIEKIAKSLSKSVESVKNKIAQLSEKNPMLGHRGCRLAISHPEIYSMQIRAILSAASELKKEKKIEVEPEIMIPFIMSEKEFILICELAKKESSVISQTQIPASRAGMTSDKAYSIGTMIELPRAALIADKLAKHAEFFSFGTNDLTQTTMGLSRDDSVNFLDSYKKNNIFDNDPFEVLDIEGVGELIKMAIERGKKTRKEIKLGICGEHGADPKSIEFLIESGVDYVSCSPYRVPIAKLVAAQFSVRSKFAR

SEQ ID NO: 82285 - protein, 336 aa, Mycobacterium avium 104
MKLAVIGGDGIGPEVTAEALKVLDAVLPGVDKTEYDLGARRYHATGELLPDSVIDELRAHDAILLGAIGDPSVPSGVLERGLLLRLRFELDHHINLRPGRLYPGVSSPLAGNPDIDFVVVREGTEGPYTGTGGAIRVGTPNEVATEVSQNTAFGVRRVVVDAFERARRRRKHLTLVHKTNVLTFAGKLWSRIVAEVGRDYPDVEVAYQHIDAATIFMVTDPGRFDVIVTDNLFGDIITDLSAAVCGGIGLAASGNIDGTRTNPSMFEPVHGSAPDIAGQGVADPTAAIMSVALLLAHLGEDAAATRVDRAVERYLATRGNERPATTEVGERIAAAL

SEQ ID NO: 82286 - protein, 226 aa, Photorhabdus luminescens subsp. laumondii TTO1
MKDFLIAPSILSANFARLGEDTDKVLAAGADVVHFDVMDNHYVPNLTIGPMVCQALRDYGITAPIDVHLMVKPVDRIIPDFAKAGATYITFHPETSEHIDRSLQLIKEHGCKAGLVFNPATPLSHLDYVLDKLDIILLMSVNPGFGGQSFIPGTLEKLRQVRKIIDESGYDIRLEVDGGIKASNIAAAATAGADMFVAGSAIFSQPDYKTVIDNMRSELSKVSHGK

SEQ ID NO: 82287 - protein, 450 aa, Pseudomonas fluorescens PfO-1
MDVSVFGTGYVGLIQAAALADVGHRVLCVDIDPNKIKQLQQAVPPISEPGLSATLEENIKAGRLLFSTQASDAVEHAGLIFIAVGTPADEDGSADLSHVLNVARQIASCMEDDRTLIIKSTVPVGTADQVLHTAEEELQRRGKNGLAVRVVSNPEFLKEGSALADCMRPDRIIVGTLDPEAREQMSELYAPFCRNHEKLMFMDNRSAELTKYAANAMLATRISFMNELANLTELLGADIEAVRKGIGSDPRIGYHFIYPGCGFGGSCFPKDLRALLHTAEHNGMPLKLLRSVTDVNDAQRHILFSKLRAQFPQGLAGKSIAIWGLAFKPNTDDMREAPSRYLMEALWAEGASVQAYDPEAMSECRRIYGYRNDLHLCATRDDTLEDADALVICTEWKNFRVVDFELLAEKLRAKVIVDGRNLYNPEQVAAAGLHYSGIGLRHIAPDEGRP

SEQ ID NO: 82288 - protein, 371 aa, Zea mays
MVSDQEIASCVESVLRGSAGGPGEVSLTAVLQQAEATLGVDLSHKAGFIRDQMDLFFGPRLQPQPLTTPQLAPPPPQAVVAPADAVPQPQPQHQVLPQAPPSAQQMQPQPQQLTSLQQQLMFQTIHQLPAIAPVLVVSSPPAVPAMAFYPPPPLAFRYTTGLAGAAAGGTVSFQQSAPGAGGTASPTAAPQVTGDNKESSSKRKRGGPGGLNKVCAISPELQTIVGETAMSKTQIVKQLWAYIRQNNLQDPDDKRKIICNDELRVVFETDNTDISVLEFAQVLPNDIAEGQLHEVKRMKAPTMSPQPGRSIDQPSIVISDALAKFIGTDGTFPHDFALKYLWDYIKANQLEAAMADAERCGWHCVDICLLD

SEQ ID NO: 82289 - protein, 362 aa, Vitis vinifera
MASTQFPSFRAAPVQSVQELIKEPIPAVPQPFILDDPQPPILSASIPLPLLPTIDMKHLIMSETAGSELEKLHSTCKEWGFFQLVNHGVSSSLVEKLKSEIGEFYKLPLEERIKYKMRPGDFEGYGLSPIRSEDQKLDWGDRFYMITNPIHTRKPHLLPELPSSLRDSLECYLAELQKLAMMLLGFMAKALKLEKGEMEELFEDGMQSVRMTYYPPCPQPELVMGLTSHSDATGITILLQINGVDGLQIKKDGVWIPVSFLPDALVVNVGDVLEILSNGVYTSIEHRATVNAAKERISIAMFFNPKFSAQIKPAPSLINPQNLPLFKHVGMEKYCKDFFSRKLDGKSYLEHMKIKNEEEYSI

SEQ ID NO: 82290 - protein, 666 aa, Neurospora crassa
MDGSLMAALPQGQDVIRVISTGGVTKVVKIAECNTCEEVMRVTLRKFGLREDHERNYCFWVLAGVDPDPNQCRRLGDTELWRVIKDHTRPERNRLILRRVPSGEPGKAELERAAAIAMEEAQQTHRPPIEPSDKRSQLKLQKVLGVGWEDLQQQPPLSPMSYQDRERNVSNAARDLERPAPLETPRAMPRRTQALRQFGGLRPPSELIASDLTSYFPDHSREAIDRTARLSMRRSARLSRVNHRLSVASTLSFASSIQDAPPIPTIADSWLTASNQIAKVRPRDVLPRAPHGYRDSVASSVLDTLQEEGSPTEPNRRSFVPFSDSGSDTAAVSVIDPDGNIVRHSYYDSGTNNSADSAVIQEALAEDGEDAADKELQTFLAGDAWDDSMWMKGSLIGQGSFGSVYLALHAITGELLAVKQVETPAPGADSKNDARKKSMIEALKREITLLRDLQHPNIVQYLGCSSSAEYLNIFLEYVPGGSVQTMLDQYGALPESLVRSFVRQILQGLSYVHNRDIIHRDIKGANILVDNKGTIKISDFGISKKLEATNILNGANNNKHRPSLQGSVFWMAPEVVKQTSYTRKADIWSLGCLVVEMMTGTHPFPDCTQLQAIFKIGGSKASPTIPDNASEEAKQFLAQTFEIDHNKRPSADELMLSPFLTPVPGT

SEQ ID NO: 82291 - protein, 338 aa, Shigella flexneri 2a str. 2457T
MRVLVTGGSGYIGSHTCVQLLQNGHDVIILDNLCNSKRSVLPVIERLGGKHPTFVEGDIRNEALMTEILHDHAIDTVIHFAGLKAVAESVQKPLEYYDNNVNGTLRLISAMRAANVKNFIFSSSATVYGDQPQIPYVESFPTGTPQSPYGKSKLMVEQILTDLQKAQPDWSIALLRYFNPVGAHPSGDMGEDPQGIPNNLMPYIAQVAVGRRDSLAIFGNDYPTEDGTGVRDYIHVMDLADGHVVAMEKLANKPGVHIYNLGAGVGSSVLDVVNAFSKACGKPVNYHFAPRREGDLPAYWADASKADRELNWRVTRTLDEMAQDTWHWQSRHPQGYPD

SEQ ID NO: 82292 - protein, 356 aa, Vitis vinifera
MASIQSSSFRAAPIQSVQELIKEPIPAVPQPFILDNPQPPILSASTPLPLLPTIDMKHVIMSETAGSELEKLHSTCKEWGFFQLVNHGVNSSLKIGEFYKLPLEERMKYKMRPGDVEGYGHLPIRSEEQKLDWADRFYMITNPIHTRKPYLLPELPSSLRDSLECYLAELQKLAMMLLGFMAKALKLEKREMEELFDDGMQSVRMTYYPPCPQPELVMGLTPHSDATGITILLQINGVDGLQIKKDGVWIPVSFLPDALVVNVGDVLEILSNGVYTSIEHRATVNAAKERISIAMFFNPKFSAQIKPAPSLINPQNPPLFKQVGMEKYFKDFFSRKLDGKSYLEHMKIKNEEDYST

SEQ ID NO: 82293 - protein, 374 aa, Coprinopsis cinerea okayama7#130
MTAAILDNALGAVGHTPLIRLDKIAKAYDLKCNLLGKVEYMSAGGSVKDRIAKAMVEAAEREGKLIPGKSVVIEPTSGNTDKGYSVIITLPNKMSLEKEALLRALGAEVIRTPTEAAWDAPESHIGVAQRLQREIPHAIILDQYKNVNNPLAHEYTTGPEIVAAVEATPSTSAHPSSGKVDVIVAGAGTGGTVTGLSRAIKKKHNKECIVVAADPKGSVLALPNNLNDEDAGAMYVVEGIGYDFVPDVLTRDPTEIDYWLKTGDEESFDAVQQLMRKEGLLVGGSSGSALSGALRWLKSDAGRPIAETEGKNVVVLLPDGIRNYMSKPWFLKIAMEAEPSPLAGTIAQILKKPEASKTPSAPTIAQSPSSQTSH

SEQ ID NO: 82294 - protein, 353 aa, Vitis vinifera
METDSQKVVLGKSIIVPSVSELVKESITKVRPRYVYHEQDPPTAADGEIWLQAIPVIDLHGLLHGDSMDSELERLHAACKDWGFFQVVNHGVSSSLLEEFKGEVQDFFLLPLEEKKKLWQQPDNHQGFGQLFVVSDEQRLDWSDVFYLTTLPLNLRKSDIFQKLPQKLRGSLEAYRIEMKSFKDEAEEIRDMFTDGFQSMRMNYYPPCPEPDMTIGLTPHSDAGALTILLQLDDTDGLQIRKEGRWIPVKPLPNAFVINVGDIMEIVSNGVYHSIEHRVMVNSAKERLSVATSNSSNINSELGPAPSLISPQNPAKFQRVPTEKYYKDFFARKLDGKSHLKFLKIDQDGGHTS

SEQ ID NO: 82295 - protein, 242 aa, Brassica napus
  misc_feature (161)..(161): Xaa can be any naturally occurring amino acid
MVKICCIGAGYVGGPTMAVIALKCPSVEVAVVDISVPRITAWNSDQLPIYEPGLDDVVKQCRGKNLFFSTDVEKHVREADIVFVSVNTPTKTRGLGAGKAADLTYWESAARMIADVSVSDKIVVEKSTVPVKTAEAIEKILTHNSKGIKFQILSNPEFLAXEGTAIEDLFKPDRVLIGGRETPEGFAAVKALKDIYSQWVPEERILTTNLWSAELSKLAANAFLAQRISSVNAMSALCEATG

SEQ ID NO: 82296 - protein, 275 aa, Parvularcula bermudensis HTCC2503
MATWGYRGTAVITGAGSGIGRALAFALAEKGMDLALVDIREDRLEELRQALASNQRKVTIYARDVADRDAMRRLPSDVAADHDQVSVLVNNAGVALGGQFDQVAEDDFDWLMNINFRSVVDLTRAFLPHLREAARARIVNTSSLFGIIAPPGQAAYSASKFAVRGFSEALRHELDGSNVGLTVVHPGGIATNIATDARIKIDAPPEEIEKRKQSMNKLLRLSPEKAAKAIVEGVEKHRGRVLIGNDAKAAALVARLFPETYYRLIGMQMKGNDGT

SEQ ID NO: 82297 - protein, 298 aa, Vitis vinifera
MGSELERLHSACKDWGFFQVVNHGVSSSLLEEFKGEVQDFFELPLEEKKKLWQQPDNHEGFGQLFVVSEEQRLDWSDMFYLTTLPFNLRKSDIFQKLPQKLRETLEAYSVEMKKLAMTILSQMTKALKMKAEEIRDMFSDGVQSMRMNYYPPCPEPDMTIGFAPHSDADALTILFQLNDTEGLQIRKEGRWVPVKPLPNAFVVNIGDIMEIVSNGIYQSIEHRAMVNSAKKRLSVATFFSSNLDSELGPAPSLISPQNPAIFQRVPIEKYFKDFFARRLDGKSYLKFMKIDEDGGHTS

SEQ ID NO: 82298 - protein, 381 aa, Oryza sativa Indica Group
MASSTQGQVITCKAAVAWEANKPMTIEDVQVAPPQAGEVRVKILFTALCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 82299 - protein, 288 aa, Triticum aestivum
MEAKEEDVRLGANKYSERQPIGTAAQGSEDEDYKEPPPAPLFEPGELKSWSFYRAGIAEFVATFLFLYVTILTVMGYSGATSKCATVGIQGIAWSFGGMIFALVYCTAGISGGHINPAVTFGLFLARKLSLTRAVFYIIMQCLGAICGAGVVKGFQQGLYMGNGGGANVVAPGYTKGSGLGAEIIGTFVLVYTVFSATDAKRNARDSHVPILAPLPIGFAVFLVHLATIPITGTGINPARSLGAAIIYNREHAWSDHWIFWVGPFIGAALAAVYHQVVIRAIPPKTKS

SEQ ID NO: 82300 - protein, 366 aa, Vitis vinifera
MDAQKLTSLGGSLMVPSVQELAKKTLTTVPPRYLRPEQDPPFLSDSSTTCSSIHVPVIDFHRLVSGDVLDSELDKLHYACKDWGFFQLTNHGVSSTLVERVKVEVQEFFNLPMEEKKKFWQEPEDLEGFGQAFVISEEQKLDWADMFYMITLPTYLRKPHLFPKLPISLRDSLEIYAVELRNLAMTILGFIAKALKMEANDMKELFEEGHQGMRMNYYPLCPQPDQVIGLTPHSDAVGLTILLQVNEMEGLQIRKDGMWVPIKPLPGAFIVNMGDILEIVTNAAYRSIEHRATVNSIKERLSVATFYSPKLNGDMGPAPSLVSPDSPSLFKRIGVADYFKGLFSRELHGKSYLEVLRTETGEAQNN

SEQ ID NO: 82301 - protein, 351 aa, Schizosaccharomyces pombe
TFSLPLLQSFIMSSYILFGLENPLLDYYVGGETATLEKYGLKSNDAVLASESQMGIYKEPCVSYSAGGAAQNSCRAAQYVLPPNSTVFAGCVGQDKFADMLLESNEKAGLRSEFSVDPTTPTGVCAVVLSNNNKNRSLCTNLGAANNYKLKDLQQPNVWKFVEEAKVIYVGGFHLTVSPESMLCLAQHANENNKPYIMNLSAPFLSQFFKEQMDSVIPYCDYVIGNEAEILSYGENHGIKSTDVQEIALALSSVEKVNKKRTRVVVITQGADATIVAKDGKVTTYKPNRVPSEEIVDTNGAGDAFAGGFIAALSQGQGIDYAVTLGHWLGQECIKVSGTTLPLPKKQFPLP

SEQ ID NO: 82302 - protein, 214 aa, Candidatus Kuenenia stuttgartiensis
MFFVINIPPNTLEILPFQSYSCNKALPCLQDLGDTISFRIRMLFNVRFTAGDVTDIHMKIELIVTGKTEDDYLKRGISVYANRLKHYCAFNIAEISSVKPISSKSSEDVKEREAVALEKLLAPTDFVVLLDEKGRELTSVEFADFLQQKMNTGVRAVKFVSGGAYGIATQIKKRANFTLSLSLMTFSHQMVRLFFVEQLYRAMTIIRNEKYHHE

SEQ ID NO: 82303 - protein, 315 aa, Physcomitrella patens subsp. patens
SKFRNSLKKRRGCGVHRSKNLSLPIEDIRDSKDQQAVEELRRELNSRNLLPDDHDDYHVLLRFIKARKYDIKKTAEMWKNMLAWRTEFGTDTIDEDFVFTEIDKVRNYYPQGYHGVDKEGRPVYIERIGKIHAQNLMEVTTLDRYLKYHVQEFEKLLNLKFPACSVAANRPIHTTTTILDVAGVGLKNFCKPARDLIVAIQKVDNDNYPETLAQLFIVNAGPGFKMLWGTIKGFLDPHTAAKIHVIGNNYQKKLLEIIDESNLPDFLGGSCKCPEEEGGCMQSDMGPWRDPDVLKVIRDCSICDRILNLHIILAL

SEQ ID NO: 82304 - protein, 321 aa, Calystegia soldanella
KGQNPVFPRILGHEAAGIVESVGEGVTDLKAGDHVLPVFTGECKECRHCKSEESNMCDLLRINTDRGVMLEDQKSRFSINGKPIYHFVGTSTFSEYTVRHVGSVAKINPLAPLDKVCILSCGISTGLGATLNVAKPPKGSTVAVFGLGAVGLAAAEGARMAGASRIIGVDLVPSRFELAKKFGVTDFVNPKEHSKPVQEVIVEMTDGGVDRSVECTGNVNAMISAFECVHDVWGVAVLVGVPHKDAEFKTHPMNLLNERTLKGTFFGNYKPRSDLPSVVEKYMNKELELEKFITHEVPFAEINKAFDLMLKGEGLRCIITM

SEQ ID NO: 82305 - protein, 242 aa, Brassica napus
MQKEKLRERITALERELGQKQDLELVVEHLKRQLSVMRHMELDGGTEIVNKVETYLRDLSEKEGELAHVNKFNQDLVVRERKTNDELQEARRALISNLRDMRSHIGVRRMGELDTKPFMEAMRRKYCQEDLEDWAVEIIQLWEEYLKDPDWHPFKRIKLDAAETIVEVIDEEDEKLRTLKIELGDDAYQAVANALQEINEYNPSGRFVSSELWNFREERKATLEEGVTCLLEQWNQAKRHRP

SEQ ID NO: 82306 - protein, 439 aa, Wolbachia endosymbiont of Drosophila simulans
MNIGSGRVVIQSLQRINQEIGTIENNVNLQSFISNLKSKNGVCHIMGLVSDGGVHSHQKHISTLANKISQHGIKVVIHAFLDGRDTLPNSGKKCIQEFIKSIKGNDIRIATVSGRYYAMDRDNRWERTIEAYEAIAFAKAPRHDNAVSLIDENYQNNITDEFIRPAVIGDYQGIKPEDGVLLANFRADRMIQLASILLGKTDYAKVAKFSSILSMMKYKKDLQIPYIFPPTSFADTLGQTIEDNKLQQLRIAETEKYAHVTFFFNCGKEEPFSGEERILIPSPKVQTYDLQPEMSAFELTEKLVEKIHSQEFALIVVNYANPDMVGHTGNIKAAEKAVLAVDDCLAKVLSAVKKSSNTALIVTADHGNVECMFDEENNTPHTAHTLNKVPFIVSCDNLKLRDGRLSDIAPTILQLLGIKKPDEMTGSSLISCITLCHSS

SEQ ID NO: 82307 - protein, 87 aa, Zea mays
FPLAFEWCQEGEKPKPGRKPDIFPKFPPKKTPLPHPLPAEDPLDEDEKEKEKQPPPQGEPQKDDPNTEKQNFPPIWRNKQQKQPYFC

SEQ ID NO: 82308 - protein, 310 aa, Escherichia coli O157:H7 EDL933
MLDANKLQQAVDQAYTQFHSLNGGQNADYIPFLANVPGQLAAVAIVTSDGNVYSAGDSDYRFALESISKVCTLALALEDVGPQAVQDKIGADPTGLPFNSVIALELHGGKPLSPLVNAGAIATTSLINAENAEQRWQRILHIQQQLAGELVALSDEVNQSEQTTNFHNRAIAWLLYSAGYLYCDAMEACDVYTRQCSTLINTVELATLGATLAAGGVNPLTHKRVLQADNVPYILAEMMMEGLYGRSGDWAYRVGLPGKSGVGGGILAVVPGVMGIAAFSPPLDEEGNSVRGQKMVASVAKQLGYNVFKG

SEQ ID NO: 82309 - protein, 430 aa, Escherichia coli O157:H7 EDL933
MMNTEGNNGNKPLGLWNVVSIGIGAMVGAGIFALLGQAALLMEASTWVAFAFGGIVAMFSGYAYARLGASYPSNGGIIDFFRRGLGNGVFSLALSLLYLLTLAVSIAMVARAFGAYAVQFLHEGSQEEHLILLYALGIIAVMTLFNSLSNHAVGRLEVILVGIKMMILLLLIIAGVWSLQPAHISVSAPPSSGAFFSCIGITFLAYAGFGMMANAADKVKDPQVIMPRAFLVAIGVTTLLYISLALVLLSDVSALELEKYADTAVAQAASPLLGHVGYVIVVIGALLATASAINANLFAVFNIMDNMGSERELPKRMNKSLWRQSTWGNIIVVVLIMLMTAALNLGSLASVASATFLICYLAVFVVAIRLRHDIHASLPILIVGTLVMLLVIVGFIYSLWSQGSRALIWIIGAILLSLIVAMVMKRNKTV

SEQ ID NO: 82310 - protein, 474 aa, Brassica napus
  misc_feature (44)..(44): Xaa can be any naturally occurring amino acid
  misc_feature (422)..(422): Xaa can be any naturally occurring amino acid
MVHTILADPLLGINQETVAETKKHRNNLRLALTLLLLTLVSISXLGLSDNITVWLAREATNRHSHATRSDAVESENGVVAADDGRCSDIGVSVLRRGGHAVDAAGATSLCVGVVNPMSSGIGGGAFLIVSSMEDSKAEAFDMRETAPLAASKDMYKSDEDAKSIGALSMGVPGEIAGLYEAWKRYGRLPWKPLFEPAIELARGGFVVAPYLGRAISKHSSMILKDPGLRNVFSRNGQVLNPGETCYNPELARSLEMISELGPVAFYNGTVGENFVNDVKKAGGIITMDDLRSYKVRVTNAMASDVMGYKIYGMPPPSSGTVGFSMVMNILDSFSELYTGSGTDLGLHRLIEAMKHMFAARMDLGDPEFVNITNAMKQMLSKPRAESIRERILDNTTFPPEYYLNRWSQLRDQGTSHFIVVDXTRNAVSMTTTVNFVFGAGVLSPSTGIVLNNEMGDFSVPTENTPDDLPPAPTN

SEQ ID NO: 82311 - protein, 322 aa, Vitis vinifera
MECVMLSSHGGLCDASYDVVSNSPVQPDKVIIDTDPGIDDSMAILMAFQTPELEILGLTTVFGNVTTKDATRNALLLCEIAGRPDVPVAEGSSGPLKGGEPRVADFIHGSDGLGNIFLPQPKAKKIEKNAAEFLVDKVSEYPGEVSILALGPLTNVALAIKRDSSFASKVKKVVVLGGAFFALGNVNPAAEANIYGDPEAADVVFTSGANIVVVGINITTQIKFTDADLHQLRHSEGRYAQFISDICKFYRDWHVKSDGVYGIFLHDPVSFAALVRPDLFTYKEGVVRVETQGISFSINCIDYMEFKQPVDWLFSCLSCLDS

SEQ ID NO: 82312 - protein, 523 aa, Candida tropicalis
MATQEIIDSVLPYLTKWYTVITAAVLVFLISTNIKNYVKAKKLKCVDPPYLKDAGLTGISSLIAAIKAKNDGRLANFADEVFDEYPNHTFYLSVAGALKIVMTVDPENIKAVLATQFTDFSLGTRHAHFAPLLGDGIFTLDGEGWKHSRAMLRPQFARDQIGHVKALEPHIQIMAKQIKLNQGKTFDIQELFFRFTVDTATEFLFGESVHSLYDEKLGIPTPNEIPGRENFAAAFNVSQHYLATRSYSQTFYFLTNPKEFRDCNAKVHHLAKYFVNKALNFTPEELEEKSKSGYVFLYELVKQTRDPKVLQDQLLNIMVAGRDTTAGLLSFALFELARHPEMWSKLREEIEVNFGVGEDSRVEEITFEALKRCEYLKAILNETLRMYPSVPVNFRTATRDTTLPRGGGANGTDPIYIPKGSTVAYVVYKTHRLEEYYGKDANDFRPERWFEPSTKKLGWAYVPFNGGPRVCLGQQFALTEASYVITRLAQMFETVSSDPGLEYPPPKCIHLTMSHNDGVFVKM

SEQ ID NO: 82313 - protein, 643 aa, Coprinopsis cinerea okayama7#130
MAAPLDVAQQVFALLNGGALGSQQHVACVNNTLNGTATSFVPPTSAALPTSFDIHSILTFIFSFSALREWVKLAAIGAVLETFRRFVFHFYYKIWDAFFITVLFEDDDVAYGQARNIEISSKTFGLNTSATQIEGEELDPMDALASTRALNYVPSVHTAFTFWYKRRWVRITRGVRESNNYWNARAEQLWVCIFSMDHRILNQMLLEAKKAHKEAQENNISIYASDSNNQWRYIASRPKRPLTSIVLDPGVKDVILDDARDFMLSKSWYTTRGIPFRRGYLLYGAPGTGKTSIIHSLAGELGLNVYIISLSRSGLDDNALSELIADLPEQCIALMEDIDAAFSQTLNRDADESDGNKNNQQNAGPAPKTTSRISLSGLLNALDGVGAQEGRILFATTNKYTSLDPALCRPGRMDVHVEFKLASKYQARELFRRFFLPDSVDEVVKKESEKEKDVDSGYASCADGGDSEKAALIQAAKENEEVKPEQVSAVVQSSHRRRGPRLSSQEVEELAAKFADAVPEREFSMATLQGYLMTYKIRPCAAVEEAANWVAGRRAEAAAKAEKEKKEKEEAEKKEAERKQKEEEEKRKKEEEEKKKKEEEEEKRRKEEEREKRRKEREENKAKKKKSKKETEDEDSATSSWED

SEQ ID NO: 82314 - protein, 522 aa, Candida tropicalis
MTVHDIIATYFTKWYVIVPLALIAYRVLDYFYGRYLMYKLGAKPFFQKQTDGCFGFKAPLELLKKKSDGTLIDFTLQRIHDLDRPDIPTFTFPVFSINLVNTLEPENIKAILATQFNDFSLGTRHSHFAPLLGDGIFTLDGAGWKHSRSMLRPQFAREQISHVKLLEPHVQVFFKHVRKAQGKTFDIQELFFRLTVDSATEFLFGESVESLRDESIGMSINALDFDGKAGFADAFNYSQNYLASRAVMQQLYWVLNGKKFKECNAKVHKFADYYVNKALDLTPEQLEKQDGYVFLYELVKQTRDKQVLRDQLLNIMVAGRDTTAGLLSFVFFELARNPEVTNKLREEIEDKFGLGENASVEDISFESLKSCEYLKAVLNETLRLYPSVPQNFRVATKNTTLPRGGGKDGLSPVLVRKGQTVIYGVYAAHRNPAVYGKDALEFRPERWFEPETKKLGWAFLPFNGGPRICLGQQFALTEASYVTVRLLQEFAHLSMDPDTEYPPKKMSHLTMSLFDGANIEMY

SEQ ID NO: 82315 - protein, 116 aa, Zea mays
HASAHASAHASAHASAHASAHASATNEPGALMNLVEESTADDADDDDTKDCKGLFKNLKFYLSREVPRESLLFIIPAFGGTVSWEGEGAPFKEIDEDITHQVDSICNNLLHQSLTI

SEQ ID NO: 82316 - protein, 446 aa, Oryza sativa Indica Group
MATGRRLSMILLLLLLGLASGDKILFQGFNWESWRQSGGWYNLLMGKVDDIVAAGVTHVWLPPPSHSVSTQGYMPGRLYDLDASRYGTSMELKSLISALHGKGIQAIADVVINHRCADYKDSRGIYCIFEGGTPDGRLDWGPHMICRDDTQFSDGTGNLDTGADFAAAPDIDHLNGVVQRELTDWLLWLKSDEVGFDAWRLDFARGYSPEVAKVYIEGTTPVGLAVAELWDSMAYGGDGKPEYNQDAHRQALVDWVDRVGGTASAGMVFDFTTKGIMNTAVEGELWRLIDQQGKAPGVIGWWPAKAVTFVDNHDTGSTQQMWPFPSDKVMQGYAYILTHPGNPCIFYDHFFDWGLKEQIAALVAVRQRNGVTATSSLKIMLHDADAYVAEIDGKVVMKIGSRYDVSSLIPPGFHLAAHGNGYAVWEKSAAAAAAAADHRTSSSASL

SEQ ID NO: 82317 - protein, 522 aa, Candida tropicalis
MTAQDIIATYITKWYVIVPLALIAYRVLDYFYGRYLMYKLGAKPFFQKQTDGYFGFKAPLELLKKKSDGTLIDFTLERIQALNRPDIPTFTFPIFSINLISTLEPENIKAILATQFNDFSLGTRHSHFAPLLGDGIFTLDGAGWKHSRSMLRPQFAREQISHVKLLEPHMQVFFKHVRKAQGKTFDIQELFFRLTVDSATEFLFGESVESLRDESIGMSINALDFDGKAGFADAFNYSQNYLASRAVMQQLYWVLNGKKFKECNAKVHKFADYYVSKALDLTPEQLEKQDGYVFLYELVKQTRDRQVLRDQLLNIMVAGRDTTAGLLSFVFFELARNPEVTNKLREEIEDKFGLGENARVEDISFESLKSCEYLKAVLNETLRLYPSVPQNFRVATKNTTLPRGGGKDGLSPVLVRKGQTVMYGVYAAHRNPAVYGKDALEFRPERWFEPETKKLGWAFLPFNGGPRICLGQQFALTEASYVTVRLLQEFGHLSMDPNTEYPPRKMSHLTMSLFDGANIEMY

SEQ ID NO: 82318 - protein, 886 aa, Triticum aestivum
  misc_feature (762)..(762): Xaa can be any naturally occurring amino acid
MAPAQCARVQRVFHFGKGKSEGNKAMKDLLGGKGANLAEMASIGLSVPPGFTVSTEACEQYQAAGRALPPGLWEETLEGLRWVEEYMGARLGDPARPLLLSVRSGAAVSMPGMMDTVLNLGLNDEVAAGLAAKSGDRFAYDSYRRFLDMFGNVVMDIPHALFEEKLEAMKATKGVDNDTDLTANDLRELVGQYKNVYVEAKGEQFPSDPKRQLQLAVLAVFDSWDSPRANKYRSINQITGLRGTAVNVQCMVFGNMGNTSGTGVLFTRNPSTGEKKLYGEFLVNAQGEDVVAGIRTPEDLDAMRDHMPEAYAELVENCEILESHYKEMMDIEFTVQENRLWMLQCRSGKRTGTGAVKIAVDMVNEALVDRNTAIKMVEPGHLDQLLHPQFANPEAASYKGKVITTGLPASPGAAVGQIVFTAEDAEAWHAQGKSAILVRTETSPEDVGGMHAAAGILTARGGMTSHAAVVARGWGKCCVSGCSSIRVNEIEKVVAIEDKMLYEGDWISLNGSTGEVILGKQPLSPPALSADLETFMSWVDEVRQLKVMANADTPGDALAARKNGAEGIGLCRTEHMFFASDERIKAVRQMIMAPTVELRQKALDRLLPYQRSDFEGIFRAMDGLPVTIRLLDPPLHEFLPEGHVEDIVRELCAETGAAEDDVLARMEKLSEVNPMLGFRGCRLGISYPELTEMQARAIFEAAISMTNQGIQVFPEIMVPLVGTPQELGHQVALIRQIANNVFTNMGKTIDYKVGTMIEIPRXAALVADEIAEQAEFFSFGTNDLTQMTFGYSRDDVGKFLPIYLAQGILQHDPFEVLDQRGVGELVKIATERGRKARPNLKVGICGEHGGEPSSVAFFAKAGLDYVSCSPFRVVPIARLAAAQVLV

SEQ ID NO: 82319 - protein, 568 aa, Coprinopsis cinerea okayama7#130
MQAAANAAQNYMGPLPTDVHPEYEPAESGEKMRALAWFGTKDVRMIDAPIPKVTEPDDVILKVTATTICGSDLHLYHGEIMALQKGEILGHEFMGVVDSVGPSVKNLEPGQRVVASFQIACGECEFCKKKISSMCDRTNPSSLQKAMYGTTDAGFFGYSHFAGGFPGGQAEYVRVPKGNVNLLPVPDDLADEQVLFLSDILPTSYHAVVDTGVEEGDTVAVWGLGPVGMYVAKFALLKGASKVIGIDQVPERLEFAEQSLGIETINFKEHKDVPARIREIIGEKGVDVCIDAGSFHEPKSFTHKVQKFLMLETDAPETINEMLLAVRKMGRCGIIAVYAGYANGVNVGALMEKGIRLIGNGQAPVHLYWKDILENYIKTGKLDPTFIISHRVGLEDLPALYAAFDARTAGVEKVVVDTKFTKALGRRSDNVPPLTRVQDWKNDPEKSSISHVEATKTPEDEARIQPLPRPNESESSLRARLVYQSRKRGTLETDLLLSTFAQENLAKMSVPELKEFDKLLDEPDWDIYYWCTGKRTPPERWAKSELLEKLRVHAQNEGKVVRRMPDLS

SEQ ID NO: 82320 - protein, 540 aa, Candida tropicalis
MSSSPSFAQEVLATTSPYIEYFLDNYTRWYYFIPLVLLSLNFISLLHTRYLERRFHAKPLGNFVRDPTFGIATPLLLIYLKSKGTVMKFAWGLWNNKYIVRDPKYKTTGLRIVGLPLIETMDPENIKAVLATQFNDFSLGTRHDFLYSLLGDGIFTLDGAGWKHSRTMLRPQFAREQVSHVKLLEPHVQVFFKHVRKHRGQTFDIQELFFRLTVDSATEFLFGESAESLRDESIGLTPTTKDFDGRRDFADAFNYSQTYQAYRFLLQQMYWILNGSEFRKSIAVVHKFADHYVQKALELTDDDLQKQDGYVFLYELAKQTRDPKVLRDQLLNILVAGRDTTAGLLSFVFYELSRNPEVFAKLREEVENRFGLGEEARVEEISFESLKSCEYLKAVINETLRLYPSVPHNFRVATRNTTLPRGGGEDGYSPIVVKKGQVVMYTVIATHRDPSIYGADADVFRPERWFEPETRKLGWAYVPFNGGPRICLGQQFALTEASYVTVRLLQEFAHLSMDPDTEYPPKLQNTLTLSLFDGADVRMY

SEQ ID NO: 82321 - protein, 512 aa, Ocimum basilicum
MAALLLLLLLPLLLPAIFLLHHLYYRLRFRLPPGPRPLPIVGNLYDVKPVRFRCFADWAQSYGPIISVWFGSTLNVIVSNTELAKEVLKEKDQQLADRHRSRSAAKFSRDGQDLIWADYGPHYVKVRKVCTLELFSPKRLEALRPIREDEVTAMVESIYHDCTAPDNAGKSLLVKKYLGAVAFNNITRLAFGKRFVNSEGIIDKQGLEFKAIVSNGLKLGASLAMAEHIPSLRWMFPLDEDAFAKHGARRDQLTREIMEEHTRAREESGGAKQHFFDALLTLKDKYDLSEDTIIGLLWDMITAGMDTTAISVEWAMAELIKNPRVQQKAQEELDRVIGYERVMTELDFSNLPYLQCVAKEALRLHPPTPLMLPHRSNSNVKIGGYDIPKGSNVHVNVWAVARDPAVWKNPCEFRPERFLEEDVDMKGHDFRLLPFGAGRRVCPGAQLGINLVTSMIGHLLHHFNWAPPSGVSSDELDMGENPGLVTYMRTPLEAVPTPRLPSDLYKRIAVDL

SEQ ID NO: 82322 - protein, 436 aa, Pseudomonas putida GB-1
QTMAEQMGGKVEGSDLREFGYARVDVVGKSRLLDGIEDHVDDNGVLGLDVWMSHGDKVTQMPGNFNILASTPSCPIAGMYDDARGYYGVQFHPEVTHTKQGGRILSRFVQDICGCEALWTASNIVEDAIAQVRAQVGSANVLLGLSGGVDSSVVAALLHRAIGDQLTCVFVDNGLLRLHEGDQVMAMFKENMGVKVIRADAEKQFLDNLEGEADPEKKRKIIGRTFIDIFDAEASKLENIQFLAQGTIYPDVIESAGAKSGKAHVIKSHHNVGGLPEEMNLKLVEPLRELFKDEVRKIGLELGLPYDMVYRHPFPGPGLGVRILGEVKKEYADILRRADHIFIKELRKADWYHKTSQAFVVFQPVKSVGVVGDGRRYTWVVALRAHETVDFMTARWAHLPYELLETVSGRIINEIDGISRVTYDVSSKPPATIEWE

SEQ ID NO: 82323 - protein, 213 aa, Debaryomyces hansenii CBS767
MASLPPAKRDIAISKSLSYLLRHGAVKEKLNIDQTGYININELLNHNRLKTNKVTLDDIRRIVGNNDKKRFSIVEKEGEIMICANQGHSIKTVNDSNLIQLSKDTIPEEIYHGTYKNKLPAIFNSGGLSKMNRNHIHFASSISDVSGIRNSSNVLIYLNIEKCLQSGIVFYRSSNNVILTSGDANGLIGLEFFGKVVDAKNGTPIDINQYANI

SEQ ID NO: 82324 - protein, 223 aa, Silicibacter sp. TM1040
MIWNLPNILTVLRLLAAPALAVMFLFFSRPHADWFALVLFVGAAITDWFDGYLARSWKQETKMGAMLDPIADKAMVVIALMILVGYSTSHWTAWLVLPATVILFREVFVSGLREYLGDTAGSLKVTKLAKWKTTAQMIAIATLFSQGIFEHHLGMGGFGMDAQMVNDVLSGVIEDTQGLRFYFEGMIWSGRIGLWLLWIAAALTLITGFDYLKKALPYLKETR

SEQ ID NO: 82325 - protein, 423 aa, Physcomitrella patens subsp. patens
MGNEEETWVVMKTARAPSNIAVIKYWGKRDEKLILPINSSISVTLDPEHLSATTTVAASPAFEKDRLWLNGKEVSVEGVRYKNCLREMRARATDVVIESSGKVIRKEDWNSLHIHIASENNFPTAAGLASSAAGFACLVYALAQLMGVQEKYEGELTAIARLGSGSACRSLYGGFVEWKMGQEIDGTDSIAVQLAEESHWKDLVIIIAVVSSRQKETSSTSGMQESVKTSPLLKYRAEEVVPKRIVQMEKAIKSMNFTEFAKITCADSNQFHATCLDTSPPIFYLNDTSRKLIGLVERWNRHAGEPQVAYTFDAGPNAVMFAKNKEVAAQLLQRLLYQFPPSADTDISRYVHGDQSILESAGVNSLKDIDSLSAPAEVAGIPNLQRIPGEVDYLICTNVGKGAYVLGEQGANLIDPVSGLLKK

SEQ ID NO: 82326 - protein, 563 aa, Triticum aestivum
MPGAVKAGSRPPWLGLGAAVWLQASAGTSSAFALYSHALKVALGADQSRVALLGVACNVGDSLGLLPGVVCNKLHPALLLLVAAASGLLGYGVTWLAVSGVAPALPYWLIWIALCMGSNSGAWMSTAALVTNMRNFPLSRGAVAGILKGYSGLSAAVYTAIYTGALHGSAANLLLFLTLGVAIVCLLAMYFVRPCEPSLVENSSERVHFLFVQINSALLGVYLVCATTLDRFVTLTPALNYSLIAIMVILILAPFAIPVKMTLFRSVPRKVTSAAADNDFTEPFLLPSSSEPNFGKIEDEDAADIDLLLAEGEGAVKQKRRRPKRGEDFRFREALLKADFWLLFAVFFIGVGSGVTVLNNLAQVGTAAGVVGTTISVSLFSLGNFFGRLGGGAVSDYFVRSRTLPRTVLITCTQVVMIVNYLVFALGLKATLYISVAILGVCYGVHFSVMVSTSSELFGLKQFGKIYNFILLANPLGALVFSSLAGYVYDHEAAKQHSVAAVAGSDHVMVCYGPSCFRLTFFVLSGMACLGTFLSVILTVRIRPVYQTLYGGGPSSQPRSSAH

SEQ ID NO: 82327 - protein, 620 aa, Bradyrhizobium sp. BTAi1
MTTDHKRPIRNPQHWASAAMPPLQRFLAACHADFGPDHDGTVANYIPELGKADPVHFGISLAALDGHVYEVGDSRVPFTIQSMSKPFVFALALDTLGSDAVEQVIGVEPSGDPFNSIRLNANNHPFNAMVNAGAIACSGLILKARGADAFESIRDALGRFAGRRLDVDDAVFASEAATGDRNRAIAYLLRTSHVIKEPVEDVLAVYFRQCAVLVTARDCAVMAATLANRGVNPVTGEQVVTPYAVSRTLSVMTSSGMYDFAGEWIYRVGIPAKSGVGGGILASLPARLGLGSYSPRLDSHGNSVRGIKVCEALSAHYGLHMLNRSDDARASIIADYDIGANPSRRSRRAQERKILAAHPDAVRVLELVGTLSFSNVDYVSRQLAGRARPQFVIFDLHRVNAMTQAGLRLLAELFHELADFHVTVVLSGIRRSSPEWQEITARTGDIRNVRDFYLLDTAIEWAEDQIVYRHGGAIDFLETTELAEQPLLAGLTEGERDELAALATIRQYRQGERILSAGDAATSLFFLRSGVVHVTLPDGIRLATLTAGQCFGEMALLEPVRSADVVADFSASAFEITLPDFERFRSSHPHAGACIMRNLAQLLADRLTVANARLNLLAAD

SEQ ID NO: 82328 - protein, 431 aa, Burkholderia cepacia
MTVPQQAFLRDAMRRLNMTREAFANRIGVSRRALDTWLLPDDSQESRGMPEIVERFVSEIVERSAPEGGSYTQSVDNQGLAKQFFFEGKPQLLSVDQFSRESVEALFRVADVMQPIARRHKISRVLEGAVLGNLFFEASTRTRVSFGAAFCRLGGSVCDTTGFTFSSMAKGESIYDTSRVMAGYVDAFVIRHPEKGSVAEFARATNLPVINGGDGPGEHPSQALLDLYTIQREFSRLGKIVDGAHIALVGDLKYGRTVHSLVKLLALYRGLKFTLVSPPTLEMPAYIVDQIATNGHVIEQTTDLAAGLRGADVVYATRIQKERFTDESFEGYTPDFQINQALVDTVCKPDTLIMHPLPRDSRPGANDLSVDLNRDPRLAIFRQTDNGIPVRMAIFAVLLGVENLVQHSMRDATWRPPAYLGPEDAVFHGVD

SEQ ID NO: 82329 - protein, 725 aa, Physcomitrella patens subsp. patens
MAGASGSASTGNGGNYGADSNWTMNSGPSHVTNGWDDPVDGWQFQPAYNSSYGDKNGKSLYDNASNRSGSSSKARSRKGNSMNRQDSGSPQSGRGGGRQGSNRNNGGSERSPGQGEAGRGGRGGRGRRGEGRGGRGKFNGGRGEFNGERGASNKPQGGWGQHNNFRQYEAAPNADYGGRGGWDGQGPLLSPENGWQQVSSKSRNGSESSSRSGAPGITNKAWHQGAKASTQLVSGSSSNLYQQGDTGTDLALEYPASPYSDSQCSDLDHVEDDSDDGFFSDDSFAQESHEDQKKIKWFRDFFQDLDSMTDAQLNEHDRQWHCPACKGGPGAIDWFRGLVPLATHARTMRSRRVKLHRKFAEILEEELRIRRSAQPNVELQSTFGKWNGLSEDTESQQKMIIWPPILVIQNTQLEQDDEGKWIGMGNKELVDMFKDYNPLKPRHAYGPQGHRGMSLLIFPDSPIGYHDAVRLATHFANSRRGRDDWQRPGKILFKPGGERILYGYLAIKDDLDIFNRHSRGKTLLKYELRKLQQVVLEPMQRMEQQNQLIQSLQIEQNTLKKSVSETSKNLQLREEELQILWDRQGKQHAENKRELADMEEFFQQESAQWANEVAAKDSELQKLRDDLHKIALNQSHELNVLRSNLPNIDQDPAMANEILQMTKKVEGSLLEAEDFENKLKELEQKHHERRVQFQKQQHEAALTFEQQIKIEMTEFLHSFEKQMRQ

SEQ ID NO: 82330 - protein, 519 aa, Bradyrhizobium sp. BTAi1
MSWQPELEELARREAFAREMGGPDKVKRQHDQGRLTVRERIDGVVDAGSFHEIGAVAGLGEYDEQGELKHVTPANCVFGRARIDGRTVVVVGDDFTVRGGSADASIAAKPLMAEEMAHDFRLPIIRIIEGSGGGGSVKTIETKGAANLPGGIGGNRWYRYTTENMSLVPVVALGLGSVAGLGAARLAASHYSVMTKQSAMFVAGPPVVKRLGQDLGKMELGGADIQTRAGGVDHAVDTEAEAFACARRFLSYLPSSVYELPPTLPCTDDPQRTDEQLISAVPRDRRRVYKMRPIIESVVDSGSFFEVAQNYGRPIIIGLARLEGRAVMVLASDPYHYGGSWTADACQKVIRWVDFAETFHLPIVYLMDCPGFMVGLEAEKAATIRHGVRAMAAVNQSTVPWCTVIVRNSFGVAGVVHQPADRFSIRYAWPSAYWGSLPLEGGIEAAYRAEIDAAPDPKAKLKEIEERLNKLRSPFRSAEKFWVEEIIDPRKTRALLCEFARLAEPLRTVGPPTAMTTRP

SEQ ID NO: 82331 - protein, 250 aa, Actinobacillus pleuropneumoniae serovar 1 str. 4074
MVPGIVCLIVLPYLLYLIYPPELKDTPKMAEMARQELQNMGKMSKAEWILALDFVLLLFLWTVGDLAFGIPATVSAFIGLVILLLSNIMNWQNIISEKSAWDTMFWFAVLVMMANALNKYGAITWISSHISQSVGGLDWPMAFGILVLVYFYTRYFFASAMAHISAMYLAFLAAAIAVGTPPMLAAIGLGYTSTLSMSLTQYAGGPGPALFGSGYNTTGQWWGVSFIISVASLVIWFTVGGAWMKLLGWW

SEQ ID NO: 82332 - protein, 231 aa, Actinobacillus pleuropneumoniae serovar 1 str. 4074
MSADQKAPPVEVKLGFNWQGLLISVVVGVGIVLIPTPEGLSERAWGMLALFVATIVAIIAKAMPMGAATLVALVISGVTELTPIKAGKDEVAMLSGFSNATIWLIGIAMFLSQAVIKTGLGKRIALYFVSRFGKRMMGVAYGIALADLVIGPGIPSASARGGGIMYPIMKSIAEAYDSKPGPTAKRAGAFLALAVSQINTIVCTMFLTAMAGNPLIAELARGQGVEISWIT

SEQ ID NO: 82333 - protein, 560 aa, Dehalococcoides sp. VS
MMSEMNNKQSAESLRVSTTGDIEVSTYLEIAKEKSGAKPECIATGEENLRESIVIFDFGSQYSLLIARRIREMHVYCELVSHDTPWEKIAHLNPRGFILSGGPSSVYEQGAPLAPAYIFESKLPVLGICYGMQAITQQLGGVVEHSEKREYGHALLHSNVVNTDLLADMPEPSPVWMSHGDRIEKMPAGFTALAYTENCPVAVMGNESDIYGLQFHPEVVHSPHGKIILKNFVFNICKCHANWTMGNYIQESIQNIREQVGGGQVICALSGGVDSAVVASLIHKAIGEQLTCIYVNNGLLRREEADRTLHVFKNHMGMKIIYVDAVDRFLEGLGGVTDPEQKRKVIGSEFIKVFEDEACKLGTIDFLAQGTLYPDVIESVSSVSKASAKIKSHHNVGGLPAHMKLKLIEPLRYLFKDEVRLLGKELGLPDEMIWRQPFPGPGLAIRIIGEVTREKLEILRAADWIVMSEIKKAKMYHQVWQSFAILTDVKSVGVMGDFRTYGYLVAIRAVTSEDAMTADWAKLPYDLLSVISNRIVNEVKEVNRVVYDISSKPPSTIEWE

SEQ ID NO: 82334 - protein, 321 aa, Calystegia soldanella
KGQNPVFPRILGHEAAGIVESVGEGVTDLKAGDHVLPVFTGECKECRHCKSEESNMCDLLRINTDRGVMLEDQKSRFSINGKPIYHFVGTSTFSEYTVCHVGSVAKINPLAPLDKVCILSCGISTGLGATLNVAKPPKGSTVAVFGLGAVGLAAAEGARMAGASRIIGVDLVPSRFELAKKFGVTDFVNPKEHSKPVQEVIVEMTDGGVDRSVECTGNVNAMISAFECVHDVWGVAVLVGVPHKDAEFKTHPMNLLNERTLKGTFFGNYKPRSDLPYVVEKYMNKELELEKFITHEVPFAEINKAFDLMLKGEGLRCIITM

SEQ ID NO: 82335 - protein, 138 aa, Triticum aestivum
VHAFSVCDDPEYFYDYVQGLIDGLQSGLDSHDIVSIQNAKGLGYAMNTAEELKFVKDIATATGIVLDPVYSGKGAYAMLKDMADNPSKWKGRKVLFVHTGGLLGLYDKVDQMSSLAGSWRRMDLEESVPRKDGTGKMF

SEQ ID NO: 82336 - protein, 498 aa, Bradyrhizobium sp. BTAi1
MRSIGHFIGGKEVKGTSGRTADVFEPMTGDVQAKVALASRAELRAAVENAKAAQPAWAATNPQRRARVMMKFLELAQRDYDQLAELLAREHGKTVPDAKGDIQRGLEVVEFACGIPHLMKGEYTEGAGPGIDIYSMRQPLGVVAGITPFNFPAMIPMWKFAPAIACGNAFILKPSERDPGVPMKLAELMIEAGLPAGILNVVNGDKEAVDAILEDPDIMAVGFVGSSPIAQYIYERAAAHGKRCQCFGGAKNHAIVMPDADLDQAVDALIGAGYGSAGERCMAVSVAVPVGKTTADRLMEKLIPRVESLKIGTSIDPSADYGPLVTREAVERVKNYVDIGVKEGATLAVDGRGFKMQGYENGFYMGGCLFDNVTKDMRIYKEEIFGPVLSVVRAKDYAEALALPSEHDYGNGVAIFTRDGDAARDFAAKVNVGMVGINVPIPVPIAYYTFGGWKKSGFGDLNQHGPDSIRFYTKTKTVTSRWPSGVKEGAEFSIPLMK

SEQ ID NO: 82337 - protein, 454 aa, unidentified eubacterium SCB49
MTNYIEAQKAFFITQATKDVSFRIKQLKKLAKLLDDNEAALHKAIHDDFKKSAFENYVTELAFVQHDIKEAIRNIDQWTRVQDVQTNIANFPAKSYIIPEPLGTCLVIGAWNYPYQLSLAPAVAAIAAGNTVIIKPSEMPSNTARVMATLINKAFDPRVLKVIEGGVAETTALLNQDFDKIFFTGSTTVGKIVYKAAAEKLIPVTLELGGKSPAIITKDANLKMAAKRLIWAKFLNAGQTCIAPDYILIHKSKQETFLKYAVAEIEKAKYAFENGNYVQIINDKNFDRLFKMLDASKTYIGGQNNKKDRYIAPTVLTNISWDHPTMKEEIFGPILPVISYYEIDEVFTNVRKFPKPLSLYVFTSNSKTKSRVLNELSFGGGAVNEAVMHISNPHLPFGGVGTSGIGTYHGKAGFDCFTHYKSILDKPTWLELPIKFSPYSKTKLAWLRRLFKLQ

SEQ ID NO: 82338 - protein, 368 aa, Coccidioides immitis RS
MALYAFGSNGSGQLGLGHREDVAFPTRCLIKWEPNSMDKAATNAPPNNYNDNVPFCLAAGGNHTLALFSSGAVYAAGSNGNGRCAYAPEDAEILLEFSRVVIYDGERKVDRFTSVSATWESSCFVEAGTGYVYVAGTGMKGELGLGENVTEMNVPTRIPNFPPKGTEIVGISGSVGHTVVILSNGEVYGWGNARKGQLGESGVKKKIFWSPQRVNVPFQARNAACGREFTIIVGDAEEGSLVILGSDKWGVQSGAPSTLKGYNSVAASWHGIYSHNFDGSITAWGRNDRGQLPPPDFPRVPLIGIGSEHVVAAIDNKRVVAFGWGNVVGRYAKVPPAGGEGLNITAVGAGCATSWLMTEERPHAFEEH

SEQ ID NO: 82339 - protein, 397 aa, Desulfotalea psychrophila LSv54
MTEFRMPSLGADMKEGRLVEWKVKLGDQVKRGDIIAEVETAKGVIEIEVFTDGVIEQILVQRGENVPVGTVLATIQGNGEQGRELREEALPEPVFKYKACLIAAHREEPAAEPPPAVVTAAGKRLRISPRARKLLAELDVELSTVQGTGQGGAITGIDIERAAAAEKAAAQSVPSTPGAAMRQAIATAMARSNREIPHYYLASRIDMSNTLRWLEAENKKRSIKERVLPVVPLIKATALALAKVPELNGYWLDNRQQPEEAVHIGFVISLRQGGLVAPAIHHANLKSLPELMETLSDLITRTRSGHLRSSELTDATVTITNLGDLGVEVVHGVIYPPQVALVGFGKILEQPWAKDGMLGIRPILTATLAADHRATDGHRGAQFLEALNHHLQKPEEL

SEQ ID NO: 82340 - protein, 540 aa, Candida tropicalis
MSSSPSFAQEVLATTSPYIEYFLDNYTRWYYFIPLVLLSLNFISLLHTKYLERRFHAKPLGNVVLDPTFGIATPLILIYLKSKGTVMKFAWSFWNNKYIVKDPKYKTTGLRIVGLPLIETIDPENIKAVLATQFNDFSLGTRHDFLYSLLGDGIFTLDGAGWKHSRTMLRPQFAREQVSHVKLLEPHVQVFFKHVRKHRGQTFDIQELFFRLTVDSATEFLFGESAESLRDDSVGLTPTTKDFEGRGDFADAFNYSQTYQAYRFLLQQMYWILNGAEFRKSIAIVHKFADHYVQKALELTDDDLQKQDGYVFLYELAKQTRDPKVLRDQLLNILVAGRDTTAGLLSFVFYELSRNPEVFAKLREEVENRFGLGEEARVEEISFESLKSCEYLKAVINEALRLYPSVPHNFRVATRNTTLPRGGGKDGCSPIVVKKGQVVMYTVIGTHRDPSIYGADADVFRPERWFEPETRKLGWAYVPFNGGPRICLGQQFALTEASYVTVRLLQEFGNLSSDPNAEYPPKLQNTLTLSLFDGADVRMF

SEQ ID NO: 82341 - protein, 467 aa, Flavobacteria bacterium BBFL7
MSTYDVAIIGSGPGGYVAAIRCAQLGMKTAIIEKYNTLGGTCLNVGCIPSKALLDSSHHYDDAMKHFEDHGIEIPGDIKINFEKMIARKAQVVKQTCDGVSFLMKKNDIDVYTGMGSFKDATHINIDGEDGTQTIEAKNTIIATGSKPGSLPFISLDKERVITSTEALTLKEIPKHMIVIGGGVIGLELGQVYRRLGAEVTVIEYMDRITPVMDKMLSKELMKVLKKQKIKFHLSHAVNKVERNGDEVTVTAKNKKGEEVTFTGDYCLVSVGRRPYTDKLNATAAGVKINERGQVETNEHLQTNVSNIYAIGDVVKGAMLAHKAEEEGTFVAETIAGQKPHINYNLIPNVIYTWPEVASVGKTEEELKEAGTAIKVGQFPMRALGRARASGDIDGMVKIIADEKTDEVLGVHMIGARVADLIAEAVTAMEFRASAEDIARMSHAHPTYAEAVKEAALAATADRALHV

SEQ ID NO: 82342 - protein, 499 aa, Candida tropicalis
MAISSLLSWDVICVVFICVCVYFGYEYCYTKYLMHKHGAREIENVINDGFFGFRLPLLLMRASNEGRLIEFSVKRFESAPHPQNKTLVNRALSVPVILTKDPVNIKAMLSTQFDDFSLGLRLHQFAPLLGKGIFTLDGPEWKQSRSMLRPQFAKDRVSHISDLEPHFVLLRKHIDGHNGDYFDIQELYFRFSMDVATGFLFGESVGSLKDEDARFSEAFNESQKYLATRATLHELYFLCDGFRFRQYNKVVRKFCSQCVHKALDVAPEDTSEYVFLRELVKHTRDPVVLQDQALNVLLAGRDTTASLLSFATFELARNDHMWRKLREEVISTMGPSSDEITVAGLKSCRYLKAILNETLRLYPSVPRNARFATRNTTLPRGGGPDGSFPILIRKGQPVGYFICATHLNEKVYGNDSHVFRPERWAALEGKSLGWSYLPFNGGPRSCLGQQFAILEASYVLARLTQCYTTIQLRTTEYPPKKLVHLTMSLLNGVYIRTRT

SEQ ID NO: 82343 - protein, 509 aa, Ocimum basilicum
MAALLLLLLLLPAIFLLHHLYYRLRFRLPPGPRPLPVVGNLYDVKPVRFRCFADWAQSYGPIISVWFGSTLNVIVSNTELAKEVLKEKDQQLADRHRSRSAAKFSRDGQDLIWADYGPHYVKVRKVCMLELFSPKRLEALRPIREDEVTAMVESIYHDCTAPDNAGKSLLVKKYLGAVAFNNITRLAFGKRFVNSEGIIDKQGLEFKAIVSNGLKLGASLAMAEHIPWLRWMFPLDEDAFAKHGARRDQLTREIMEEHTRAREESGGAKQHFFDALLTLKDKYDLSEDTIIGLLWDMITAGMDTTAISVEWAMAELIKNPRVQQKAQEELDRVIGYERVMTELDFSNLPYLQCVAKEALRLHPPTPLMLPHRSNSNVKIGGYDIPKGSNVHVNVWAVARDPAVWKNPSEFRPERFLEEDVDMKGHDFRLLPFGAGRRVCPGAQLGINLVTSMIGHLLHHFNWAPPSGVSTDELDMGENPGLVTYMRTPLEAVPTPRLPSDLYKRIAVDL

SEQ ID NO: 82344 - protein, 530 aa, Mycobacterium sp. JLS
MALKSTLDPSSPGYAAAADAMAAKLAELETEHAKALAGGGAKYVERHHARGKLTARERIELLLDPDSPFLELSPLAAWGSEFTVGASVVTGIGAVSGVECLLVANDPTVKGGTSNPWTLRKILRANQIALQNRLPVISLVESGGADLPTQKEVFIPGGQMFRDLTRLSAAGIPTIALVFGNSTAGGAYVPGMSDHVVMIKERSKVFLAGPPLVKMATGEESDDESLGGAEMHARTSGLADYFALDELDALRIGRRIVGRLNWRKQGPAPAPVTEPLFDSEELLGIVPADLRIPFDPRDVVARIVDGSEFDEFKALYGSSLVTGWARLHGYPIGILANARGVLFSEESQKATQFIQLANRSNTPLLFLHNTTGYMVGRQYEEGGMIKHGSMMINAVSNSTVPHLSLLIGASYGAGHYGMCGRAYDPRFLFAWPSAKAAVMGGTQLAGVISIVGRAAAEARGQVVDEDADAALRAAIEAQIEAESLPMFLSGRLYDDGVIDPRDTRTVLGMCLSAIANGPIEGTSNFGVFRM

SEQ ID NO: 82345 - protein, 517 aa, Candida tropicalis
MIEQLLEYWYVVVPVLYIIKQLLAYTKTRVLMKKLGAAPVTNKLYDNAFGIVNGWKALQFKKEGRAQEYNDYKFDHSKNPSVGTYVSILFGTRIVVTKDPENIKAILATQFGDFSLGKRHTLFKPLLGDGIFTLDGEGWKHSRAMLRPQFAREQVAHVTSLEPHFQLLKKHILKHKGEYFDIQELFFRFTVDSATEFLFGESVHSLKDESIGINQDDIDFAGRKDFAESFNKAQEYLAIRTLVQTFYWLVNNKEFRDCTKSVHKFTNYYVQKALDASPEELEKQSGYVFLYELVKQTRDPNVLRDQSLNILLAGRDTTAGLLSFAVFELARHPEIWAKLREEIEQQFGLGEDSRVEEITFESLKRCEYLKAFLNETLRIYPSVPRNFRIATKNTTLPRGGGSDGTSPILIQKGEAVSYGINSTHLDPVYYGPDAAEFRPERWFEPSTKKLGWAYLPFNGGPRICLGQQFALTEAGYVLVRLVQEFSHVRSDPDEVYPPKRLTNLTMCLQDGAIVKFD

SEQ ID NO: 82346 - protein, 430 aa, Coprinopsis cinerea okayama7#130
METRLTQLHTQDAKDREIRKYSKTESQHLRLRRTKIKLSDFKTVKVIGKGAFGEVRLVQKVDTGKVYAMKSLQKAEMLKRDQLAHVRAERDVLAESTSPWVVQLFYSFQDPLYLYLIMEFLPGGDLMTMLMKYDVFSEDVTRFYMAECILAIEAVHNLGYIHRDIKPDNVLIDRNGHLKLSDFGLSTGLHKATDGEIYKRYLEQEKTKDNSRNSVQVNPINLTMSREQIATWKANRRKLAYSTVGTPDYIAPEVFMMKGYGKECDWWSLGAIFFECLVGYAPFCSDNPGDTYKKIIDWPRYLIFPEEVYISKEGEDLIRGYVRLIYYLLGHLNLTLFVLSMMNWADKRLTVEQIKNHPWFFGADWNSLRYIEPPFVPRLSSITDTSYFPTDDLGNVSNQLDQVESVSAEKDLAFLGFTFKRFTGGPGASG

SEQ ID NO: 82347 - protein, 517 aa, Candida tropicalis
MIEQILEYWYIVVPVLYIIKQLIAYSKTRVLMKQLGAAPITNQLYDNVFGIVNGWKALQFKKEGRAQEYNDHKFDSSKNPSVGTYVSILFGTKIVVTKDPENIKAILATQFGDFSLGKRHALFKPLLGDGIFTLDGEGWKHSRSMLRPQFAREQVAHVTSLEPHFQLLKKHILKHKGEYFDIQELFFRFTVDSATEFLFGESVHSLKDETIGINQDDIDFAGRKDFAESFNKAQEYLSIRILVQTFYWLINNKEFRDCTKSVHKFTNYYVQKALDATPEELEKQGGYVFLYELVKQTRDPKVLRDQSLNILLAGRDTTAGLLSFAVFELARNPHIWAKLREEIEQQFGLGEDSRVEEITFESLKRCEYLKAFLNETLRVYPSVPRNFRIATKNTTLPRGGGPDGTQPILIQKGEGVSYGINSTHLDPVYYGPDAAEFRPERWFEPSTRKLGWAYLPFNGGPRICLGQQFALTEAGYVLVRLVQEFSHIRSDPDEVYPPKRLTNLTMCLQDGAIVKFD

SEQ ID NO: 82348 - protein, 214 aa, Glycine max
  misc_feature (99)..(99): Xaa can be any naturally occurring amino acid
MVLYCSTSKKTEAHGYEEPTILSSETPFTVSEVEALHELYKKLSNSIVEDGLIHKEEFQLALFRNKNKKNLLADRILDLFDLKRNGVIEFGEFGRSLGXFYPNAPLEDKNAVAFRLYDLRQTGFIEREELKEMVLALLHESDLELSDDMIETIVDKTFSDADINGDGRIDQDEWKAFVSKHPSLIKNMTLPYLKDITLAFPSFVTGTDIEESEM

SEQ ID NO: 82349 - protein, 512 aa, Candida tropicalis
MLDQILHYWYIVLPLLAIINQIVAHVRTNYLMKKLGAKPFTHVQRDGWLGFKFGREFLKAKSAGRSVDLIISRFHDNEDTFSSYAFGNHVVFTRDPENIKALLATQFGDFSLGSRVKFFKPLLGYGIFTLDAEGWKHSRAMLRPQFAREQVAHVTSLEPHFQLLKKHILKHKGEYFDIQELFFRFTVDSATEFLFGESVHSLKDEEIGYDTKDMSEERRRFADAFNKSQVYVATRVALQNLYWLVNNKEFKECNDIVHKFTNYYVQKALDATPEELEKQGGYVFLYELVKQTRDPKVLRDQSLNILLAGRDTTAGLLSFAVFELARNPHIWAKLREEIEQQFGLGEDSRVEEITFESLKRCEYLKAVLNETLRLHPSVPRNARFAIKDTTLPRGGGPNGKDPILIRKDEVVQYSISATQTNPAYYGADAADFRPERWFEPSTRNLGWAFLPFNGGPRICLGQQFALTEAGYVLVRLVQEFPNLSQDPETKYPPPRLAHLTMCLFDGAHVKMS

SEQ ID NO: 82350 - protein, 231 aa, Haemophilus somnus 129PT
MYKKMSWLLLVFHNAIFPIGNDLSENKMTNIKLNYHKTHFLMSAPNIKVLPEDSGIEIAFAGRSNAGKSTALNALTQQKNLARTSKIPGRTQLINLFQVEPNCKLVDLPGYGYAAVPEQMKLQWQKSLGEYLQKRECLGGLVILMDIRHPLKDLDQQMIEWAVSADLPVLLLLTKADKLSQSARSKQVKMVREAILPFQGDVQVEAFSAQNKIGIERLSEKLDQWFSPLFS

SEQ ID NO: 82351 - protein, 156 aa, Spinacia oleracea
MNELEGYVTKAQSFRFAIVVARFNEFVTRRLMEGALDTFKKYSVNEDIDVVWVPGAYELGVTAQALGKSGKYHAIVCLGAVVKGDTSHYDAVVNSASSGVLSAGLNSGVPCVFGVLTCDNMDQAINRAGGKAGNKGAESALTAIEMASLFEHHLKA

SEQ ID NO: 82352 - protein, 178 aa, Dehalococcoides sp. VS
MPPTKHTIVALVEDRPGVLNRMASLFRRRGFNIDSIAVGRSETPGFSRMTIVVDGANTMVEQVRKQLDKVVDVVKVSDITGQDIICRELALIKVKSTPANRSEIMQIVDIFRAKIVDVASDSLTVEVTGDEEKVNSLYNLLRAFGIKEITRTGRIAMTRGGLATATELQSSKELKTKE

SEQ ID NO: 82353 - protein, 224 aa, Zea mays
  misc_feature (45)..(46): Xaa can be any naturally occurring amino acid
  misc_feature (134)..(136): Xaa can be any naturally occurring amino acid
  misc_feature (142)..(143): Xaa can be any naturally occurring amino acid
MLPFKVLVTFSPRGSSRGSSERNRKEGRLIRVKEAMEHKEAGCQXXEGPILCINNCGFFGSAATMNMCSKCHKEMITKQDQAKLAASSIDSIVNGSDAVMEPVVAGSNTVVAVAQVELQTMNVQQPADVAGPSXXXAAISKXXKVGPNRCSACRKRVGLTGFNCRCGNLYCALHRYSDKHDCKFDYRTAARDAIAKANPVVKADKLDKISYFPTVGCQEDCKPR

SEQ ID NO: 82354 - protein, 745 aa, Physcomitrella patens subsp. patens
MTMNNERKVIELEQGWSFMQIGITKLKNLLEGVPEQQFSSEEYMLLYTTIYNMCTQKPPQDYSQQLYDGYRVSFEEYINSKVLPALREKHEEFMLKELVKRWYNHKIMVRWLSRFFNYLDRYFIARRSLPALSEVGLICFRNLVYAETKINVKDAVVALIDREREGEQIDRALLKNVLGIFVEIGMGNMDAYDTDFEQFMLEDTAAYYRRKASSWIQEDSCPDYMLKAEECLKREKERVGHYLHASSEQKLLEKVQQELLTQYETQLLEKEHSGCHTLLRDDKVDDLSRMYRLFYRIPKGLEPVASIFKQHVTEEGTALVKQAEDAVSNKRAEKKDTVGVQEQVFVRKVIELHDKYLQYVSECFANHSLFHKALKEAFEVFCNKGVAGSTSAELLATFCDNLLKKGGSEKLSDEAIEDTLEKVVKLLAYISDKDLFAEFYRKKLARRLLFDKSANDDHERSILTKLKQQCGGQFTSKMEGMVTDLTLARENQSNFEDYLSDNTKSNPGIDLTVTVLTTGFWPSYKSSDLALPAEMVKCVEVFKEFYQTKTKHRKLTWIYSLGTCNITGKFDAKPIELIVTTYQAAVLLLFNAEDRLSYNDIKNQLNLTDEDIVRLLHSLSCAKYKILNKDPNTKAVGQNDIFEFNTKFTDKMRRIKIPLPPMDEKKKVIEDVDKDRRYAIDASIVRIMKSRKMLPHQQLVLECVEQLGRMFKPDFKVIKKRVEDLIARDYLERDKDNPNMFKYVA

SEQ ID NO: 82355 - protein, 157 aa, unidentified eubacterium SCB49
MKITLLAIGKTDDKKLIELTEVYIKRLKHYVGFSFEIIPDIKKAKNLSEAQQKQLEGEEILKRTQTSDALILLDEKGKTYTSVKFSQYLQKHMNSGLKNLIFVIGGPYGFSEEIYTRANGKVSLSSMTFSHQMVRLFVVEQIYRGFTILKNEPYHHR

SEQ ID NO: 82356 - protein, 454 aa, Ustilago maydis 521
MHPRRLSSLSGPMPVDNTEHIRLRQPSVSTKTSTHHDSTAVARNRIQQVTRHITHKLPSTLQKDMSTQEFKQAPHKLLVIPGPIEVADDVLLANAHPAMSHVSPDFIPVFGDCIRMLREVLFAPNSQPVLTAGSGTLGWDHVAANVIQPGEEALVLNSGYFGDSFADCLETYGAKVDQIKAPIGSKPSLTEVEEALKKKQYKVLTFTHVDTSTGVLSDAKGLGELVKRVSPETILVLDGVCSVGSEEIRMEEWGIDVVLTATQKGLGCPPGLMVLAASKKAIAAFEKRTVPPNSYFASWSRWLPVMKAYEAGTGAYFATPPTNLIYALHASLTTITKGSPSLEDRFQQHVAASDRVKDFVSQLGLKQLAADGKKDGAHGMTAVRYPEGLKATDLLPKLVAKNIVVAAGLHKQVKDEYFRIGHMGITVVNDKERGDIEYLLTSIKEALAEAGYKP

SEQ ID NO: 82357 - protein, 596 aa, Arabidopsis thaliana
MSQSIQFSTPSHTPHLLHLPHSQFNRPLSSISFRRFPLTTIKYTSIRASSSSSPSPDLDSSSSSSSSQVLLSPNGTGAVKSDERSVVATAVTTDTSGIEVDTVTEAELKENGFRSTRRTKLICTIGPATCGFEQLEALAVGGMNVARLNMCHGTRDWHRGVIRSVRRLNEEKGFAVAIMMDTEGSEIHMGDLGGEASAKAEDGEVWTFTVRAFDSSRPERTISVSYDGFAEDVRVGDELLVDGGMVRFEVIEKIGPDVKCLCTDPGLLLPRANLTFWRDGSLVRERNAMLPTISSKDWLDIDFGIAEGVDFIAVSFVKSAEVINHLKSYLAARSRGGEIGVIAKIESIDSLTNLEEIILASDGAMVARGDLGAQIPLEQVPAAQQRIVQVCRALNKPVIVASQLLESMIEYPTPTRAEVADVSEAVRQRSDALMLSGESAMGQFPDKALTVLRTVSLRIERWWREEKRHESVPLQAIGSSFSDKISEEICNSAAKMANNLGVDAVFVYTTSGHMASLVSRCRPDCPIFAFTTTTSVRRRLNLQWGLIPFRLSFSDDMESNLNKTFSLLKSRGMIKSGDLVIAVSDMLQSIQVMNVP

SEQ ID NO: 82358 - protein, 588 aa, Silicibacter sp. TM1040
MPSFRQYFPILVWGRDYDKSALSNDLIAAVIVTIMLIPQSLAYALLAGLPPEAGIYASIAPILLYAVFGTSRALAVGPVAVVSLLTASAVGQVAEQGTAGYVVATLTLAFLSGSFLVLMGVLKLGFIANFLSHPVIAGFITASGILIATSQIKHILGIRAEGHTLPEMLYSIALRLGEVNWITLLIGASATGFLFWARKHLKQTLHGMGTPPLLADILNKAGPVAAVVTTTVVVWGFDLAEKGVKIVGEVPQGLPPLTMPGFAPDLIGALLVPAILISIIGFVESVSVAQTLAAKRRQRIDPDQELIGLGAANLGAAFTGGYPVTGGFARSVVNFDAGAETPAAGAFTAIGLALAAVALTPLVYYLPIATLAATIIVAVLSLVDLSILKKTWTYSHADFIAVAATILLTLGLGVEIGVASGVILSVVLHLYKTSRPHVAEVGLVPGTQHFRNIDRHNVQTDPRLVSLRVDESLYFVNARFLEDLIQKRVTEGCAIKHVVLMFSAVNMVDYSALESLEAINHRLKDMGVGLHLSEVKGPVMDRLQRSDFIDEMNGKIFLSQYEAWANLTAGAQQGAADTGQGDQLRCGA

SEQ ID NO: 82359 - protein, 365 aa, Dehalococcoides sp. VS
MDFKLTVLPGDGIGPEVMAEGLKVLNAVAKKYKHRFEYQYGLIGGCCIDKEGVALSPETLAMCKKSDAVILAAVGDPRFDDPKLPVHPEDGLLALRRGLGLFANIRPVKVAPSLINSAPVKAEIIKGTDFIFIRELTGGVYFAKPKKRWTTPSGIRKATDSMTYSEKEIERIVRVGFELARSRKKKLVSVDKANVLLSSRLWRQIVIELAKDYPDVTVEHILVDACAMKLILSPTYFDVIVTENMFGDILTDEASMLAGSMGMLPSASLAGIPAKGTKTFGLYEPIHGSAPTIAKQNIANPIATILSIAMMLRYSCGLEAEAAEIEAAVDKVLAAGYATIDIFKEGNTKLGTAEMGSQIAKTIGG

SEQ ID NO: 82360 - protein, 512 aa, Synechococcus sp. WH 5701
MTFSLKEWWGLPHRDILSGLVVAFAMIPEAIAFSGIAGVDPSVGLFGAFLLAVTLAVVGGRTAMITSATGSTALLMTGLVQQGDALGAGLGLQYLLAAGLLTGVLQIAWGYLQLAQQMRFVPQPVMAGFVNALAILILLAQLPQLGLDLVHPEAVAVQADQLPAVWGVTGLTLLIIYLLPRLTKAVPSALIAILITTGLSISLGLDLPTVSSLGSLPSGLPRFGLPQVPFSLDTLGVILPTALAISLVGLMETFLTQDILDDLTDESSHKNTEARGQGIGNIVSSLFGGMAGCALVGQSVMNVGYGGRTRLSTLTSGLSLLAMILLARGWVNQIPMATLVGVMIMIAINTANFGSITGIGKIPRSDTAVMLLTVGITVLTHNLAIGLLAGVALAAILFSRKVAKVIAVDSRLEAPDHRLYTVRGQLFFVSSIYFRAGFEVHEHPARVTIDMAEAHIWDQSGVTVLDQVIRRLKLGGSAVEVINLNRESTNLFARIGVAQEAGGRGGEPGPLH

SEQ ID NO: 82361 - protein, 127 aa, Streptococcus thermophilus CNRZ1066
MEEITMALNIENIIAEIKEASILELNDLVKAIEEEFGVTAAAPVAAAADGAADAGAAKDSFDVELTSAGDKKVGVIKVVREITGEGLKEAKAIVDGAPSVIKEGVAAAEAEEIKAKLEEAGASVTLK

SEQ ID NO: 82362 - protein, 348 aa, Glycine max
FYIGLRQKRATGQEYSELLQEFMTAVKQNYGEKVLIQFEDFANHNAFELLAKYGTTHLVFNDDIQGTASVVLAGVVAALKLIGGNLADHTFLFLGAGEAGTGIAELIALEMSKQTKTPIEETRKKIWLVDSKGLIVGSRKASLQHFKQPWAHEHEPVGSLLEAVKVIKPTVLIGSSGVGKTFTKEVIEAVTSINEKPLVLALSNPTSQSECTAEEAYEWSEGRAIFASGSPFDPVEYKGKVYYSGQANNAYIFPGFGLGLVISGAIRVHDDMLLAASEALAKLVTEENYEKGLIYPPFSNIRKISANIAASVAAKAYELGLATRLPRPQNLVKYAESCMYTPVYRNYR

SEQ ID NO: 82363 - protein, 380 aa, Oryza sativa Indica Group
MGSSCSRSHSLSEAETTKNAKSADIDRRILQETKAEQHIHKLLLLGAGESGKSTIFKQIKLLFQTGFDEAELRSYTSVIHANVYQTIKILYEGAKELSQVESDSSKYVISPDNQEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDIFEKKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 82364 - protein, 521 aa, Caulobacter crescentus CB15
MTSKAQSRVVLVTGGADGIGWAACQRFARAGDQVLVADRNVERARERADSLGPDHHAIAMDVSSEAQIREGFEQLHREFGRLDVLVNNAGVTDPQPTATLDQTAEEVARLQAINVTGAFLAAREAGRLMIEQGHGAIINLASGAGLVALAKRTSYSASKAAVISLTRTLACEWAAKGVRVNAVLPGYTRTQMVQDQIDAGLLDPSIVLSRIPLGRMGEPEEMAEGAFFLASDAASYVVGATLVVDGGYTVYGGSGPASTTPAPSPLAPSPRVSAITGGGRGIGRCVVDLFHAAGDRLLVIERDAEGAKALAEALGDEHIVVQADITDVAAVEAAFAQAQARWGRLDVLINNAGAADVFKPSLEQTAQDFTSVYDLNFSGPLATAKAAARLMSQGGVIVNLGSIAGLGALPQRNAYCAAKAAVTMMSRSLACEWASAGIRVNTVAPGYIETPAVLALKSAGRAQFDKIRRRAPIGRLGDPMEVARTIAFLASPAASYVAGATLTVDGGWTAFGDAGDASDIL

SEQ ID NO: 82365 - protein, 357 aa, Vitis vinifera
MSAFVGKYADELIKNAKYIATPGKGILAADESTGTIGKRLSSIKVDNNEPNRQALRELLFTSPNALSYLSGVILFEETLYQNTRDGKPFVEVLQENNVIPGIKVDKGTVELAGTNGETTTQGFDSLGARCQQYYKAGARFAKWRSVLKIGPTEPSELSIQQNAQGLARYAIICQENGLVPIVEPEILTDGDHDIKKCAAVTETVLAAVYKALNDHHVLLEGTLLKPNMVTPGSAGPKVSSEVIAEYTVAALRRTVPPAVPGIVFLSGGQSEEEATLNLNAMNKLEVLKPWTLSFSFGRALQQSTLKTWSGKTENVGKAQGAFLGRCKANSEATLGKYEGGTGGGLASESLYVKGYKY

SEQ ID NO: 82366 - protein, 1075 aa, Mycobacterium avium 104
MTASLLVANRGEIALRIIRTATELGMRTVAVYAADDAHSPHVHAADEAMPLPGSGPPAYLNQAALLAVAENTGATLIHPGYGFLSENAEFAEACAAARRTFVGPDARVLELLGNKTAARRAAIAAEVPTLAATDGPSGVEDIEAFFAAHPGGIMIKALAGGGGRGMRKVHNAAQIAGAYQRCAAEARLGFGDPALFAEALLGDARHIEVQVVAAPAGHQTHALAVGDRDCSIQRRYQKLIEIAPAQGLSEELRRALHQAAVRLCARVGLRGLATVEFLVSGERFVFLEVNPRIQVEHTVTEQTTGLDLVAVQLAIAGGESYYRLGLPAGIASDGTEVIGEPAAQRGIAIQLRVNAETFGADFSVLPSAGTLTAFCPPSGRGVRVDTYGRPGLVVSPQYDSLLAKVIVAVHGSSWRAAMRKADTALSEFGVEGVATNIGFLRRLLAEQRLETGWVNTDFVDDKLPELAAAALTHQPGPQPGAVELYPGEDALRAQLAGTVVEVAPEGADYPAGAQLVVLEAMKMQHVLAAPDALRTVRVLVTPGQVVGTGDPLLVFTRTTGGDDGESETAATDLDLTRADLDEVIERHARTLDEGRPDAVAKRHRQGRRTARENIDDLVDPGSFVEYGALAIAAQRSRRSEEDLIANTPADGLVAGLATVGADRFGRAAAQAVVASYDYTVLAGTQGMRNHAKTDRVFDLAARKRLPVVLFAEGGGGRPGDTDVGGAAGLDVPTFRMLAGLRGRVPLVSVVSGRCFAGNAALAGVCDVIIATPDANIGMGGPAMIEGGGLGVYPPEAIGPIAVQRRNGVVGLVARDEAHAVSLAKQYLSYFQGRLDRWQAPDPRVARHVVPQNRLRAYDVHRAIEAIVDVGSVLELRPDYGVGIVTALVRVEGVPCGLIANSTHHLGGAIDAEAADKAGDFLALCESFGLPVISLCDTPGFMVGPDAETQAAVRRFGRMFVLGARLTVPLGMIILRKGYGLGAMAMAGGSFRAPQFTVAWPTGEIGGMGLEGAVRLGYRKELAAVTDPAERQNLFDRLVAAAYQHGKALRAATTFELDDVIDPAASRAWITRLSEG

SEQ ID NO: 82367 - protein, 449 aa, Pseudomonas fluorescens PfO-1
MEIEEFGYKQELKRSLTLTDLVVYGMIFMIPIAPFGVYGYVNAEAPGMVPLAYIIGMVAMVFTALSYGSMARAFPIAGSVYSYAQRGLNQHVGFIAGWLMLLDYLLIPPLLYVYAAMALNHLYPDIPKVGFILAFLVSATFVNLRGITFTARMNIVFLLAQLVVLGIFLFYAWNALHNGGGNGQLTLAPLYHPETFNFALLMQAVSIAVLSFLGFDAISTLAEEIKGDPGRSVGKAALITLVVMGVIFVAQTWIATDLAAGMGFKSADTAFYEIAEIAAGSWLATLTGVATALAWGVAVAITSQAAVSRLLFGMARDGKLPKVLAKVHPKHNTPYLSIYLVAVLSLVICYLFINSVDTLTSLVNFGALSGFMLLHLTVINYYWRRQKSGQVIRHLICPVIGFIIVAAIMYNMGVDAQKLGLIWIALGLVYLFFLNKLGASTALPDPSNG

SEQ ID NO: 82368 - protein, 512 aa, Candida tropicalis
MLDQIFHYWYIVLPLLVIIKQIVAHARTNYLMKKLGAKPFTHVQLDGWFGFKFGREFLKAKSAGRQVDLIISRFHDNEDTFSSYAFGNHVVFTRDPENIKALLATQFGDFSLGSRVKFFKPLLGYGIFTLDGEGWKHSRAMLRPQFAREQVAHVTSLEPHFQLLKKHILKHKGEYFDIQELFFRFTVDSATEFLFGESVHSLRDEEIGYDTKDMAEERRKFADAFNKSQVYLSTRVALQTLYWLVNNKEFKECNDIVHKFTNYYVQKALDATPEELEKQGGYVFLYELAKQTKDPNVLRDQSLNILLAGRDTTAGLLSFAVFELARNPHIWAKLREEIESHFGSGEDSRVEEITFESLKRCEYLKAVLNETLRLHPSVPRNARFAIKDTTLPRGGGPNGKDPILIRKNEVVQYSISATQTNPAYYGADAADFRPERWFEPSTRNLGWAYLPFNGGPRICLGQQFALTEAGYVLVRLVQEFPSLSQDPETEYPPPRLAHLTMCLFDGAYVKMQ

SEQ ID NO: 82369 - protein, 447 aa, Photorhabdus luminescens subsp. laumondii TTO1
MSCLLSLSSFLGSIQRRDEYQPEYLQAVREVFTSLWPFLEQNPKYREYSLLERMVEPERVIQFRVCWVDDQGKVQVNRAWRVQFSSAIGPYKGGMRFHPSVNLSILKFLGFEQTLKNALTTLPMGGGKGGSDFDPKGKSQGEVMRFCQALMTELYRHLGPDTDVPAGDIGVGGREVAFMSGMMKKLSNNTACVFTGKGLSFGGSLIRPEATGYGLVYFVNAMLKRHGMGFEGMRVSVSGAGNVAQYTIEKCMALGAKVVTASDSGGTLVDEDGFTPEKLTHLEEIKNQRYGRVEEYARERGLTFLKGLQPWSVPVDIALPCATQNELDLDAAKVLIKNGVKAVAEGANMPATISATEAFIEAGVLFAPGKAANAGGVATSGLEMAQNAARLGWKAEKVDARLHHIMLDIHHACVEYGGEGKQINYVQGANIAGFVKVADAMLAQGIL

SEQ ID NO: 82370 - protein, 582 aa, Phaseolus vulgaris
MSSFSVRFLAPPCCPTSRSKTLLCASPTAAPAASEAVEASRLEPRVEERDGFWVLKEEYRGGISPQEKVKLEKDPMKLFMEGGIEDLAKMSLEEIESSKHTKDDIDVRLKWLGLFHRRKHHYGRFMMRLKLPNGVTTSSQTRYLASVIRKYGKDGCADVTTRQNWQIRGVVLPDVPEILKGLAEVGLTSLQSGMDNVRNSVGNPLAGIDPDEIVDTRPYNNLLSQFITANSLGNPAMSNLPRKWNVCVVGSHDLFEHPHINDLAYMPANNKDGRFGFNLLVGGFFSAKRCAEAIPLDAWVSADDVIPVCKAVLEAYRDLGFRGNRQKTRMMWLIDELGIEVFRSEVEKRMAGKQLERAQEDLVKKQWERRDYLGVHPQKQEGLSYVGIHIPVGRIQADEMDELALLADEYGSGELRLTVEQNIIIPNVDNSKLEALLQEPLLKHKFSPEPSLLMKTLVACTGNQFCGQAIIETKARALKVTEEVERQVAVTRPVRMHWTGCPNTCGQVQVADIGFMGCMARDENGKATEGVDIFLGGRIGSDSHLAELYKKGVPCKNLVPVVADILVKHFGAVQRNREEVED

SEQ ID NO: 82371 - protein, 549 aa, Mycobacterium sp. JLS
MNPARLLPRRSDYADLPTSWRRDVLAGVTVGVVALPLALAFGISSGVGAAAGLITAVVAGVVAAVFGGSHVQVSGPTGAMAVVLAPIVAAHGLGSVALVTVVAGLLVAGCGIAGLGRTVTFIPWPVIEGFTLGIAVIIFAQQLPAALGVSAPAGGRTLTTALHVLTHADWAAAAKTLVVVGFVAVVMVALPRLHPGAPASLLAVVGATIGVIALHVPVAAIGELPSHLPAPVLPTVDVDSLRTLLSAAVTVAALAAIESLLSARVAATMSPTGPYDPDRELLGQGLASVASGVFGGMPATGAIARTAVNVRSGARTRVAAIVHSVVLLGVVYLLSGPVSQIPLAALAGVLMVTSFRMISAATVRSILRSGRSDALTFVVTAVITVSFDLIEAVMIGVLAAAFFALRNVAGRSSVTREQLPGPNRDGDEHIALLRLDGAMFFGAAERISTEIAEAFGTPGGPAAAGIRVVIIRMSQLGMLDATGARTLAEITAELEARGITVIIKGVRPEHLNMITSVGVLDSLRHENHLMDSLDDAIAHARTHVAEHPS

SEQ ID NO: 82372 - protein, 360 aa, Streptococcus pyogenes MGAS8232
MTKRLLILEDGTIFEGEPFGADIDVTGEIVFNTGMTGYQESITDQSYNGQILTFTYPLIGNYGINRDDYESISPTCKGVVVSEVSRLASNWRKQMTLDAFLKIKGIPGISGIDTRALTKIIRQHGTMKATMADDGDSIQHLKDQLRATVLPTNTIEQVSTKTAYPAPGIGKNIVLVDFGLKHSILREFSKRQCNITVVPFNITAEEVFQLNPDGLMLSNGPGNPEDLPEALDMIRGVQGKIPIFGICMGHQLFSLANGAKTCKMTFGHRGFNHAVREIATGRIDFTSQNHGYAVERSSLPDTLMVTHEDINDKTVEGVKHRDFPAFSVQFHPDAAPGPHDASYLFDEFLEMIDSWRCTSK

SEQ ID NO: 82373 - protein, 549 aa, Geobacillus stearothermophilus
MLTFHRIIRKGWMFLLAFLLTALLFCPTGQPAKAAAPFNGTMMQYFEWYLPDDGTLWTKVANEANNLSSLGITALWLPPAYKGTSRSDVGYGVYDLYDLGEFNQKGAVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYIMKTNGTMSLFDAPLHNKFYTASKSGGTFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIAWSITTRPWTDEFVRWTEPRLVAWP

SEQ ID NO: 82374 - protein, 236 aa, Cyanothece sp. ATCC 51142
MFGSLPVRERRGSPSESSISEPRTSRPNLLSFLRKDFQIIFERDPAARNWLEVVCCYPGLHALAIHRLSHELWHRNLPFFPRFLSHIARFLTGIEIHPGATLGQGVFIDHGMGVVIGETAIIGDYCLIYQNVTLGGTGKESGKRHPTLGTSVIVGAGAKVLGNIEIGNHVRIGAGSIVLSDVPHDCTVVGVPGRIISRSGRGCPLEHGKLPDVEGQVIRSLLDRIEELEQKIQKLP

SEQ ID NO: 82375 - protein, 524 aa, Microcystis aeruginosa PCC 7806
MDNLQLWQRYQDWLYYHPNLELYLDVSRIPFDEAFLKGLEAKFERAFQDMAALEQGAIANPDEQRMVGHYWLRAPELAPNQELRDEITEPLAQIKEFVKKIHSGAIKPPNRAKFTHVLCVGIGGSALGPQFVAEALAPDFPALEIAFIDNTDPKGIDRTLAHLTLATTLVIVTSKSGGTPEARNGMLEVRNAYEKQDLNFPQHAVAVTMPGSRLDKYAQDWLTRFPMQDWVGGRTSELSAVGLLPAALQGIDIDEMLAGAKEMDIATRVHNLKKNPSALLALAWYHEGNGKGEKDMVILPYKDSLYLFSRYLQQLVMESLGKEKDLDGKTVYQGIAVYGNKGSTDQHAYVQQLREGIPNFFATFIEVLKDRQGDSIEVETGSTAGDFLSGLLQGTRQALYENSRHSITITIPEVTPRQVGALIALYERAVSFYASLVNINAYHQPGVEAGKKAAASILDLQRKIVQVVRETGTSLDLATLAAKIGASDQVEAIYKIVRHLNANRRSLTITGDLSKPETIQISAR

SEQ ID NO: 82376 - protein, 317 aa, Vitis vinifera
MAEHLASIFGTEKDRVNCPFYFKIGACRHGDRCSRLHTKPSISPTLLLSNMYQRPDMVTPGVDPQGQPLDPRKIQEHFEDFYEDLFEELSKYGEIESLNICDNLADHMVGNVYVQFREEEHAANALRNLNGRFYAGRPIIVDFSPVTDFREATCRQYEENICNRGGYCNFMHLKKISRQLRRQLFGRNRRRRSRSRSRTSTWSSWSSWSTWSTWSTWSTGGRRPRSRSPARRGGRSRSPGGRRNKSPVREGSAERRAKIEQWNREREQAEATNKNDNSHSDNGNNNNDFEQDDQQYYNPQHQEEDQQQQQQHGGYNY

SEQ ID NO: 82377 - protein, 231 aa, Chlamydomonas reinhardtii
MTAWTGRRALLDDDDEFDFKKLFLHHLAPGLGCIIAFLMFVSPLKTVLQIRANKHLGDLNPLPLVAIIANCAAWLIYGCINADPYVITANEPGLLLGIFMTVSCYGFADPKARDVMLKALMFFAVLLSAVGIAIALFIEEDETASKTAGYTAVFILLCYYGAPLSTMAEVLRSRSSASLFWPTSLMNTINGLLWVAYGTAVSDPFIAVPNAIGAAFGVIQIGLINIYPAKK

SEQ ID NO: 82378 - protein, 271 aa, Vitis vinifera
MILPIGAPSFKEAMKMGVEVYHHLKAVIKKKYGQDATNVGDEGGFAPNIQENKEGLELLKTAIAKAGYTKEVVIGMDVAASEFYGTDKTYDLNFKEENNDGSEKISGDALKNLYKSFVNEYPISSIEDPFDQDDWEHYTKLTCEIGEKVQIVGDDLLVTNPKRVEKAIKEKACNALLLKVNQIGTVTESIEAVKMSKRAGWGVMASHRSGETEDTFIADLSVGLATGQIKTGAPCRSERLAKYNQLLRIEEELGADAVYAGANFRKPVEPY

SEQ ID NO: 82379 - protein, 420 aa, Silicibacter pomeroyi DSS-3
MTVRQDQLANGFRIVSENMPGLQSAAIGIWVTAGGRHERIDQNGIAHFLEHMAFKGTERRSALQIAEAIEDVGGYINAYTSREVTAYYARVLKEDVALALDVIGDIVLNPVFDPREIEVERGVILQEIGQAHDTPDDVIFDWLQEESYRDQPLGRTILGPVERVSAFSRADLSAFVADNYGPEQMILSATGAVDHDLLVRLAEEMFGHLTPRKGALAVPALFTGGEARREKALEQAHFALALEGPGYRDDAIYTAQIYSSALGGGMSSRLFQEVREVRGLCYTIFAQTGAYADTGTTTIYAGTSAGQVAELAGITIDEMKRAAEDMSEAEVARARAQMKAGMLMGLESPSNRAERLARLVQIWGKVPSLEDTVARIDAVTTADVRAFAEQMAVEAPAALALYGPVSAAPNLAELQERRAA

SEQ ID NO: 82380 - protein, 168 aa, Zea mays
MDPAEGAAEPAAWPPWTSLLLRALSRRRTWVALFLAVYAALLSSSWSLLASVRAWYYAASVAPAWPAALYASVTYGAVFGLLSMAAALAVAAPAMLVTWTTVLVLLAFAGRRPRSLVAEGRRATRDIAGLALRVLLREGNAVAALCAAASFAALLIGRRDDDAARRAS

SEQ ID NO: 82381 - protein, 309 aa, Physcomitrella patens subsp. patens
PLVVVGSVNADIYVEVERLPVEGETIAARSGQTLPGGKGANQAACAARLSYPTFFCGQVGLDGHANLVKDALASAGVRLDHVNTVDSPTGHAVVMLQPGGKNSIIIVGGANVAWPKLEDGISRLTANAQQLIKRAGAVLLQREIPDAVNLEAAKVAKSAGVPVIMDAGGAEGPIPEELLKHVTVLSPNESELARLTAMPTNSLEKILLAAAKVQEMGVQQVLVKMGETGSVLVSGKEPPIYQPAILAPTVVDTTGAGDTFTASYAVALIERQTPAEALRFAAAAASICVRSKGAMPSMPERKAVLQLLK

SEQ ID NO: 82382 - protein, 360 aa, Vitis vinifera
MASAPTLCITATNLLILLIFFLPSLVLSDCSCDEAEHSDHPSNGGESLKYKLAAIASILVAGAAGVSIPLLGKKVPALNPENHIFFMIKAFAAGVILATGFIHILPEAFERLTSPCLGENPWGKFPFTGLVAMMSAIGTLMVDTFATGYYKRQHFSKPKQVTADEERGQEHAGHVHVHTHATHGHAHGSASPSDEESLSDLIRRRIVSQVLELGIVVHSVIIGVSLGASQRPETIKPLLAALSFHQFFEGLGLGGCISQAKFRFSTMAMMVLFFSVTTPVGIVLGIGISRIYHENGPTALIVEGVFDAASAGILIYMALVDLLAADFMNPRLQNSLRLQLGANISLLLGTGCMSFLAKWA

SEQ ID NO: 82383 - protein, 374 aa, Cryptococcus neoformans var. neoformans JEC21
MSPVRVPSHGDGWASTPQTKQVYSIASIPADGIGPEVVEAAITVLKAIAKKRGTFQLDFTNFDWSSETYKKTGRYVPDNHLDILRKFDAILFGAVGAPDVPDHISLWGLRLAICQPLQQYANVRRTRVLPGTESPLRNCKPGQLDWVIVRENSEGEYAGHGGRSHNGYNHEVATEISIFTRVGVERIARFAFQLAQSRPRKKLTYVTKSNAQRNGMVMWDEVVNEVAKEFPDVELDHMLVDAMTVRMVLHPESLDTIVATNLHADILSDLAAALAGSIGIAPTANLDPSRQNPSMFEPIHGSAFDITGKGIANPVATFWTAVEMLEWLGEKEAGQQLMEAVEAVCVDGIKTKDLGGSATTKEVTDAVVKRILQG

SEQ ID NO: 82384 - protein, 360 aa, Vitis vinifera
  misc_feature (3)..(3): Xaa can be any naturally occurring amino acid
  misc_feature (42)..(42): Xaa can be any naturally occurring amino acid
  misc_feature (334)..(334): Xaa can be any naturally occurring amino acid
MAXAPTLCITATNLLILLIFFLPSLVLSDCSCDEAEHSDHPXNGGESLKYKLAAIASILVAGAAGVSIPLLGKKVPALNPENHIFFMIKAFAAGVILATGFIHILPEAFERLTSPCLGENPWGKFPFTGLVAMMSAIGTLMVDTFATGYYKRQHFSKPKQVTADEERGQEHAGHVHVHTHATHGHAHGSASPSDEESLSDLIRRRIVSQVLELGIVVHSVIIGVSLGASQRPETIKPLLAALSFHQFFEGLGLGGCISQAKFRFSTMAMMVLFFSVTTPVGIVLGIGISRIYHENGPTALIVEGVFDAASAGILIYMALVDLLAADFMNPRLQXSLRLQLGANISLLLGTGCMSFLAKWA

SEQ ID NO: 82385 - protein, 385 aa, Haemophilus somnus 129PT
MEPSYKEQNNCTETIKINEVKKLWLDSKFSLNLPVWTLLLPLFALLVLAFHLLTHPTGWLINTVTTVLLIGSVFAAVHYAEVIAHKVGEPFGTLVLAIAVTVIEVALIVILMSNSTQENSLVLARDTVYAALMLICNGIVGIGLLIGGMKNYVQLFSLHGIKAAVSVLLAISLIVFVLPNFTLSAEGGGMVNSQLLFVAMCCLVLYGSFIFTQTIRHRNYFVDEDENESHHNDNWLTIGVSIVFLLISLVSVVGLAKMLSPTIESALVSFGLPKIMLGIIVAGLVLLPESIASIKAAYNNQLQNSLNLGLGSALASIALTVPVIAIISVISGQPIVFGLTAKESLMLIITLLLTMNTLSTGRSNFLLGVIHLVMLATFIFFSIIP

SEQ ID NO: 82386 - protein, 339 aa, Acidobacteria bacterium Ellin345
MKAIRIHGFGGPEVLKYEDVPEPELRKDQVLVQVKACALNHLDLFVRKGIPGIKPPLILGSDVSGVVAKVEEYITDLKEGQRVLLAPMRACYHCEFCLRGEHSFCAQFAVRGTRFDGGDCEYVAVPRVEVIPIPESLTYDEAASVPLVFLTAWHMLVSRAKIKHGQTVLVWGAGSGVGTAAIQICKLMGCTVITTAGGERKLDLAWELGADYTIDHYKQKVSDEVKKIVKGGVDVVFEHTGEKTWPESLRSMRVGGTLVTCGATTGPEAKLDLRVLFTRQLTFMGSFMGTFDDLNEALKYVFSGALKPVVDRSFALREAAAAHSYLEKGEQFGKVVLNP

SEQ ID NO: 82387 - protein, 402 aa, Microcystis aeruginosa PCC 7806
MPKKTVANLTEADLAGKRVLVRVDFNVPMDKATGAISDDTRIRAALPTIEDLIKKGAKVILCSHMGRPDGQVKENLRLTPVAKRLSELLGQEVIMCPDCIGEGVTAAISQMSNGQVALLENLRFHGEEEANDPDFAKKLAANADLYVNDAFGTAHRAHASTEGVTHYLSPSVAGYLIEKELNYLQAAIETPQRPLAAIIGGSKVSSKIGVIETLLEKCDKLLIGGGMIFTFYKARGLSVGKSLVEEDKLELAKSLEAKAKEKGVAFLLPTDVVLADKFDKDANSQIVNVENIPDGWMGLDIGPESVKVFQEALSNCKSVLWNGPMGVFEFDKFAAGTDAIAHTLADLTATGTTTIIGGGDSVAAVEKVGVAEKMSHISTGGGASLELLEGKVLPGIAALDEA

SEQ ID NO: 82388 - protein, 391 aa, Oceanicola granulosus HTCC2516
MSWKSLDDMDLAGKRVLTRVDINVPMEDGRVTDATRIERIVPTVRDILDKGGLPILLAHFGRPKGQVVPEMSLRHVVPALEEALGRSVTFVEGGYGEAVAGAGDGDVLLFENVRFNPGEEKNDEGFAERLASVGDVYCNDAFSAAHRAHATTEALAHLLPACAGRLMAAELRALEAALGDPERPVVAVVGGAKVSTKLDLLGNLVTRVDTLVIGGGMANTFLAAQGLDVGKSLCEHDLADTAREIAAKAAEAGCEILLPRDVVVAREFKAGAESEVVKAEDVPADAMILDAGPDSVAHVGMVFERSRTLVWNGPLGAFEIEPFDAASNAAARKAAELTRAGKLTSVAGGGDTVSALNQAGVADDFSYISTAGGAFLEWMEGKTLPGVAALR

SEQ ID NO: 82389 - protein, 316 aa, Trichodesmium erythraeum IMS101
MSNTIVTGVGGFIGSHLAETLLNQDNKVIGIDEFNNYYNPTLKRQNISQFQDHPAFQLIENDIQSLNWSELLVDVDIIYHQAAQAGVRASWGGGFFDYTERNIDATQIILEAAKDAPNLKRLVYASSSSVYGNAETFPTPETVCPQPVSPYGITKLAAEQLGKLYHHNFGVPCVYLRYFTVYGPRQRPDMAFHKFFKWILQDEPISIYGDAQQTRDFTFISDAVAANLLAATVPLAVGEVFNIGGGSRVVLAEVINIMEQIVGRPIKKNFVEKARGDARHTSADVSKAQKILGYQPQISLAEGLKREWEWIRSLYS

SEQ ID NO: 82390 - protein, 436 aa, Synechococcus sp. WH 5701
MSGVLETLAFFRDPDFARSRFERYGDVYETTLLGQRTVFIRGGQAVGDLFAQGDAVQGWWPDSVRKLLGPLSLANRNGVDHKARRRVVGQLFTTVALKRYSPAIVALVNELSHDLLGCAAPVALVPRLRRFAFSVIASTVLGLDPVDRDALFVDFETWCQGLFSLPFALPGSPYARARQARGRLLLRLGSVLNKAQAAVAAGKPLAAGGLDLLAGGLDEAGLPLADDDVAEQLLLLLFAGYETTASSLSCLLQTLLQHPAELAWLQQELGALSWPPPQGEATTAYDAIRAPRLDAVVKEVMRLTPPVGGFFRRTLEPIALAGVLVPADRVVQVSIAASHRHGREDEDLEVFRPQRHLAGDSTATLLPYGGGERVCLGKSLAELEIRLLTVGMLKQLMLVLKPDQDLTLRVIPSPSPTDGLLVRPLPRATGLHSPVR

SEQ ID NO: 82391 - protein, 305 aa, Vibrio parahaemolyticus RIMD 2210633
MNKLVVLGSVNADHVLQVPSFPRPGETLHGRNYQVIPGGKGANQAVAAARLNADIGFIACVGDDSFGINIRENFKMDGIDIAGVKMQPNCPTGIAMIQVSDSGENSICISAEANAKLTSEAIEPDLERIRQADYLLMQLETPMCGIEKAARVAKDAKTNVILNPAPARELSDELLACIDVITPNETEAEVLTGVTVTDNESAQEAANVLHGKGIEIVMITLGAKGVWLSQNGRGEIIPGFRVEATDTTAAGDTFNGAFVTGLLEDLPLESAIKFAHAAAAISVTRFGAQTSIPTREEVDAFLAEQ

SEQ ID NO: 82392 - protein, 633 aa, Kitasatospora griseola
MALLTRIRGPRDLDRLTPAQLAELAEEIRAFLVEEVSKTGGHLGPNLGVVELTLAMHRVFDSPRDRILFDTGHQSYVHKLLTGRQDFSRLKMKGGLSGYPSRAESEHDVIENSHASTVLGYADGLAKANKIQGHKDRPVVAVIGDGALTGGMAWEALNNIADSQDLPIVIVVNDNERSYSPTIGGLANHLATLRTTQGYERFLSWGKDALQRTPVVGQAMFDTLHGAKKGLKDFIAPQGMFEDLGLKYLGPIDGHDLQALESAFTKARNFGGPVIVHCITEKGRGYHAAENNDEDRFHAVGVIHPDTGLPVKTSGKDWTSVFGEEMVALGRERRDLVAITAAMLHPVGLAPFAKAYPERIFDVGIAEQHAAVCAAGLATNGLHPVVAVYATFLNRAFDQVLMDVALHKLGVTFVLDRAGVTGTDGASHNGMWDMSILQVVPGLRLAAPRDAEQVRLQLREAVEVADAPTVVRYSKGNVGPAVPAVGTVGGMDVLRRPEADSADEAADVLIVSIGAMAPTCLEAAELLAQQGISSTVVDPRWVKPVDAALPGLAAQHRLVVTVEDNGRAGGVGSAIAQALRDADVDVPLRDFGIPQEFLDHASRGEILDEIGLTAPAIAKKIEALVSTRSFARS

SEQ ID NO: 82393 - protein, 299 aa, Bacteroides fragilis
GRMVFRAAVKNFGNDIQIVGINDLLDAEYLAYMLKYDSVHGRFEGEVAVEDGALIVNGNKIRLTAEMDPANLKWNEVDADVVVESTGFFLTNETARKHIQAGAKKVIMSAPSKDSTPMFVYGVNHTSYAGQDIISNASCTTNCLAPIAKVLNDKFGIVKGLMTTVHAATATQKTVDGPSKKDWRGGRGILENIIPSSTGAAKAVGKVLPVLNGKLTGMAFRVPTSDVSVVDLTVVLEKAATMAEINAAMKEASEGELKGILGYTEDAVVSTDFRGCANTSIYDSKAGISLDSNFAKVVS

SEQ ID NO: 82394 - protein, 176 aa, Oryza sativa Japonica Group
MSSDSSSWARALVQISPYTFSAIGIAVSIGVSVLGAAWGIFITGSSLIGAAIKAPRITSKNLISVIFCEAVAIYGVIVAIILQTKLESVPTALVHHPESLRAGYAIFASGLIVGFANLVCGVCVGIIGSSCALSDAQNSSLFVKILVIEIFGSALGLFGVIVGIIMSSQATWPAKA

SEQ ID NO: 82395 - protein, 281 aa, Streptomyces avermitilis MA-4680
MIGDTETIEEFLAHRTSDVEEAVRQAAATEIMPRFRQLAAHEIDQKSGPHDLVTDADRKAEAYLTEVLAKLLPGSVVVGEEAVHANPVTYEAIQGEAPVWIVDPVDGTRQFVHGDPGFCTLVALAQGGVVHASWTYAPALDQLATAIRGRGAHLDGEPLRSGAPDPGRDLEVATSHPDYTTEEQKRALLALRTEGVLPRPCGSAGLEYLAVARGELDATAFSWEAAWDHAAGLLLVEEAGGAHLTRAGEPFRITGGNALPFTAARDEATARRVVGLLSAGG

SEQ ID NO: 82396 - protein, 321 aa, Calystegia soldanella
KGQNPVFPRILGHEAAGIVESVGEGVTDLKAGDHVLPVFTGECKECRHCKSEESNMCDLLRINTDSGVMLEDQKSRFSINGKPIYHFVGTSTFSEYTVCHVGSVAKINPLAPLDKVCILSCGISTGLGATLNVAKPPKGSTVAVFGLGAVGLAAAEGARMAGASRIIGVDLVPSRFELAKKFGVTDFVNPKEHSKPVQEVIVEMTDGGVDRSVECTGNVNAMISAFECVHDVWGVAVLVGVPHKDAEFKTHPMNLLNERTLKGTFFGNYKPRSDLPSVVEKYMNKELELEKFITHEVPFAEINKAFDLMLKGEGLRCIITM

SEQ ID NO: 82397 - protein, 236 aa, Zea mays
KEQRSGACSSFLHCQSCIPSRPRPRRPTPPFRPRVSVAAPLSVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 82398 - protein, 87 aa, Opitutaceae bacterium TAV2
MADQKTIEQRVKEIIVNQLNVNEEQITPQASFLDDLGADSLDTVELIMAFEEEFKDEIKGEIPESDAEKLRTVGQVIDYITGKAAQV

SEQ ID NO: 82399 - protein, 248 aa, Opitutaceae bacterium TAV2
MTYTHRTALITGAGRGIGKAIAEVLAAKGVTVICVSKSAETCGAVAQAINAAGTGGKAVARAVDVSDGAAVAAAAESLLKEFGKIDILVNNAGITRDGLLARMSEDDWNAVLQTNLSSCFHWTKAIGWPMCRNRWGRIVNISSVSGLIGNAGQANYAAAKAGMVGFTKSIAKEFARRGVTANVVAPGFIKTDMTAVLNEEVQKGATALIPMQRFGEASDIAHAVAFLASEEANYITGQVFTVDGGMAM

SEQ ID NO: 82400 - protein, 369 aa, Xanthomonas axonopodis pv. citri str. 306
MKSRAAVAFGPGKPLEIVEIDVAPPKAGEVLVRITHTGVCHTDAFTLSGDDPEGIFPSVLGHEGGGIVEQVGEGVTSVKIGDHVIPLYTAECRKCKFCLSGKTNLCQAVRATQGKGLMPDGTTRFSYNGEPIYHYMGCSTFSEYTVVPEISLAVVNPEAPLEKVCLLGCGVTTGIGAVHNTAKVKPGESVAVFGLGGIGLAVIQGAVQAKAGRILAIDTNPGKFDLARSMGATDCINPKDYDKPIQEVIVELTDGGVDFSFECIGNVNVMRSALECCHKGWGESVIIGVAGAGQEISTRPFQLVTGRVWRGSAFGGVKGRTQLPGMVEQSMKGAIDLDPFITHTMPLEEINEAFHLMHEGKSIRTVIHF

SEQ ID NO: 82401 - protein, 348 aa, Glycine max
METRAAAKRKANAAIVVVVEKQHPKRQRVVLGELPNLQNLIVSKIQNPRKEKLQCRKNPNANKPSPTNNTLSSPQLDGSYVSDIHEYLREMEMQKKRRPMVNYIEKFQKIVTPTMRGILVDWLVEVAEEYKLLSDTLHLSVSYIDRFLSVNPVTKSRLQLLGVSSMLIAAKYEETDPPSVDEFCSITDNTYDKAEVVKMEADILKSLKFEMGNPTVSTFLRRYANVASDVQKTPNSQIEHLGSYIGELSLLDYDCLRFLPSIVAASVIFLAKFIIWPEVHPWTSSLCECSGYKPAELKECVLILHDLYLSRKAASFKAVREKYKHQKFKCVANLPTPPYVPSCYFEDQ

SEQ ID NO: 82402 - protein, 360 aa, Flavobacteria bacterium BBFL7
MRMSNKYAVIMAGGVGSRFWPVSKQSFPKQFHDMLGLGKSLLQMTFTRLQAQIPANNILILTNEAYVDLVKEQLPEVLPENIVAEPAMRNTAPCILLAALKIQKMNPEASMIVAPSDHYIAEEDLFNEDLATTFAFCEQHPQALMTLGIQPTSPNTGYGYIEYNHETTAVKKVNQFREKPNLETAQQFLDAGNFLWNAGIFIWSVDAVVNAFAKAQPTMTQLFTNGMQVLNTEEEVSFLESEYPKAENISVDYAIMENSEEVYVLPARFSWNDLGTWGSLYDKLDKNEESNAIVNASVTAIASHGNMVRTAPGKKVILQGLEDYIVVDQDDVLMIIPKNAEQEIKEIRNTAMDKYGEEIG

SEQ ID NO: 82403 - protein, 767 aa, Oryza sativa Indica Group
MGSACEAGTDEPSRDDVKGTGNGILENGHSHKSEEEEWRNGMGEDLPNGHSTPPEPQQTDEQKEHQVRIVRWERFLPVKTLRVLLVENDDSTRQVVSALLRKCCYEVIPAENGLHAWQCLEDLQNHIDLVLTEVVMPRLSGIGLLSKITSHKICKDIPVIMMSSNDSMGTVFKCLSKGAVDFLVKPIRKNELKNLWQHVWRRCHSSSGSGSESGIRTQKCTKPKVDDEYENNSGSNNDNEDDDDNDEDDDDLSVGHNARDGSDNGSGTQSSWTKRAVEIDSPQQMSPDQPSDLPDSTCAQVIHPTSEICSNRWLPTANKRSGKKHKENNDDSMGKYLEIGAPRNSSMEYQSSPREMSVNPTEKQHETLMPQSKTTRETDSRNTQNEPTTQTVDLISSIARSTDDKQVVRINNAPDCSSKVPDGNDKNRDSLIDMTSEELGLKRLKTTGSATEIHDERNILKRSDLSAFTRYHTTVASNQGGAGFGGSCSPQDNSSEALKTDSNCKVKSNSDAAEIKQGSNGSSNNNDMGSSTKNAITKPSSNRGKVISPSAVKATQHTSAFHPVQRQTSPANVVGKDKVDEGIANGVNVGHPVDVQNSFMQHHHHVHYYVHVMTQQQQQPSIERGSSDAQCGSSNVFDPPIEGHAANYSVNGSFSGGHNGNNGQRGPSTAPNVGRPNMETVNGIVDENGAGGGNGSGSGSGNDLYQNGVCYREAALNKFRQKRKVRNFGKKVRYQSRKRLAEQRPRIRGQFVRQSGQEDQAGQDEDR

SEQ ID NO: 82404 - protein, 163 aa, Triticum aestivum
  misc_feature (135)..(135): Xaa can be any naturally occurring amino acid
MSAANRSQPIKLNRPVVGKARKLKDLMLKSDNRVCADCSAPDPKWASSNIGVFLCLKCGDVHRALGQDISNVLSLTLDDWSDSDIDSMIEVGGNSYANSIYEAFLPKDHPKPKPDSPMEYRTKFIRAKYETQDFXKPSLRISSKAGFRIYQFFEQCGLLVFLA

SEQ ID NO: 82405 - protein, 294 aa, Opitutaceae bacterium TAV2
MNVAEITAKAKVLLEALPYIQNFRGSTFVVKYGGSFMDDPDPTVRNRVAHDIALLAACGINVVVVHGGGKAITKAMAGSGIQAQFARNGMRITDEATIAIVKRTLDEVVNKDVCDAIALAKARPKGLPGDTVLVCEKLTTDDDGNPIELGYVGEVTEVKVKLIKKEIADGFVPIISPVAEGLDGKPYNVNADLVAGRVAAAMRARRLVYMSDVPGLLANPSDPDSLISTLKVGQVDELKRKGVIDKGMRPKVMSAVRALTEGVHRVHFIDGRLPHSLLLEIFTDRGIGTEIVHG

SEQ ID NO: 82406 - protein, 400 aa, Cyanothece sp. ATCC 51142
MRDCIYLDNNATTQIDEEVLGAMMPYLTLYYGNPSSMHTFGGQVGKAVKTAREQVASLLGAEPSEIIFTSCGTEGDNAAIRAALTAQPNKRHIITTEVEHPAVLNLCRHLEKQGYTVTYLGVDSQGRLDLDEVQASITGGTALVTIMYANNETGVVFPIEQVGALAKEYGALFHVDAVQAVGKIPLDMSSSTIDMLTLSGHKVHGPKGIGALYVRKGTRFRPFMVGGHQERGRRAGTENVPGIVALGKACELAESHLANISHERQLRDYLETSILTLIPDTVVNGSTKERLPNTTNIGFKYIEGEAILLSMNQYGICASSGSACTSGSLEPSHVLRAMGLPYSVLHGSIRFSLSRYTTQDEIDRVIEVLPDTIARLRSLSPFSSDDATWLQEQEKATLAK

SEQ ID NO: 82407 - protein, 263 aa, Xanthomonas axonopodis pv. citri str. 306
MPLSVFVIDAFTTLRFKGNPAAVVPLQAWLPDALMQAIASENNLSETAFFVRDADGVFAIRWFSPLKEVGFCGHATLASAFVIATQQLAPFPLRLRAAAVGELGVERLADGSFEMRFPNQAPALVAAVPQALLDALSIAPQAVYANRQAYIAVYADERQVREVVPDLTRMLALAPRDVAVTAAGSGHDFVSRYFWPANGGAEDPVTGSIHAALAPLWAQTLGKAQLTALQASARGGELGCRVEGPHVYVRGSAVQYLHGTIAL

SEQ ID NO: 82408 - protein, 285 aa, Cyanothece sp. ATCC 51142
MDLFYNPRNQGTITEKGEGQAITTGEVGSIACGDALRLHLKVDEKTEIILDARFQTFGCASAIASSSALTELLVGKTLDEALSLTNKEIADFLGGLPEEKMHCSVMGQEALEAAIFNYRGIPLDNHEDDEGALICRCFGVTDSRIRRIVLENNLTTAEQVTNYVKAGGGCGSCLADIDDMIADILQEKATAVAVATEVVKAKSETKPLTNLQKITLIQQVLEEEIRPFLAKDGGDLELIDIEGDLVKVTLQGACGSCASSTATLKGGIEARLKERVSPELTVIAV

SEQ ID NO: 82409 - protein, 475 aa, Streptomyces lavendulae
MPGTPVVQNPADRLAGPADPLGLRRLSAGLNLLRRPLPFLQELASGYGDVCAMPGRNPRTVFAFGPDQARQVLTGKSFVSDSFRHLRLPPGSPMMLLTSGLLRLNGTIHRKHRQAMQQAFSPRHVTVYTDTIVRFADDMLDGWTPGRSVDLHEELARLVTRISLATMAGLEDEAAARHLNDKMVELAAAAGHPLTAVIQAPLPGTPFRRMTRIAGEIEDILRALIAARRSGAAAPDLLSKLTVPDAEADAEELSDEELLGEAYTALCHDSVASSLFWTLFLLDQHREWWEKLRAEVAEVAGDAAPGPDVLVRMPVLDRIVKESVRLMPPAGFGVRYAEEGAVIDGHPIPKGAMTIFSSFVTHRDAGTFPEPLRFRPERWETAQPSQHEYFPFGLGQHNCIGRNLALLESKLVLTRIMQRAPVVLPAGTVVDPVVRISTVPDGHVRALVAGPDGPAPRAYRVTGSVNEIIELPEHP

SEQ ID NO: 82410 - protein, 176 aa, Vitis vinifera
MVTIQFVKARQIFDSRGNPTVEVDIGLSNGAKVSAAVPSGASTGIYEALELRDGGSDYLGKGVSKAVANVNTIIGPALIGKDPSDQTGIDNFMVQQLDGTVNEWGWCKQKLGANAILAVSLAVCKAGAIVKNIPLYKHIANIAGNKHLVLPVPAFNVINGGSHAGNKLAMQACLLI

SEQ ID NO: 82411 - protein, 212 aa, Vitis vinifera
MATTLTMARLLSSAKSLSFSSSASALFPPASLSLKLRHPKPLRFSTAISATIAVGDKLPESTFSYFDSAGELQTTTVSDLTKGKKAILFAVPGAFTPTCSQKHLPGFVEKSGELKSKGVETIACISVNDAFVMKAWKADLKIEDQVLLLSDGNGDFTKAIGCELDLSDKPVGLGVRSRRYAMLVDDGVVKVLNLEEGGAFTFSGAEDILKLL

SEQ ID NO: 82412 - protein, 481 aa, Zea mays
  misc_feature (84)..(84): Xaa can be any naturally occurring amino acid
  misc_feature (92)..(92): Xaa can be any naturally occurring amino acid
TIEQVCTKKQAGTGPEFPGSRTGEVIASIAEGGKADVDLAVKAAREAFDPGPRPRVSRYERGRILPRFPDLIDEHVEELAALDXTVDAGQLXFPVGQARDIPGAAHLLRYYAGAADQVHGATLKMAQRMHGYTLKEPVGVVGHIVPWNYPTTMFFFKVGPALAAGCAVVVKPAEQTPLSALFYAHLAREAGVPAGVLHVVPGVGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDNKGYYIEPTIFTDVKDDMTIAQDEIFGPVMALMKFKTVEAVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 82413 - protein, 331 aa, Alkalilimnicola ehrlichei MLHE-1
MRVLVTGGAGYIGSHVVRQLLAAGHEPVVYDNLSTGFAWAVGEAPLVRADLADTAQLAETLARHAFDAVLHFAAHTVVPESLSDPLRYYGNNTRNTWQLLQACHEAGVKRFVFSSTAAVYGMPETMPVAEDAPLAPINPYGASKMMSERMLMDLGAASDLRYVCLRYFNVAGAEPSGRLGQATPQATHLIKVACEAAVGRRDGVTVFGTDYATPDGTCVRDFIHVEDLARAHIQALSHLVDGGDSQVLNCGYGRGYSVLEVLEAVKRLSGADFPVTLGTRRAGDPAQVVADNRRILRTLDWSPRYADLDTIVAHALAWERDGLLARRGPRR

SEQ ID NO: 82414 - protein, 138 aa, Vitis vinifera
MRGVDEGKGKETVTFRAPSHDEEGRKRVEKVEVDTLKYIEKKLENKGVLRMERHPADGLSLKRGPPKSGHGGKYTWEGPKDSVHNELEGAPPALDEKDPNFVDEEEEERIVKGEEEDLRWPRLLRSKKALLELRLILA

SEQ ID NO: 82415 - protein, 511 aa, Flavobacteria bacterium BBFL7
MQHDKVLILDFGSQYTQLIARRVRELNIYSEIHPFNKVPSNLDDYKAVILSGSPMSVRSESAFHIDLNEVRGKKPLLGVCYGAQYLAHFHGGEVGASSTREYGRANLSYVKSGETFLEGIASGSQVWMSHSDTIKKLPTDGELLASTHDVENAAYKINGEDTYAIQFHPEVYHSTDGKQILENFLIKIANVNPDWTPNAFVEETVEALQEKVGNDKVVLGLSGGVDSSVAAMLLHKAIGENLYCIFVNNGLLRKDEYTQVLKQYEGMGLNVKGVDASARFMDALAGLDDPELKRKAIGRVFIEVFDDEAKEVQNVTWLAQGTIYPDVIESVSATGGPSATIKSHHNVGGLPDFMKLKIVEPLRALFKDEVRRVGASMGMAAELLGRHPFPGPGLAIRILGDITPEKVAILQEVDAVFINNLKKWDLYDKVWQAGAILLPVNSVGVMGDERTYEKCVALRAVESTDGMTADWVNLPYEFLQATSNEIINKVKGVNRVVYDISSKPPATIEWE

SEQ ID NO: 82416 - protein, 339 aa, Leucoagaricus meleagris
MVKVGINGFGRIGRIVLRNALQLQDLEVVAVNDPFIDLDYMAYMFKYDSVHGRFKGTVEVKNGNLVVDGRSMKVFAERDPAAIPWGSVGADYVVESTGVFTTTEKASAHLKGGAKKVVISAPSADAPMYVCGVNLDKYNPKDTVISNASCTTNCLATLAKVIHDNFGIVEGLMTTVHATTATQKTVDGPSHKDWRGGRGVGGNIIPSSTGAAKAVGKVIPSLNGKLTGLSMRVPTQDVSVVDLVVRLEKAATYDQIKDVMRKAAEGEYRGIIEYTDEDVVSTDFISDNNSCVFDAKAGIQLNPNFVKLIAWYDNEWGYSRRVCNLLQYIAKKDAEAASK

SEQ ID NO: 82417 - protein, 445 aa, Pseudomonas fluorescens PfO-1
MFLDVFVKFSLPKIATAPFCPPEVAGSVPVDPNASFFKRVLRFAGPGLLVSIGYMDPGNWATAIEAGSRFGYSLLFVVLLASLAGMVVQCLCSRLGIATGRDLAQLSRERYSTPTARLQWVLAEISIIATDLAEVLGCALAFHLLLGCSLTFGIALTAFDTLLVLALQNRGFRRLEAIMLVLVGTIGACFFVELLLIKPYWPDVAQGFTPSLSAISDAAPLYLAIGILGATVMPHNLYLHTSIVQTRLIGKDLASKQDAVKLARIDTIGSLALALLVNAAILILAAAAFHQSGHTDVVDIQDAYHLLDPLVGGALASVLFGVALLASGQSSTFTGTIAGQVIMEGYLNLRIPCWQRRLITRGLALIPAFIGVWLMGDGAVGKLLVLSQVVLSLQLPFALYPLIRMTNDKQLMGPFVNRLPTQVLAWGLFVLISGANAWLILQLAA

SEQ ID NO: 82418 - protein, 509 aa, Microcystis aeruginosa PCC 7806
MVKLLENPLRVGLRQERTPEPLILVIFGASGDLTQRKLVPALYQLKRERRLPAELTIVGTARREWSHDYFRQQMRQGIEEFSDGIGSEEYWQDFAQGLYYFPGNMDDPESYAKMKVFLEELDGIRGTRGNRVFYLAVSPNFFPPGLKNLGAAGMLKDPIKHRLVIEKPFGKDLSSAQVLNRVVQEVCQENQVYRIDHYLGKETVQNLLVFRFANAIFEPLWNRQFIDHVQITVAETVGVEERAGYYEKSGALRDMVQNHLMQLFCLTAMEAPNAINADSVRGEKVKVLQATHLADINNLEKSAIRGQYKAGWMKGKPIPGYREEPGVNPESTTPTYVAMKLMVDNWRWQGVPFYLRTGKRLPKKVSEIAIQFRHVPLLIFQSAAQQTNANVLSMRIQPNEGIALRFEAKMPGSELRTRTVEMDFSYGSSFGVTSADAYNRLLLDAMLGDQTLFTRSDEVEEAWRIVTPALAAWDAPADPASVPQYEAGTWEPTEAEFLLNRDGRRWRRL

SEQ ID NO: 82419 - protein, 482 aa, Mycobacterium sp. JLS
MDTTALLKSVPTGLWIGGEEREAKSTFNVLDPSSDEVLVAVGDATAEDAVAALDAACAVQAEWAATPARKRGEILRSVFETLTDRADDIAALMTLEMGKVLAESKGEVTYGAEFFRWFAEEAVRIGGRYTPSPAGTGRIIVTKQPVGPCYAITPWNFPLAMGTRKMGPAFAAGCTMIVKPAQETPLTMLYLAKLMAEAGLPKGVLSVLPTSSPGPVTEALVDDGRLRKLTFTGSTGVGKSLVKQSADKLLRTSMELGGNAPFIVFDDADIDAAVDGAMLAKMRNGGEACTAANRFHVANSVREEFTEKLVKRMSEVTLGNGLDESATLGPLINNKQLQKVTELVSDAVSRGATVAVGGVAPGGPGNFYPATVLADVPADARILKEEVFGPVAPITGFDSEEEGVAAANDTEYGLAAYVYTRSLDRALRVAEAIESGMVGINRGVISDAAAPFGGVKESGFGREGGTEGIEEYLDTKYIALTK

SEQ ID NO: 82420 - protein, 554 aa, Mycobacterium sp. JLS
MTADDQLTDISATSAWQALQRHHGEIAGRHLRELFAEDPSRGTELTVSVGDLYIDYSKHRVTRETLRLLVDLARAAGLEKRRDAMLSGVHINTSEDRAVLHTALRLPRDASLTVDGQDVVADVHEVLDRMGDFTDRLRSGDWTGATGERIRTVVNIGIGGSDLGPVMVYEALRHYADAGISARFVSNVDPADLVAKLDGLDPATTLFIVASKTFSTLETLTNATAARRWLTDTLGDAAVARHFVAVSTNQKLVDEFGIDTANMFGFWDWVGGRYSVDSAIGLSVMAAIGRERFAEFLAGFHLVDEHFRTAPLEANAPALLGLIGLWYSNFFGAQSRAVLPYSNDLSRFAAYLQQLTMESNGKSVRADGTPVSTDTGEIFWGEPGTNGQHAFYQLLHQGTRLVPADFIGFSQPTDDLPTADGTGSMHDLLMSNFFAQTQVLAFGKTAEEIAAEDTPADVVPHKVMPGNRPTTSILATKLTPSVVGQLIALYEHQVFTEGVVWGVDSFDQWGVELGKTQAKALLPVITADDSPAEQSDTSTDALVRRYRAERGRSA

SEQ ID NO: 82421 - protein, 382 aa, Cryptococcus neoformans var. neoformans JEC21
MTNPLLAHFQDTFFPPCRVGINGFGRIGRAAFRASLERDDLIVVAINHTAPSIDYLLHAIKYDSTHGTSRHANDLSIKDGALYYKDRRIELFSQRDPLLLDWKSAGVEYVVESTGKMTTVATASAHIKSGARKVVISAPSKDAKTIVVGVNRKDYDSSMSVVSNASCTTNCLAPLAKVLNRAFGIEFGMMTTVHASTSSQPILDGYSKKNRRLGRGVGSNIIPTTTGAATAVQLVLPELAGKFTGVSVRVPVDNVSMVDLTVRLNKPVASKEELFRPIREASTGLSSLGPLANVLCVNDDELVSRDFLGWQHSCIVDSAASVMLNDRVFKIIAWYDNEYGYACRLLDLVRFIHEYDNGKVPTPTPSGVQTPSGVHTPILRSI

SEQ ID NO: 82422 - protein, 415 aa, Acidobacteria bacterium Ellin345
MKWTRHWKTRLLLIFAVIGPGFITANVDNDAGGIFQYSAAGAQFGYGLLWTLLPTTIALIVVQEMAARLGAITGKGLSDLIREEYGLRITFFMMLGLVICNFGNVVAEFAGIASSLELFNVSKYISVPVCALIVWLLIVKGNYKNVEKVFLAASFVYFAYIVAGWWAGPAWKEALVATVKPSSNVNFRDKDYVYTIIGLVGTTIAPWMQFYLQASIVEKGITAKQYKTSRWDVIIGCIFTDVVAWFIIVACAATLFVHGFRTINTGADAAKALAPLAGQYAFILFAVGLFNASLFAASILPLSTAYTVCEGLGFESGVDKSFGEAPFFYWLYTILIAAGAAVILIPNLPLVRISILSQVVNGAVLPFVLVFMVLLANKHELMGKHVNGRVFNWIAWATTAIMVGLTVAWFGSLGK

SEQ ID NO: 82423 - protein, 152 aa, Zea mays
  misc_feature (56)..(56): Xaa can be any naturally occurring amino acid
  misc_feature (99)..(99): Xaa can be any naturally occurring amino acid
MASATVLKSSFLPNKCEWIATRQADRSRPPTGSMVRRVSAYADELVKTAKTIASLXCGILTMDESNARCGKRLATIGLENTEANREAYRTLLVTTSALXQYISGAILFEETMYQSAVDGRKIVDILAKHGIVPGIKVDKGLCPIAGSTTSRG

SEQ ID NO: 82424 - protein, 327 aa, Candidatus Protochlamydia amoebophila UWE25
MWRGLSKFKMGKQIFITGIAGFIGFHLAQKLAKRGDRIIGYDNFNPYYDTQLKRDRALKLSKLGIEIIEGDIQNYEKLQNSILLHQTTHLIHLAAQAGVRYSLQEPATYLKTNVDGFLNILEICRSHPHLKLIYASSSSVYGLNTKVPFSLEDRTDQQASLYGVTKKTNELMAKTYHHLFGISSIGLRFFTVYGPWGRPDMAYFSFANAIVQGKPIEIFNEGKMQRDFTYVDDIVEGTIGAIDTEISLGVFNLGNHRPVELLYFVLLLEKELGIEAHKIWLPMQSGDVVATFADIQESTKQLGFQPKISIEEGLCRFVKWYKNYYNL

SEQ ID NO: 82425 - protein, 561 aa, Physcomitrella patens subsp. patens
MATNDVVSVSHSMLLKATDLKDDRIDVISICLFVFLLCACIVLGHLLEENRWMNESITALLLGLFTGSIVLISSKGQGSHILEFDEELFFIYLLPPIIFNAGFQVKKKEFFRNFITIMFFGVIGVFISFGIISTGSWYFFSKFGLKNLPIRDILAIGVIFSATDSVCTLQVLNQDETPLLYSLVFGEGVVNDATSVVLFRAVQTYNFDNFTSLEGLQIGGSFLYLFFSSCILGIASGLISAYIIKTMYFGRHSTDREIAIMTLMAYLSYVFAELFYLSGILSVFFCGIVMSHYTWHNVTENSRITSKHSFATMSFIAETFIFLYVGMDALDFEKWKMMQSSFTESAGLFGSLLFLVLLGRAAFVFPLSALSNYSTKSPDAKINLRQMVIIWWAGLMRGAVSIALAFNQFTQGGDAKDSNQATLMVITIIIVLFSTIVFGTATKPLISWLLPPHFRSNYSDSASLSPKASLDADFHIPLLMDTEREELEANDRSTINQILNGLPRPQSIGMLLTAPRSTIHHVWRKFDDSYMRPTFGGRGYVRLVSRRDMDIQEDEILEDHS

SEQ ID NO: 82426 - protein, 237 aa, Trichodesmium erythraeum IMS101
MVTEQDPTTLMKQQVGKAAAEEVKSGMIVGLGTGSTTAYMIQFLGELLQRGELKDIKGIPTSFQSTVLAKKYGVPLTTLDEVDYMDIAIDGADEVDPQKNLIKGGGAAHTREKIVDCLAEKFVVVVDSSKLVDKLGSTFLLPVEVIPMAMNPVIRAIEKLGGQPEVRMGVKKAGPIVTDQGNLVIDVKFDSIDNPGELEKSLNNIPGVLENGLFVGVADVILVGEIDNGKPIVRTIS

SEQ ID NO: 82427 - protein, 226 aa, Oryza sativa Japonica Group
MKLEVMPKQRAMEAEQREEAMEMSGLELWKHEKPASMVVFLPPPPPPPPLVPAAAAAAAAACGEEATLVPPLNFAMVDDGIFRSGFPAAANFRFLKSLNLRSIVYLCPEPYPETNAEFLAKNGIKLHQFGIEGRKEPFVNIPDDKIREALKVVLDVKNQPLLIHCKRGKHRTGCVVGCLRKLQKWCLSSVFDEYQRFAAAKARSTDQRFMELFDISSLKHLTASHC

SEQ ID NO: 82428 - protein, 645 aa, Streptomyces avermitilis MA-4680
MDLSRVTRTPQIPPRADPERRPIWPMSGNSEVRGRMFTTRPTLQGTFGMVSSTHWLASQSAMAVLEEGGNAYDAAVAAGFVLHVVEPHLNGPGGEVPIILAPAGGEVRVLCGQGVAPAGATIEHYKGLGLDLVPGTGPLAAAVPGAFDAWMLLLRDYGTKSLADVLKYAIGYAQDGHAPVERVGETVETVRELFETEWVSSAEVYLPGGKAPRPGELFRNPALAATWKRLIAEVSGTGDRVAQIERAREVWRGGFIAEALVRQSGRPTLDTSGERHTGTLTAADLASWAATYEAPATYDWQGWTLCKAGPWSQGPVLLQQLALLPPELPRYGSADYVHLLIEGCKLAMADREAWYGDAAEVPLAELLSDAYNAERRVLVGHKASYELRPGSPGGRTPRMSGHARVVAADEPEPAFGPPGAGEPTVAKSPLSPVPGEPDIAADGGTRGDTCHLDVVDRWGNMIAATPSGGWLQSNPVVPELGFPLGTRLQMAWLDEGLPNSLTPGRRPRTTLTPSLALRDQVPVLAFGTPGGDQQDQWQTHFFLAVVLRSGVRGGLDLQGAIDAPNWHNDSFPGSFYPRGTRPGSVTVESRTDPGVVEELRRRGHDVLVGEAWSEGRLCAVARDPETGVLSAAANPRGMQGYAVGR

SEQ ID NO: 82429 - protein, 313 aa, Acidobacteria bacterium Ellin345
MIAPDFQNTRIPLHHGAGHIPALGFGTLIADPALTITATRDALAAGFRHFDCAERYRNEREVGEALRAGRAAGNIAREEIFVTTKLWNTNHRPERVEPAFEASLDRLGLDYLDLYLIHTPFAFQPGDEQDPRDQNGSVIYDEGVTLRETWSALENLVDRGRCRAIGLSDISMDRLAPIYEAARIKPAVVQVESHPYLPETELLEFCKRNGIVLLAFAPLGHGMRPGLLEDPVITSVSERVGKTAAQVLLSWAVQRGTALLTTPRSAARAKENFDISPLPEEAFNEINRIQTRQRLNPVVSTGVPGFIPRPESA

SEQ ID NO: 82430 - protein, 596 aa, Bordetella petrii
MSTLVEIKVPDIGDFKEVEVIEVLVSEGDTIQAEQSLITVESDKASMEIPASSGGVVKSVKVKVGDKVAEGKVILQVEAGETKEAKPAPAASQVSDSQRVSDTVTKEKAPQKGQPVNAAAQYSGSADVECDVLVLGAGPGGYSAAFRAADLDLSTVLVERYDTLGGVCLNVGCIPSKALLHNAAVIDEARALAAHGISFGEPKIDLDKLRGYKDSVVAKLTGGLAGMARARKVKVVTGVGEFADPHHLAVKGADGKTQTIRFKNAIIAAGSQSVKLPFLPDDERIVDSTGALQLRAIPKKMLIIGGGIIGLEMGTVYSTLGARLDVVEMLDGLMQGADRDLVKVWQKMNAGRFDNIMLKTKTVGAEARKDGIYVSFEGEGAPKEPQRYDLVLQAVGRSPNGKKIGADKAGVAVTERGFIEVDKQMRTNVPHIYAIGDIVGQPMLAHKAVHEGHVAAEAAAGQKSFFDARVIPAVAYTDPEVAWVGLTEDEAKKQGIKVEKGLFPWAASGRAIANGRDEGFTKLLFDAESHRILGGGIVGTHAGDLISEIALAIEMGADMVDIGKTIHPHPTLGESVGMAAEVAEGVCTDLPPVRKK

SEQ ID NO: 82431 - protein, 333 aa, Candidatus Protochlamydia amoebophila UWE25
MKKIGYLGLGAWGYCLASLLASKGHKVVCWTTKPELAKHLTDTREHPLLAGHLSKGEMTFTTDMSEALKDVDMIVESVTSAGLRSVFEQVRSLGLPNCPIVITSKGIEQDTGMILPEVVIEVLGEEFRSLIGFLSGPSFAQEVIRELPTSVVGTGYTVEVIQEICETFMTPTFRVYPNTDILGVAFGGALKNIIGIACGISDGLALGCSSKAALMTRGLHEIRKLSVACGCKAETLNGLAGMGDLCVTCSSPISRNFRFGTLLAQGLSTEQARNRIGMVVEGAYTCVSALQLSKQHKIIMPISEAVYNIIQGTIKPIEAVSALMKRTIKEEHL

SEQ ID NO: 82432 - protein, 606 aa, Silicibacter sp. TM1040
MPLPAALTQFLASVHPYDSLPDPVLAHVAQQCALHNVAVDERLFSLGDTVSSLYIIVSGEIEITDEAGVQLSILGSRNSFGERALLRGERASRSARATSASEVIALPAEVFHQLIDQHESVARFFDRRRPPPRTGNSLASLTVEQLMTRAPVTCTPETPIRDAAALMHRHHISSICICDPDGFHGIVTLRDLNSKVIVGGIDPLEPISGIMTEDVLTLAPQALVTDVLHLMVERNIHHVPIVNERGLLGIVTQTDLTRAQALSSADLVGRIARAEDASEMARATAQIPQLLVQLVEAGNRHEVITRLITDIADIATRRLLSLAEAQLGPPPVPYLWLACGSQGRQEQTGVSDQDNCLILSDDLTDAQMPYFAKLARFVSDGLDRCGYFYCPGDMMATNPRWCQPLRVWRGYFQTWIAKPDPEAQMLASVMFDLRPIGGDKSLFDHLQSDTLEAAAKNSIFTAHMISNSLKHQPPLGLLRGLATIRSGDHRDELDLKHNGVVPVVDLGRIYTLQGRLRPVNTRARLEAALAAGLLSASGGADLLDAYDLIASMRLELQTKQIKAGQAAGNYLNPSSLSDFERSHLRNAFVVVKTMQSAVGSGTGTLG

SEQ ID NO: 82433 - protein, 649 aa, Kitasatospora griseola
MPLLSRITGPADLRRLHPEQLPPLAAEIRAFLIDNVTRTGGHLGPNLGVVELSIALHRVFDSPHDRILWDTGHQAYVHKLLTGRQDFSRVRAKDGLSGYPSRAESPHDLIENSHASTALGHADGIAKADQLLGVDRCTVAVIGDGALTGGMAWEALNNIAEAEDRPLVIVVNDNERSYAPTIGGLAHHLATLRTTKGYERFLAWGKDALQRTPVVGPPLFDALHGAKKGFKDAFAPQGMFEDLGLKYLGPIDGHDIAGVEQALRRARNFGGPVIVHCLTVKGRGYRPAEQDEADRFHAVNPIDPYTCLPISPSAGASWTSVFGKEMLALGAERPELVAVTAAMLHPVGLGPFAKAYPGRTFDVGIAEQHAVASAAGLATGGLHPVVAVYATFLNRAFDQVLMDVALHRLGVTFVLDRAGVTGNDGASHNGMWDLSVLQVVPGLRIAAPRDAARVREHVRQAVAVEDAPTVVRFPKGELGPEAPAIERIGGVDVLARTGPAPDVLLVAVGPMAAACLDAAALLAADGITATVVDPCWVKPVDPALVELAGAHRMVVTVEDNGRTGGVGAALAQAMRDADVDTPLRDLGIPQEFLAHASRGEILEEIGLTGTGVAAQTAAHARRLLPGTGTRPGAQEYRPRMPLTDWSEPA

SEQ ID NO: 82434 - protein, 372 aa, Actinobacillus pleuropneumoniae serovar 1 str. 4074
MEFIKTRAAVAWAPNEPLKIEELDLMPPQKGEVLVRLVATGVCHTDAYTLSGQDSEGVFPCVLGHEGAGIVEAVGEGVTDFKVGDHVIPLYTAECRKCKFCLSGKTNLCSAVRETQGKGLMPDGTVRFFKDDQPIFHYMGTSTFSEYTVVSEYSLAKIQENAPLDEVCLLGCGVTTGIGAVTRTAKVKKGDTVAIFGLGGIGLAAIIGARMAGAGRIIAIDINPAKFEKAKELGATDCINPKDYEQPIQNVIIEMTDGGVDFSFECVGNVDLMRSALECCHKGWGESIIIGVAPAGAEIRTRPFQLVTGRVWRGSAFGGVKGRTELPGIIDQFMKGEFKLRDFITHTMPLEDINKAFDLMHEGKSIRTVIHF

SEQ ID NO: 82435 - protein, 606 aa, Oryza sativa Indica Group
METHIGSVDGAAAAADNGAVGCPASAVGCPMTSARPAPVSAGEASLGRHLARRLVQVGVSDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVTNLEDAHEQIDTAIATALRESKPVYLSISCNLPGLPHPTFSRDPVPFFLAPRLSNKMGLEAAVEATVEFLNKAVKPVLVGGPKLRVAKAGKAFVDLVDASGYAYAVMPSAKGLVPETHPHFIGTYWGAVSTAFCAEIVESADAYLFAGPIFNDYSSVGYSFLLKKDKAIIVQPERVIVGNGPAFGCVMMKEFLSELAKRVNKNTTAYENYKRIFVPEGQPLESEPNEPLRVNVLFKHVQKMLNSDSAVIAETGDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKKDCLCFIEVIAHKDDTSKELLEWGSRVSAANSRPPNPQ

SEQ ID NO: 82436 - protein, 328 aa, Kluyveromyces lactis
MPASSDKLQPKDQQTIELEQKLAVQSIRVFLQSKTSYDVLPVSYRLIVLDTSLLVKKSLNILLQNNVVSAPLWDAQTSKFAGLLTSSDFINVIQYYFHNPDKFELVDKLQLNGLKDIERAIGIQPYDTRSIHPFRPLYEACVKMIESRSRRIPLIDQDEETQREIVVSVLTQYRILKFVALNCKEIRYLKRPLRELDIISTNNIMSCQMSTPVIDVIQLLTLAGGVSSVPIVDEQGKLVNVYEAVDVLGLIKGGIYNDLSLSVGEALMRRSDDFEGVFTCTEKHKLSSILDTVRKSRVHRFFVVDSNGFLTGVLTLSDILKYILFAES

SEQ ID NO: 82437 - protein, 273 aa, Glycine max
NFPRQQGEKKNSDELAQKMAKLCDVYVNDAFGTAHRAEATTHGIAKFAPVACAGPLLAAELDALGKALGQPARPLAAIVAGSKVSTKLTILTSLAEKVDNLIVGGGIANTFMLASGLKIGKSLVEADLVGEAKAIIDMMAKRGASVPIPVDVVCAKEFSATAAATVKDVKDVTDDDMILDIGPKTASQLAEQIAKAGTVVWNGPVGVFEFDQFGEGTKTLAMAIANSKAFSIAGGGDTLAAIAKYNIADKVGYISTGRGAFPEFLERKTLPAV

SEQ ID NO: 82438 - protein, 489 aa, Photorhabdus luminescens subsp. laumondii TTO1
MRIQNKMLINGDWIDASDGQTIEVMNPHDGSLITRVAEAKEADVDCAVAAAKAAYPAWGRLQASERGALLLKLADKIEEHAAELAQLETMDTGHPIRDTLNIDVPRTAYCFRYFGGMADKLEGSVIPVEEGFLNYTTREPIGVVGQIVPWNFPLMFTSWKMAPALAAGNTIVIKPSEITPLSTLRIAELMMEVGFPPGVINVVVGYGNSAGARLSEHEDVGKIAFTGSTMTGQSIVAASAGNLKKVQLELGGKGANIIFEDADLTKAVGGSAWAIFHNQGQACIAGSRIILHESIADAFLEKFLTLAGSIRLGDPLLPETEMGPVTSLQHRERVLAYCDVARSQGCEILLGGKPPADPALANGCYIEPTVVRAKYSDRIAQEEVFGPFVTVITFKNDEEALAIANSTEYGLGSGLWTKDISRAHRFARDMHAGMVWINCYKRVNPASPFGGVGRSGYGREMGFEVMREYTQVKSVWVNVDAKIPPFYQR

SEQ ID NO: 82439 - protein, 104 aa, Cyanothece sp. ATCC 51142
MKTFKQKNKETGKKEEIAEIDVTLEVPEDVYIFDAAEEEGLDLPSSCRSGACSSCVGRIVEGEVDQEDQSFLDDEQVEKGWVLLCVAYPRSNCTIKTHQEAYLA

SEQ ID NO: 82440 - protein, 322 aa, Vibrio angustum S14
MAKKIILDTDPGIDDAMAILFAEAHPDIDLIGITTVYGNATIDNGTQNALYLKQKFRMKALVAKGTDKPLIREPVGATVVVHGEAGLGDVTAPNSLDFEAIEKPAYQFIIDSVRENPGEITLVAVGPLTNLALALEVAPDIVDLVKEVVVMGGAFGENDHRGNVTPFAEANIHDDPHAADKVFTATWPVVIIGLDVTEESFFTSQYLDELRDDAGEVGQFIWDISRYYLRFYSEKVGMSGCHVHDPSAIAYVIQPALFKTRRGSIRVVTDGPAEGMTIQKVDQRNYMNDEWSIFPAQQVGVQVDDETLLSLYRETLVQYSLQ

SEQ ID NO: 82441 - protein, 334 aa, Streptomyces lavendulae
MRRMLYAQLPSRALVVVAQLGIADILAEGPADISTLAERTSTDAVALARLLRGLAVFGVFEEGAEQVYSLTPLGEALTSGHPASALPSATLVAGQFGAAWGDLLETVRTGQSPFERSRGVSLFTHMEQDEELRAVFDDSQGRGLALELDEILRAIDFSAYPTVVDVGGSDGTFLRRILSAHPDISGIVFDLPGSTSLQAERPTADPLEGRYSVATGDFFDSLPEGGDLYLLSHILHDWDDDRAVQILRTCRAAMSDDATLMVVDLIAANRGQRDERLHTAALMDLYMLSLFGGNGGQERTAAQVEVLLSKAGFRITRVDSLPSGMNVIRAVRAA

SEQ ID NO: 82442 - protein, 563 aa, Bordetella petrii
MSKLVEIKVPDIGDFKEVEVIEVLVSEGDTIQAEQSLITVESDKASMEIPASSGGVVKSVKVKVGDKVAEGKVILEVEAGEAAGADQAPASPDKADAAAKQPSSGDAPKTQGQTVEAPDVKPAADAGKGAGGIAEITVPDIGDFKEVEVIEVMIAVGDTIKPEQSLITVESDKASMEIPASAGGVVKEVKVKVGDKVAKGTAIAVVEGQGGAQAEPQKAQAPAQAQEQQPSGAASASAAAPAPAAKPAPAAALEDPGLKPGQLPHASPSVRKFARELGVNLSKVKGSGPKDRITADDVRAFVKQALAAPAAAAGGADGAALGLLPWPKVDFTKFGPVEAKPLSRIKKISGANLHRNWVMIPHVTNNDEADITDLEALRVTLNKENEKAGIKVTMLAFLIKAVVAALKKFPEFNASLDGDQLVYKQYYHIGFAADTPNGLVVPVIRDADKKGILEIAKEMGELSKKARDGKISPAEMQGGCFSISSLGGIGGTHFTPIINAPEVAILGVSRSAHKPVWDGKQFVPRLIVPLSLSYDHRVIDGAAAARFNAYLGQLLADFRRIVL

SEQ ID NO: 82443 - protein, 625 aa, Streptococcus pyogenes MGAS8232
MSHFLVEKLTKTVGDKTVFQDISFIIHDFDRIGIIGVNGTGKTTLLDVLSGRLGFDGDHSPFSKANDYKIAYLTQDPEFNDAASVLDTVLSSDVKAIQLIRQYELLMANYTEDKQETLESLMSEMDRLDAWSIESDVKTVLSKLGITDLEQKVGDLSGGMRRRVQLAQVLLGAADLLLLDEPTNHLDIDTIAWLTTYLKTAKKTVLFITHDRYFLDHVATRIFELDKAGLTEYQGNYQDYVRLKAEQDERDAANLHKKKQLYKQELAWMRTQPQARATKQQARINRFTDLKKEVHQDSSADKLEMAFETSRIGKKVIHFEDLSFAYGDRQLIKDFNLIIQNKDRIGIVGDNGVGKSTLLNIINGDLKPTSGKLDIGDTIRVGYFSQQLKDMDETKRVINYLQEVADEVKTSVGTTSISELLEQFLFPRSSHGTLIAKLSGGEKKRLYLLKLLIEKPNVLLLDEPTNDLDIATLTVLENFLANFAGPVITVSHDRYFLDKVATKILAFEEGDIRVFYGNYSDYLDEKGFEKETVEADLAKAIVTEEVPLPPKEEKKRMSYLEKQEWAQIEDKIATIEANIEEIENQMLTVVSDYGQLAQLQKELDQRNNDLLLAYERFEYLSGLDI

SEQ ID NO: 82444 - protein, 585 aa, Arabidopsis thaliana
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWRLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 82445 - protein, 187 aa, Chlamydomonas reinhardtii
VPRAYQAVDSKHPEGSKGLSIPTYTVLQQHAAFWDRDNDGRIYPYDTYVGCREIGMSLLLSLAFVWLLHFTLLAPYMTQDNWLLHPYLAIHLKNIHRLHHASDTGTYDEEGRMYPRKFEEIWEVLGAEQLASWADVRRLLAANRCVGDPLGWLASAVSWGLLYSVARDERGVLGREAVRRCFDGTLF

SEQ ID NO: 82446 - protein, 564 aa, Physcomitrella patens subsp. patens
MPRLFPAVGLRRRREEVGVKGEQGPLGLGSGVRLPVRAQAAAGGAALPSQPANKILGIEATTFKKVIPLGLMFFCILFNYTILRDTKDVLVVTAKGSSAEIIPFLKTWVNLPMAIGFMVIYTKLSNVLSKENLFYSCIFPFIAFFGAFAFFMYPIVDILHPTAFADWALAKFGTRFLGPIAIIRNWTFCLFYVMAELWGSVVVSVLFWGFANQITTVDEAKQFYPLFGLGANVALVFSGRTVKYFSQLRTKLPPGVDGWGYSLKGMMGLVVILGLVIVGIYWWTNKYVVNDPSLPKVEARKKKSKPKMGMVESAKFLLTSRYIRDLATLVVAYGISINLVEVTWKSKLKAQFPSPNDYSSFMGDFSTYTGVATFIMMLLSRYIFRKYGWGVAAAITPTVLLVTGVAFFGLVLFSTPLTPMLAGLGMTPLLAAVYVGALQNIFSKSAKYSLFDPCKEMAYIPLDEETKLKGKAAIDVVCNPLGKSGGALIQQFLILGFGSLASSTPYLGAILLLIVLLWLGAARSLDAQFTPLVQKDLKGKLLEGKLSAISAAVLGQTQAKKEVS

SEQ ID NO: 82447 - protein, 199 aa, Synechococcus sp. WH 7805
MTANGCLRVGHQAPDFTATAVVDQEFKEISLSQYRGKYVVLFFYPLDFTFVCPTEITAFSDRYADFSSKNCEILGVSVDSKFSHLAWIQTPRNQGGIGDINYPLVADLNKEIGNAFNILDDEGKALRGLYLIDPDGVIVHATINNLPVGRNVDETLRLLQAFQYVQSNPDEVCPANWTPGSATMLEDPKGSKEYFSAIG

SEQ ID NO: 82448 - protein, 366 aa, Silicibacter sp. TM1040
MQTIKAAVCHSFGSALEIEDVVLASPGPGEVEVTLDAVAICHSDISFAEGAWGGPLPAVYGHEAAGRVSALGRDVDGFNIGDDVLVTLIRACRHCSACTSGQPVYCATPYDGLQGPLSTPSGAPLYQAMACGAFAEKVVVSGSQIVAIPADMPKDVAALVSCGVITGVGGAVHSAKLRAGEDVVVIGAGGVGLNAIQGARIAGARRIVAVDLSAEKLDVARDFGATDTVLASDLKPWRAAIDALGGKGAEVVLITVGAIPAYAQAPRYLAPGGRAVMIGMPHSGDTAPYEPVVMAALGQGLQGSKMGDVVLQRDVPWIIDLYQQGRLKLDELISGRWSLLQINEAIADTKTGSARRNVILFDHDHP

SEQ ID NO: 82449 - protein, 73 aa, Zea mays
MAAAEGQWVLMATGRTPTNIAVIKYWGKRDEALILPINDSISEISLLGGRFQSCLREIRKRARDFEDKEKGVK

SEQ ID NO: 82450 - protein, 163 aa, Brassica napus
  misc_feature (122)..(123): Xaa can be any naturally occurring amino acid
MNSCGVQQTAFEVMRSRDAVVCPKPRRVGVLNHHHLARSLRWQVSHQMELCESNSRSDTLDFILAKGGGCEQDPTPELFFTGSPPGRVSNPLTKDSLFQDELLVVAPPPPSTPRATKPPPPXXPRNGGGCVRATTNFGNNPAVRVVGFNCLDMDRRNSVPTLA

SEQ ID NO: 82451 - protein, 426 aa, Streptomyces avermitilis MA-4680
MSDLYGRHRSVLPDWLALYYADPIEITHGEGRHVWDAAGNRYLDFFGGILTTMTAHALPEITKAVSEQAGRIVHSSTLYLNRPMVELAERIAQLSGIPDARVFFTTSGTEANDTALLLATTYRQSNQILAMRNSYHGRSFSAVGITGNKGWSPTSLSPLQTLYVHGGVRTRGPYAELGDADFIAACVEDLKDLLGHIRPPAALIAEPVQGVGGFTAPPDGLYAAFREVLQEQGILWIADEVQTGWGRTGEHFWGWQAHGQSGPPDILTFAKGIGNGMSIGGVVARADIMNCLDANSISTFGGTQITMAAGLANLIYLLEHDLQGNARRVGGLLIERLRAIGAQLPVVREVRGRGLMIGIELVKPGTDEANPQAASAVLEAAREAGLLLGKGGAHNTSALRIAPPLSLTVAEAEEGAAILDRALRSV

SEQ ID NO: 82452 - protein, 713 aa, Physcomitrella patens
MINGHDIYNVLSAMVPLYVAMMLAYGSVKWWGILTPQQCGGINRFVSIFAVPLLSFQFISGNNPYAMNFKFIAADAVSKVLVLLCLGLWARYAKRGSLEWMITLFVLITIPNTLVMGTPLLAAMYGAGPGDLTVQAVVLQCIIWYTLLLVMYEYRAAKILIMQQFPENAASIVSFKVDSDVMSLDGREPVLTEAEIGDDGKLHVKVRRSVSSRSQGMHSAHHSMPSSKALTPRPSNLTGAEIYSMHSSVNLTPRDSSFNQGEFHSMMSQRSPHRQSNFDTSDVYSLQSSRGPTPRSSNFNEENSKDIHTHHRGLNMNSPRFAPPLYRNGMGARMFTPRPGLGGIGVPGTDCTGHGTLSTLGAPGMGPDGRTIYPGSQTAINILTLGGAANVNATAPSTAVNTQIVNPVYSPQASQIAKKVKDPKASPRADEDAKELHMFVWSANASPVSEAGLHVFGGNDTSANLQQRFDPKEVRMLVHPQLDRGLAAASPRTYDEYTREDFSFGNRNDLKLEDLDKDGPRLDKFGSTSTAELTPKLAEDEAKKSMPPSAVMIKLIAVMTFRKLVWNPNTYSSLLGVIWSLVANRWHLSMPLILYKSVHILSDAGLGMAMFSLGLFMGLGDRIIVCGTKMAVFGMALRFLAGPAVFAAASYLVGLRGVPLKVSIVQAALPQGIVPFVFAKEYGVHPEILSTAVIFGMLIALPITMVYYILLGL

SEQ ID NO: 82453 - protein, 379 aa, Xanthomonas axonopodis pv. citri str. 306
MNFAPVPELIEELRAGRMVVIVDDEDRENEGDLIMAAELVKPSDINFMVTHARGLVCLSLTRERCAQLGLAPMVRNNTAQFQTNFTVSIEAAEGVTTGISAYDRAHTVRTAVRPDARPQDLSQPGHIFPLISQPGGVLTRAGHTEAASDLPMLAGLEPAGVLVEVLNPDGSMARRPQLEVFAREHGLKMGSIADLIAYRLANEHTVERVDEREITTEFGPFKLVTYRDRIAHDLHFALLRGRADPQTPTLVRVQVENPLADLLHWQRDDFGVAATDALRAIAAEGQGVMVVLSAPRDSESLLARLRQQPEAAANAKDVSQWRRNGAGAQILADLGLGKLRVLGTPRRQVGLAGFGLEVVEYLECHAGEGVRSVPPSAVP

SEQ ID NO: 82454 - protein, 154 aa, Xanthomonas axonopodis pv. citri str. 306
MTHYEGDLRPTTARFAIIASRWNARITDVLVAGARQSLAGNGIGEDAIDVIRVPGAWEIPIAANRVAQSGQHGAIIALGCVIRGDTRHYEHVADLCAEGLMSVQLQTGVPVLNGVLAVERVEDAEARAGGSHGNKGEECALAALELVNLMELLP

SEQ ID NO: 82455 - protein, 261 aa, Streptomyces avermitilis MA-4680
MVELKTDTSIDAMHEAGQVVGRALTAVREAADVGVSLLELDEVARGVLREAGASSPFLGYRPSFAPTPFPAVICASVNEAIVHGIPDGYRLRDGDLVSVDFGAELGGWVGDSAISFIVGTPRAADVRLVETAERALAAGIAAAVVGNRIGDIAHAIGSVCRAAGYGIPDGFGGHGVGRRMHEDPPVPNEGRPGRGLPLRHGMVLAIEPMLIGGGTDGFHAAADGWTLRTDDGSRAAHAEHTVAITDAGPRILTARTKTHAA

SEQ ID NO: 82456 - protein, 514 aa, Holospora obtusa
MSNLSTSRMSKWRERLWPVYPEEMSIFLPMVVIMFSILFNYTVARNVKDSLLVNSPGSSGKVLPWVKLGLVTPCSIFAVIGYAKLSNLLSKQRLYFATLLPFAVYFLLFGFILYPMREYFNLSVDWIKECQSIYPLLKDFFPAVAYWNYSLFYMMAELWGNMGIALLFWQFANQITPTTQAKRFYPVYGFWSNLGLVAAGSLTAFSENFLKPERLASGEKDFGPQLRLYCSCMVVACIAIVVSYWWLNAKVLTDAQKGTDAKGRKSKPKLTLKESAVYLLKSRYLMYIAILMLAYGITINIVEVTWKDSVGHYFSDPVTGLRDMNAYNAFMGKMFIGTGITTMVFILFSKNFVQSLGWRFSANITPFVTMITGVGFFLFVVFKDYLGGLCELFGTSTLSVAVGLGLVQNVLTKGVKYALFDPTKEMAYIPLDEEEKVKGKAAIDVIGGRAGKSGGSVLQLICNAATGGLGIPQLSVPLLGGLLVSITCWWIWAVNKLAIAYAKKVLETEQVKEI

SEQ ID NO: 82457 - protein, 599 aa, Streptomyces avermitilis MA-4680
MRRPVARNLAVLAVSAAVVSVGAAAPPTAVTSVRKVPVAVGYGGAVSSVDADASAAGIEVLKKGGNAVDAAVATAAALGVTEPYSSGIGGGGYFVYYDAKSRTVRTIDGRETAPLSADSHLFEENGKALAFADAVTSGLSVGTPGSPATWQTALDKWGSKRLGTVLKPAERIARDGFTVDSTFRTQTASNEARFRYFPDTAKLFLPNGELPVVGSTFKNPDLARTYAELGTKGVDAVYRGDLGEDIVATVNKPPVEPSSGWNARPGRLSAKDLEAYRAKLQAPTKTSYRGLDVYSMAPSSSGGTTVGEALNILEKTDLSKADEVQYLHHYIEASRIAFADRGRWVGDPAFEDVPTKELLSQKYADSRACLISDDAVLTSPLAPGDPRSPAKACATGGTAAPTTYEGENTTHLTVADKWGNVVAYTLTIEQTGGSGITVPGRGFILNNELTDFSFTPANPAVHDPNLPGPGKRPRSSISPTIVLDRHDKPVVALGSPGGATIITTVLQTLTGFLDRGLPLVDAIAAPRASQRNAAQTELEPGLYDSTLRGKLEAIGHSFKLNPEIGAATGVQRLSNGKWLAAAEKVRRGGGSAMVVRPAS

SEQ ID NO: 82458 - protein, 275 aa, Glycine max
MASDKKIRIGINGFGRIGRLVARVALQRNDVELVAVNDPFITTDYMTYMFKYDTVHGQWKHFDVKLKDSKTLLFGEKPVTVFGFRNPEEIPWGEVGADYVVESTGVFTDKDKAAAHLKGGAKKVVISAPSKDAPMFVVGVNEKEYKPELDIVSNASCTTNCLAPLAKVINDRFGIVEGLMTTVHAITATQKTVDGPSNKDWRGGRAASFNIIPSSTGAAKAVGKVLPALNGKLTGMSFRVPTVDVSVVDLTVRLEKPATYEQIKAAIKEESEGKL

SEQ ID NO: 82459 - protein, 134 aa, Haemophilus influenzae
MAYSEKVIDHYENPRNVGSLDKKDSNVGTGMVGAPACGDVMQLQIKVDDNGIIEDAKFKTYGCGSAIASSSLITEWVKGKSLEEAGAIKNSQIAEELELPPVKVHCSILAEDAIKAAIADYKAKQGLEHHHHHH

SEQ ID NO: 82460 - protein, 756 aa, Haemophilus influenzae 86-028NP
MSEQLRQAALDFHEFPIPGKIEVTPTKSLATQRDLALAYSPGVAEPCLEIEKDPAASYKYTARGNLVAVISNGTAVLGLGNIGALAGKPVMEGKGVLFKKFAGINVFDIEVNEHDPDKLVDIIASLEPTFGGVNLEDIKAPECFYIEQKLRERMNIPVFHDDQHGTAIISAAAIINSLRIVGKKIEDVRLVASGAGAASIACLNLLLSLGMKRENITVCDSKGVVYKGRDDKMDQTKKDYAIEDNGWRKLGDAMPNADIFLGCSAAGALTQDMVKTMAAHPIILALANPNPEITPPEAKAVRPDAIVCTGRSDYPNQVNNVLCFPFIFRGALDVGATTINEEMKRAAVYAIADLALEEQNEVVTSAYGGEGATFGADYVIPRPFDPRLIVRIAPAVAKAAMESGVATRPIQNWDIYIDQLTQFVYKTNLFMRPIFSQAKSAKQRIILAEGEENKALHATQEVISMGLANPILIGRRSVIEEKIKKLGLRLTAGVDFEIVDNEDNPRYEECWKHYYELTKRKGITPAIAKRVVRSNTTVLASTLLSLGYADALVCGLFGSYGKHLASIRDIIGLKDGVKTAAALNSLVLPTGNVFLTDTHVNSNPTAEELAEITLMAAEEIHRFGIEPAVALLSHSNFGSSDSLGAPKMREVLQIVKERNPHLMIDGEMRGDLAMNEAHRKEVMPDSPLKGSANLLVFPDLSASRISYSLLRSTTTAITVGPILMGMNKSAHILNPGASVRRIINMIAYAAVKAQQE

SEQ ID NO: 82461 - protein, 86 aa, Glycine max
  misc_feature (11)..(11): Xaa can be any naturally occurring amino acid
  misc_feature (19)..(22): Xaa can be any naturally occurring amino acid
  misc_feature (67)..(67): Xaa can be any naturally occurring amino acid
MKFNIASATTXCQKELQIXXXXKLLAFFDKRISQEVSGDALGEEFNGYVFKITGGCDKQGFPIKPGXLTPCPVRLLLHRGTPFFLG

SEQ ID NO: 82462 - protein, 579 aa, Methylobacillus flagellatus KT
MAQSSKVSFSMHGVGVSGGIAIGSAHLVANALVEVVHHQIPRKAVAAEIIRFEQALAHVRRDLESVREQLPANAPAELAAFINTHLMILSDKHLSEAPKAIIEQELCNAEWALKQQMHELVAQFELIEDEYLRERKQDVVQVVERIIKALLGHPSAAVRPEESAQILVAYDVSPADAIQFKHHQFAAFITDVGGATSHTAILARSLGIPSIVALHRARDLIRDGELIIVDGNHGIVIVNPDKDTLAEYRLRQEAWELEQQKLKRLKLTKAVTLDGVEVELHANIEVPSDVAKAKAVGATGIGLYRTEFLFMNRREMPDEEEQFAAYRTVAEMMKGMPVTIRTLDLGADKQMNPDAARSCTNPALGLRAIRLCLSEPQIFLTQLRAILRASHYGKIKILIPMLSSLLELRQTVSLLERAKDSLREQNIPFDDGIMLGGMIEIPAAAINAEAFARELDFLSIGTNDLIQYSLAIDRTDDAVSHLYKPSHPAVLKLIEITIKAGNKLGKPVSVCGEMAGELHFTRLLLGLGLRQFSMHPSHLLTIKRQVLQTELQSIVAMARKVMNTYDIDKIEPLLEKLNQ

SEQ ID NO: 82463 - protein, 314 aa, Streptococcus pyogenes MGAS8232
MDPNVITVISYANIAIIKYWGKENQAKMIPSTSSISLTLENMFTTTSVSFLPDTATSDQFYINGVLQNDEEHTKISAIIDQFRQPGQAFVKMETQNNMPTAAGLSSSSSGLSALVKACDQLFDTQLDQKALAQKAKFASGSSSRSFFGPVAAWDKDSGAIYKVETDLKMAMIMLVLNAAKKPISSREGMKLCRDTSTTFDQWVEQSAIDYQHMLTYLKTNNFEKVGQLTEANALAMHATTKTANPPFSYLTKESYQAMEAVKELRQEGFACYFTMDAGPNVKVLCLEKDLAQLAERLGKNYRIIVSKTKDLPDV

SEQ ID NO: 82464 - protein, 577 aa, Aspergillus oryzae
MEGETLPLAQYLFKRLRQLGVDSIFGVPGDYNLTLLDHIVPSGLKWVGNCNELNAGYAADGYSRIKEIGAVVTTFGVGELSAINAIAGAYAERAPVVHIVGTPMRASQESRALIHHTFNDGDYQRFDAIQEHVTVAQVSLNDHRTAPSEIDRILLQCLLHSRPVRIAIPVDMVPVLVPVAGLSSKIQIPPAVRQPQVEEAALSAVLKRIYSSKKPMILVDGETRSFGMHGRVNHLVRTISWPTFTSGFGKGLVDETLPNVYGVCTLAYKAFVDSCDLVLVFGPHFSNTNSYNYLLKPADEKSVLLSPNSIQVNKDVFRDLPVGYFIEQLTQQLDISKIPTHKHDLVHPSLRTLPEVSPTDLVTQTGGFWKRFSPFLRTGDIILGETGTPGYGVNDFILPPQTRLFKPATWLSIGYMLPAALGASHAQRDLVISNKYHSVSNPRTILFIGDGSFQMTVQELGTIIHQKLNVIIFLINNDGYTIERCIHGRSQAYNDIAPWRYLKAAEFFGADQEGEYKALTWEVRTWADLDRVLNDSQLANGKGLRMVEVFMERLDAPDVLMGLLNNQVLRENAQSRL

SEQ ID NO: 82465 - protein, 173 aa, Oceanicola granulosus HTCC2516
MSLYALDGIRPEIDDTAWIAPGAHVLGRVVLEADTSVWFCATLRGDNEPIVVGQGSNIQENCVLHTDMGFPLTIGRGCTIGHKAMLHGCTIGDNSLVGMGATVLNGAKIGCDCLIGAGALVTEGKEIPDGSLVIGAPAKVVRSLDAEAVEGLRQSALHYQENARRFRKGLTAL

SEQ ID NO: 82466 - protein, 197 aa, Zea mays
MHAPRRFRKAFTAQLLRSLRAAGQASKSLGLRERRDAVRLSSDVALALAASARAPRSPPAWARALVARHAAERRNEALLRRVLDGAGYELAAARARKDARSRRVVRRSRRVCSRGGGAGRKRRSLLLAAGGGGRCAAMAAARRMVRARLRVLRSLVPGAEAMRGLSLLSETLDYVACLKTQVELMQCLCKGPCSLLR

SEQ ID NO: 82467 - protein, 308 aa, Photobacterium phosphoreum
ICLTLNKARCLQLKLPLMVKNNTDKFATPFTLSIEAASGVTTGISVKDRARTVQAAVAAMATSEDIVMPGHIFPLMAQDGGVLTRAGHTEAGCDVARLAGLEPSSVIVEILNDDGTMARRPQLEVFANKHGLRLGTVADLIEYRNKYETMIERISECKLKTEYGEFNMITYRDKINHQIHYALQKGNIEPNSQTLVRVHLQDTFKDILQTGSNRWTLPAAMSRISSENGVLVIVTKPEDPEIVISKIQNLALGNQETPVINSQSRQVGLGSQILSDLGVRKMRLLSSSRQLYHSLSGFGLEIVEYVCD

SEQ ID NO: 82468 - protein, 327 aa, Oryza sativa Japonica Group
MGGGSIRAAAKAAMIGGYRSASAVRRAVLPASPAPQTAPSAAGEGRKAASTYAAIDDWVIPDREVFGPVPTHEEAMAATLDLKESFQFAKSAQLEPLPSGDLDVPTKVGQEGLVHSETPQDLVHSETQGLVDLGASQDLVHSETSQGLVHSESSQGLIHSKTSEHEDNHEISLVSSGAPGRVVQAFTMLQDSPEAQEVVASLASDQNVWNAVMRNEKVMKFYKTYATKLNEDEVEGSESDSVQNSSELGSAGEAFMCYVEKMKALVSEMMTNLSSIMQDLVATSDEGQSKGKLKTMILDSKKDFANAPSAFVLLAIASIMVVLLKRA

SEQ ID NO: 82469 - protein, 156 aa, Photobacterium phosphoreum
MKLIEGATVAPNAKVAIVIARFNSFINDSLLSGALDALQRQGQVSDDNITIIRCPGAYELPLVAQFTAKTDRYDAIIALGAVIRGGTPHFEYVAGECNKGLAQVALDYNIPVAFGVLTVDSIEQAIERAGTKAGNKGAEAALSVLEMVNVLAQVES

SEQ ID NO: 82470 - protein, 123 aa, Synechococcus sp. WH 7805
MSRHSLHWACLQHCGACCRLAPEERQEAIEALTPEQQSQYLAMVGADGWCIHFDSGARRCRIYEERPDFCRVASLCSLFDVPKDHADAFAISCCRQQIRSVHGGRSLELRKFERLIRSTPPLR

SEQ ID NO: 82471 - protein, 182 aa, Photobacterium phosphoreum
MVNVRERVPLNVGINSDIPAELLSFNGLESGKEHIALIFKEADKILVPLVRMHSECLTGDVFHSSRCDCGEQLVETIEKMTEQGGIILYLRQEGRGIGLYNKIDAYKLQSQGMNTYEANNYLGFDDDLREFSEAAQMLTALGIQNIHLVTNNPKKIFDLQQNGINIVEVVGTNVHLKDGNEG

SEQ ID NO: 82472 - protein, 358 aa, Bordetella petrii
MTHNIAVLPGDGIGPEIVEQAVRVLGALDLPLQIQQAPVGGAAYDQFEHPLPPATLDLARNSNAVLFGAVGDWKYDSLPREFRPEQAILGLRKALGLFANLRPAILYPELASASSLKPEIVSGLDILIIRELTGDIYFGTPRGVRNAADGPFSGEREGFDTMRYADSEVRRIARIGFESARKRGKKLCSVDKANVLETSQFWRDIVIEVARDYPDVELSHMYVDNAAMQLVRNPRQFDVIVTGNLFGDILSDEAAMLTGSIGMLPSASLNASGQGLYEPSHGSAPDIAGQGIANPLATILSAAMLLRYSLNLAPQADRIEAAVRAVLAEGLRTADIHEPGTTKVSTSQMGDAVLKALG

SEQ ID NO: 82473 - protein, 517 aa, Caulobacter crescentus CB15
MTEFTDLGLSPTTLQAVADTGYTTATPIQAQAIPVALAGQDVLGIAQTGTGKTAAFTLPLIDRLQSGRAKARMPRALVIAPTRELADQVAASFEKYAKGTKLSWALLIGGVSFGDQEKKLDRGVDVLIATPGRLLDHFERGKLLMTGVQFLVVDEADRMLDMGFIPDIERIFKMTPPKKQTLFFSATMPPEITRLTKQFLRDPVRIEVARPATTNANITQLLVKVPSSDPKAKRLALRALIEKAGIETGIVFCNRKTEVDIVAKSLKVHGYDAAPIHGDLDQTQRMKTLADFRSGALKILVASDVAARGLDIPAVSHVFNYDVPHHADDYVHRIGRTGRAGRTGITYMLVTPADDKGFDKVIKLIGSTPDEEKLDLDYSNAVTVKREGDRKRGGRDRDRGERGERSERPARGRGRGRERAEETVEAPAEAVAEIVDTPAMAEERPARERRPRREREPKAAAPAPTAVEAERPARAERPERPVRGVQPVRDRDDDDRRVVGFGSDVPAFLARPPRGAK

SEQ ID NO: 82474 - protein, 474 aa, Magnaporthe grisea 70-15
MTVAQEEAPKVVTVAESSETTKSSCSEDAVAPPPTQRPAGKFDVLIQGVALFSDGYNIQIIGYMNTVLAKLYPKEMTSEVKTRLSNSILIGDVFGMLLFGLCIDKFGRRVGIVLTTLFLVFGIILATASHGNTVEGMFWMMVVGRGVAGVGAGGEYTVCTSQALECADSTPEMRKRRGMLVAVSTNAAIISGFVGSSIVSLIVIAAYGSQASDGIWRICFGIGIFYQKHAIQHKVPYWLAIKFYWRALLGCCSAWFLYDFVVYPFNLLAPTLVAGFSSNQSMIESIGWSALINFFALPGSFIGALLMDRIGRRQTYALGWAIVCVFGFIIGGSMVQLQNIFPLFVVLYALFQTFLSVGPGDCNFLVSSESFPTPLRGHFLGFAAAVGKAGAAIGTTVLSQALASFDDKVKGQQAIFLIGSGISVVGTLCVWFLIPNAPKNLEDEDVRFRNYLQQNGYDTSDMGLQAKKVEGAES

SEQ ID NO: 82475 - protein, 486 aa, Vibrio parahaemolyticus RIMD 2210633
MEMKTHYIDGAMYIGCSEEHFTTYNPANGEPLANIKQANQSDMEAAIESAKRGFEVWSAMTAIERSRILNKAVAILRERNDELAALEVADTGKPIQEAIAVDITTGADVIEYYAGLAPSLQGEQQPLNENQFFYTRREPLGICAGIGAWNYPIQIAMWKSAPALAAGNAMIFKPSEETPLTALKLAEIYSEAGLPDGVFNVVQGDYRVGQMLTAHPDIAKVSFTGESGTGKVVMGDSAKTLKQVTMELGGKSPLIVFDDAKLDDAVSAAMVANFYTQGEVCTNGTRVFVHESIYDDFVAQLKTRTEKLVVGDPLDENTQIGALISKEHESKVLSAIESAKASGATLLTGGYKVTDNGLQNGNFVAPTVFIDCDDSMSHVQQEIFGPVMSVLKFSEEAEVIERANDTDYGLAAGVFTQNLSRAHRVIHKIQAGICWVNAWGDSPAEMPVGGYKQSGIGRENGVETLKHYTQTKSVLVQLSDFESPYA

SEQ ID NO: 82476 - protein, 485 aa, Caulobacter crescentus CB15
MNAPVNLSSDAHKAVMNDVLQRQKAAHLRDGPPSAEKRIQWLNRCIDLLVGHQAEIAKAVNQDFGSRSPEATSLTDVAGSIGPLKHAREHLTKWMKPEKHKTTPAILGLFGAKATVQWQPKGVVGVISPWNFPVNLTFAPLAGVFAAGNRAMIKPSEFTPATSDLLKAMFAKAFNEEEVAVFVGGPEVGQAFSGLAFDHLVFTGATSVAKHVMRAAAENLVPVTLELGGKSPVILSRGADMATAAARVMNGKTLNAGQICLAPDYVLAPQEDVEAFVKEAQAAVSRYFPTIKDNPDYTAVVAQRHYDRVKGYVDDARAKGARVIEINPAGEDLSQQEHRKIPPTLILDPTDDMKVMQEEIFGPVLPVKGYKTVDEAVDYVNAHDRPLALYWFGTDEAEKDRVLERTTSGGVTVNDVIFHVAQENLPFGGIGPAGMGAYHGYDGFREFSHRKAVFQQLKKDIAPMLGLRPPYGEGIRKYLAGQIKK

SEQ ID NO: 82477 - protein, 854 aa, Desulfovibrio vulgaris subsp. vulgaris str. Hildenborough
MVGIVVVTHSAVLGQGLRELAEQMTQGRVPLAVAGGIDDPDHPIGTDPVRVMTAIEEVQQGDGVLVLMDLGSALMSAETALDLLPPEVASQVRLSAAPLVEGLMAAAVLASTGADLGAVAEEAQSALAAKRELLGAAAPAAPAMPSAHPEGARDSTVPSSAMPAGEELTLVVPNRLGLHARPAARIVTALGPFAADVQLVRGDRVVSARSVNRIATLAVRGGETVTFRAVGGDAALALRAIEALAAAHFGDAPEAPSKGEAPSPAEAPKDGDMAEAAVSADVQGGGVLRGAAASPGLTVGNAVWYRPAFDAPDVAPLADDPATEVTRLDAALGAARTELVELERRTVAAAGRKEAEIFAMHRLLLDDVTIAGAARQRIMDRREAAESAWYEVISDAAATFRQLPEGYMREREADMVDVGARVLRLLTGVAAVGPRLGGPSVLLATDLGPSDMATLDPSLVIGIVTVQGGATSHAAILARSLGIPAVAGLGPALQGVGEGDIVALDGGTGDVWVNPAPGVRAAVEARRDAWLAGREAALAGAAAPAVTADGRAVHILANIGSSADAGAALKNGAEGVGLFRTEFLFLDRTSPPGEEEQLTAYVTAAAAMQGRPVVVRTLDIGGDKPVSYLEGFATGEDNPFLGLRGIRFCLERKPLFMTQLRALLRAAAVHPLKVMFPMVAHPGELAAAKALLDEARATLDAEGMPHGQLDVGIMIEVPAAVALADQLARDAAFFSIGTNDLAQYVMAADRGNASVAALSDALHPAVLRMVRDTVRAGHAAGIPVAICGELGGNPEAIPLLVGLELDELSMNGPAIPRAKEVVRGCDTGTCAVLADRAMALPDAAAVRRLLQGGS

SEQ ID NO: 82478 - protein, 153 aa, Emericella nidulans
MTSEQTFIAIKPDGVQRGLVGPIISRFENRGFKLAAMKLTSPSRSLLEQHYSDLKEKPFFPGLVTYMLSGPIVAMVWEGKDVVKTGRTILGATNPLASAPGTIRGDFAIDVGRNVCHGSDSVESAKKEIGLWFTPEEIQNYKLNAFGWIYEKE

SEQ ID NO: 82479 - protein, 351 aa, Chlamydomonas eugametos
MAPRAMSCVWHLNALAAVTVLLVASLQGARAVPPPSPAACNLTTVNNTAVNQTTLVNSASVLISVAPSYAVNASCLQSARGALGSCITDLGRTSGCCTQRCYTALHNLTLDCVNGLVRAVCRMGSDGNATVNTTARAFTHPLFSVYNNCIDTRPAPYNCSTFNVTSVITPTPSPSPSPSPSPSPSPSPSPKASPSPSPKASPSPSPKASPSPSPKASPAPSPQPSPTPSPKASPVASPQQSPTPSPRPSPTPSPTPSPSPKASPPPSASPSASPSLSPKVSPSTPPTGSPAASPSGSPRASPPGGGPPAMSPRLSPTIPPTRSPILPIPIPSPIRTPSPAIGRRNRRRLLN

SEQ ID NO: 82480 - protein, 548 aa, Rubrobacter xylanophilus DSM 9941
MSGHRSRMKVGGMTCGHCEVAVGRALEGAGARDVEADFRRGEAVFALPEGAGVEALRRAVREAGYEPGAVERVGGERVRGGGRHDYDLAIIGSGGGAFAAAIRAVERGARVAMIERGTVGGTCVNVGCVPSKTLLRGAEIYHRAGHHPFEGVRTKALAADYGAMVAQKDRLVGRMRQEKYLDLVEEYGWELIRGEAAFEDEGTLRVEGRRISAAAYLIATGARPAVPPIPGLEEAGYLTSTTNMELEEAPESVLVIGAGYVAIEQGQLLSRLGSRVTLMQRGPRLLREQEPEVSEAMMEALRREGIEVLTGVRIERAGKTEKGKKRLHLAVGGEERVLEGEEILVAAGRRPNVEELGLERAGVELDERGAVRVDGRLGTTNPRVWAAGDVTLGPQYVYVAAYEGALAADNALGGAGREVDLSALPGVIFSDPQVASVGLTERRARERGLEVQSSVLPLEAVPRALVNHDTLGVIKLVAEAGTGRLLGAHMVAENAGDVIYAATLAVRFGLTVSDLAENFAPYLTMSEGLKLAAQAFGRDVSRLSCCAA

SEQ ID NO: 82481 - protein, 719 aa, Isatis tinctoria
MMENWVVVALFTLCIVGFELRFIHGATDASDTSALNTLFTSMHSPAQLTQWTASAGDPCGQNWRGVTCSGTRVTQIKIPSLELSGTLGYMLDRLTNLTELDLSSNNLGGDLPYQLPPNLQRLNLAYNQFTGAAQYSISQMAPLKYLNLGHNQFKGQIAVDFSKLTSLTFADFSFNSFTNSLPGTFTSLTSLKSLYLQNNQFSGTVDVLAGLPLETLNIANNDFTGWIPSSLKGIHLIKDGNSFSTGPAPPPPPGTPPIRGSPSHKSGGGTNRSSGDSTSNGDSKKSGIGAGAIAGIIISLLVVTALVAFFLVKRKRRSKRSSSMDIEKTDNQPFTLAPSDFHENNSIQSSSSVETKKLDTSLSINLRPPPADRHKSFDDEEDSTRKPILVKKSAVVVPSNVRAYSVADLQIATGSFSVDNLLGEGTFGRVYRAEFDDGKVLAVKKIDSSALPHGMTNDFAGIVSKIAILDHPNVTKLIGYCSEHGQHLLVYEFHKNGSLHDFLHLSEEESKALVWNSRVKIALGTARALEYLHEVCSPSIVDKNIKSANILLDSELNPHLSDSGLASFLPTANELLNQTDEGYSAPEVSMSGQYSLKSDVYSFGVVMLELLTGRKPFDSTRSRSEQSLVRWATPQLHDIDALGKMVDPALEGLYPVKSLSRFADVIALCVQPEPEFRPPMSEVVQALVVLVQRANMSKRTVGVDPSQRSGSADTTSDYM

SEQ ID NO: 82482 - protein, 177 aa, Arabidopsis thaliana
MRGVTETDKLANGIFHLVCLADLEFDYINPYDSASRINSVVLPEFIVQGVLCVFYLLTGHWFMTLLCLPYLYYNFHLYSKRQHLVDVTEIFNLLNWEKKKRLFKLAYIVLNLFLTIFCDIPMTQFIVNMNNSMPPSQKFIIHVLDSTHLFVQPHVEQMIRSAISDFRDQNSYEKPTS

SEQ ID NO: 82483 - protein, 380 aa, Zea mays
  misc_feature (186)..(186): Xaa can be any naturally occurring amino acid
  misc_feature (321)..(321): Xaa can be any naturally occurring amino acid
  misc_feature (338)..(338): Xaa can be any naturally occurring amino acid
  misc_feature (344)..(344): Xaa can be any naturally occurring amino acid
  misc_feature (348)..(348): Xaa can be any naturally occurring amino acid
  misc_feature (351)..(352): Xaa can be any naturally occurring amino acid
  misc_feature (354)..(354): Xaa can be any naturally occurring amino acid
  misc_feature (358)..(358): Xaa can be any naturally occurring amino acid
  misc_feature (366)..(366): Xaa can be any naturally occurring amino acid
  misc_feature (369)..(369): Xaa can be any naturally occurring amino acid
  misc_feature (376)..(376): Xaa can be any naturally occurring amino acid
MVSNGELSQPQAGEYGLAVMRRRPKTKIVCTLGPASRSVDMIEKLLRAGMCVARFNFSHGSHDYHQETLDNLHAAMERTGILCAVMLDTKGPEIRTGFLKDGKPIQLRKGQEIVISTDYSIKGDDKMISMSYKKLAVDLKPGSVILCADGTITLTVLHCDKEQGLVRCCCENTAMLGERKNVNLPXGVVVDLPTLTEKDREDILQWGVPNKIDMIALSFVRKGSDLVEGQGRYLGEHAKSIMLMSKVENQEGVANFDDILANSDAFMVARGDLGMEIPIEKIFFAQKVMIFKCNIQGKPVVTATQMLESMIKSPRPTRAEXTDVAKRILDGTDCVMLXGETAAXAYSXFAXXTXAKTXCKPESCVXHPXFSNQSGXTPIP

SEQ ID NO: 82484 - protein, 477 aa, Acinetobacter sp. NCIMB9871
MNYPNIPLYINGEFLDHTNRDVKEVFNPVNHECIGLMACASQADLDYALESSQQAFLRWKKTSPITRSEILRTFAKLAREKAAEIGRNITLDQGKPLKEAIAEVTVCAEHAEWHAEECRRIYGRVIPPRNPNVQQLVVREPLGVCLAFSPWNFPFNQAIRKISAAIAAGCTIIVKGSGDTPSAVYAIAQLFHEAGLPNGVLNVIWGDSNFISDYMIKSPIIQKISFTGSTPVGKKLASQASLYMKPCTMELGGHAPVIVCDDADIDAAVEHLVGYKFRNAGQVCVSPTRFYVQEGIYKEFSEKVVLRAKQIKVGCGLDASSDMGPLAQARRMHAMQQIVEDAVHKGSKLLLGGNKISDKGNFFEPTVLGDLCNDTQFMNDEPFGPIIGLIPFDTIDHVLEEANRLPFGLASYAFTTSSKNAHQISYGLEAGMVSINHMGLALAETPFGGIKDSGFGSEGGIETFDGYLRTKFITQLN

SEQ ID NO: 82485 - protein, 157 aa, Flavobacteria bacterium BBFL7
MKIILLAVGKTDDSRIDQLTQMYVDRLKHYINFELQIIPDLKKTKNLSEEQQKNEEGKLILNKLEKSDFITLLDEKGKKLSSMQFAELINKRSVSGLKRLVFIIGGPYGFSADVYQRANSKLSLSDMTFSHQMVRLFATEQIYRAFTILRNEPYHHE

SEQ ID NO: 82486 - protein, 381 aa, Haemophilus influenzae 86-028NP
MAKKDYYEVLGLQKGASEDDIKRAYKRLASKHHPDKNQGSKEAEEKFKEINEAYEVLGDDQKRAAYDQYGHAAFEQGGGTGGFGGGFGGADFGDMFGDIFGDIFGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRSCHGEGRVHKKENLSVKIPAGVDTGNQLRLAGKGAAGENGAPAGDLYVVIHVREHNIFERDGSNLYCEVPISFATAALGGEIEVPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 82487 - protein, 558 aa, Fulvimarina pelagi HTCC2506
MPGALDAVRSRPCENELEKTQIMPDTNSNSEPADRADYDVFVVGGGINGCGIARDAAGRGYSVGLAEMNDLGSGTSSWSTKLIHGGLRYLEHYEFSLVRHALRERETLWNIAPHIIRPLRFVLPLHSGLRPGWLIRIGLFLYDHIGGRKKLKKSTAIDLRTSPLGRPLKAEFKKGFEYSDASVDDVRLVILNARDAAARGADIIVRTRLTAARRERDSWSLTLRDEESGAHRTVTARILVNMAGPWVDKVIADAFGHNGPRHVRLVKGSHIVTRKLFDHDRAYIFQNADERIIFAIPYENDFTLVGTTDEDFEGDPSDVRIEEHEIAYLLDAASNYFETPLSRDAIVWHYSGVRSLFDDGADEAKEATRDYVLRLEGGRGEAKVLQGFGGKLTTYRVLAEDALERIGQAIGRKGGTWTHEPPLPGGDFPTDGVGRLEDRLRAECPELDERTVRRIVRAYGTDAARFMRAGALGRDFGHGLFEAEVRWQIENEWARTSEDVLWRRSKLGLRFTDEEAARVDAFIASHLDGTSGGRSWRETADRTLHSSEGERQRGNILA

SEQ ID NO: 82488 - protein, 282 aa, Pseudomonas syringae pv. tomato str. DC3000
MTAPSLLIAGCGDIGSRLATRLQPHGWVVHGLRRTVSELPAGVIGVEGDLFEAQRPAQWPTAALDYVVYCATPSQRDETGYRMAYVEGLRNVLSWLEQTGQQPKRLIFVSSSGVYGQQNGEWVDENSATEPGGYTGTVMLEAEQLALNSGLPATAVRLTGIYGPGRSDLSNRVRQGHSVRVDPPVYANRIHADDAASLLEHLLQADLRGVALESCYLGVDDDPAALADVVAWLREYLGVTEWSEDVSVQRVGSKRCSNARARALGWAPMYPDYRAGYAALLG

SEQ ID NO: 82489 - protein, 565 aa, Haemophilus influenzae 86-028NP
MSKQIQIPDIGSDEVTVTEVMVNVGDTISVDQSIINVEGDKASMEVPAPEAGVVKEILVKVGDKVSTGTPMLVLEAAGAAPAADEPTAPVADAPTAPVVATAPTASAIVEVNVPDIGGDEVNVTEIMVAVGDTITEEQSLISVEGDKASMEVPAPFGGVVKEILVKSGDKVSTGSLIMRFEVLGAAPAASASASTSAPQTAAPATTAQAPQAAAPATTAQAPQAAAPDTTAQAAQSNNNVSGLSQEQVEASTGYAHATPVIRRLAREFGVNLDKVKGTGRKGRIVKEDIEAYVKTAVKAYESGATAQATGNGVANGAGLGLLPWPKVDFSKFGEIEEVELSRINKISGANLHRNWVIIPHVTHFDKADITDLEAFRKEQNALAEKQKLGVKITPVVFIMKAVAKALEAYPRFNSSITEDAQRLILKKYINIGVAVDTPNGLVVPVFKNVNKKGIIELSRELMEVSKKAREGKLTASDMQGGCFTISSLGGIGTTHFAPIVNAPEVAILGVSKSSMEPVWNGKEFAPRLILPMSLSFDHRVIDGADGARFISYLGSVLADLRRLVM

SEQ ID NO: 82490 - protein, 474 aa, Haemophilus influenzae 86-028NP
MSKEIKTQVVVLGAGPAGYSAAFRCADLGLETVIVERYSTLGGVCLNVGCIPSKALLHVAKVIEEAKHANKNGIYFSEPRIELDEVRAGKEAVVAKLTGGLAGMAKARKVTVVEGLATFTDSHTLVARDRDGNPTTVKFDNAIIAAGSRPVQLPFIPHEDPRIWDSTDALKLKEVPKKLLIMGGGIIGLEMGTVYNALGSEVEVVEMFDQVIPAADKDVVGIYTKQVEKKFKLMLETKVTAVEAKDDGIYVSMEGKACNDTKRYDAVLVAIGRVPNGKLIDAGKAGVEVDDRGFIHVDKQMRTNVPHIYAIGDIVGQPMLAHKGVHEGHVAAEVIAGQKHYFDPKVIPSIAYTEPEVAWVGKTEKECKQEGLNYEVAKFPWAASGRAIASECSEGMTKLIFDKDTHRILGGAIVGSNGGELLGEIGLAIEMGCDAEDIALTIHAHPTLHESVGLAAEVFEGSITDLPNAKAKKK

SEQ ID NO: 82491 - protein, 620 aa, Salmonella typhimurium LT2
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKDRRTVCVIGDGAITAGMAFEAMNHAGDIRPDMLVILNDNEMSISENVGALNNHLAQLLSGKLYSSLREGGKKVFSGVPPIKELLKRTEEHIKGMVVPGTLFEELGFNYIGPVDGHDVMGLISTLKNMRDLKGPQFLHIMTKKGRGYEPAEKDPITFHAVPKFDPSSGCLPKSSGGLPGYSKIFGDWLCETAAKDSKLMAITPAMREGSGMVEFSRKFPDRYFDVAIAEQHAVTFAAGLAIGGYKPVVAIYSTFLQRAYDQVIHDVAIQKLPVMFAIDRAGIVGADGQTHQGAFDLSYLRCIPDMVIMTPSDENECRQMLFTGYHYNDGPTAVRYPRGNAQGVALTPLEKLPIGKGLVKRHGEKLAILNFGTLMPEAAKVAEALNATLVDMRFVKPLDDTLILEMAAQHDALVTLEENAIMGGAGSGVNEVLMAHRKPVPVLNIGLPDFFIPQGTQEEARAELGLDAAGIEAKIKAWLA

SEQ ID NO: 82492 - protein, 299 aa, Salmonella typhimurium LT2
MDFTQQLQACVTQANQALSRFIAPLPFQNTPVVEAMQYGALLGGKRLRPFLVYATGQMFGVSTATLDAPAAAVECIHAYSLIHDDLPAMDDDDLRRGLPTCHIKFGEANAILAGDALQTLAFAIISDAPMPEVADRDRIAMIAELANASGIAGMCGGQALDLAAEGQRITLDALERIHRHKTGALIRAAVRLGALSAGDKGRNTLPILDRYAESIGLAFQVQDDILDVVGDTATLGKRQGADQQLGKSTYPALLGLEQARNKARDLIEDARQSLHQLAAQSLDTSALEALANYIIQRDK

SEQ ID NO: 82493 - protein, 432 aa, Salmonella typhimurium
MKTPRLLQYLAYPQKITGPIIEAELRDVAIGELCEITPWLAPKTGCCTCAGGWLTAGTHRADAYRNCQGLSRDVVLYPTGRALSAWVGYSVLGAVLDPTGKIVERFTPEVAPISEERVIDVAPPSYASRVGVREPLITGVRAIDGLLTCGVGQRMGIFASAGCGKTMLMHMLIEQTEADVFVIGLIGERGREVTEFVDMLRASHKKEKCVLVFATSDFPSVDRCNAAQLATTVAEYFRDQGKRVVLFIDSMTRYARALRDVALASGERPARRGYPASVFDNLPRLLERPGGTSEGSITAFYTVLLESEEEADPMADEIRSILDGHLYLSRKLAGQGHYPAIDVLKSVSRVFGQVTTPTHAEQASAVRKLMTRLEELQLFIDLGEYRPCAKISITIGRCRCGDSLKARLCQPVAQYSSFDDTLSGMNAFADQN

SEQ ID NO: 82494 - protein, 199 aa, Streptococcus pyogenes MGAS8232
MAEEQVLNTHNASILLSAANKSHYPQDDLPEIALAGRSNVGKSSFINTILGRKNLARTSSKPGKTQLLNFFNIDDKLRFVDVPGYGYAKVSKSERAEWGKMIEEYLTSRDNLRAVVSLVDLRHAPSKEDIQMYDFLKYYDIPVIVVATKADKIPRGKWNKHESVVKKALNFDKSDTFIVFSSVERIGIDDSWDAILEQV

SEQ ID NO: 82495 - protein, 562 aa, Photobacterium profundum
MNNDKRPLYIPYAGPALLETPLLNKGSAFSIEERMFFNLEGLLPEAIESIEEQTERAYQQYQKFDKDMDKHIYLRNIQDTNETLFYRLVENHITEMMPIIYTPTVGAACEDFSNIYRRGRGLFISYPNRDRIEDMLNNASRQNVKVIVVTDGERILGLGDQGIGGMGIPIGKLALYTACGGISPAYTLPVVLDVGTNNPQRLSDPMYMGWRHTRISGQEYDNFVDEFIQAVKRRWPDALIQFEDFAQKNAMPLLERYKNKICCFNDDIQGTAAVTVGSLLAACKAAKSKLSEQRISFLGAGSAGCGIAEAIIAQMVSEGISEAQARSQVFMVDRWGLLIDDMPNLLNFQQALVQKRDTVNEWDLADNNVSLLDVMRNAKPTVLIGVSGVPGLFSEDVIREMHAHCKRPIVFPLSNPTSRVEATPADIINWTDGNALVATGSPFEPVVHNGKTYPIAQCNNSYIFPGIGLGILAVNARRVTDEMLMASSRALAECSPLAINGHGALLPPLEDIQKVSRKIAFAVAKKAIEQGKAPKNSDERILDKIDANFWQSDYRNYKRTSF

SEQ ID NO: 82496 - protein, 227 aa, Glycine max
LPAKQNQRREASGRLIRSILLNNESRQSLSTTGAQHKIQILSSENGKRPPRTFGSRSGLNDQVSNNDAAQVNSEGDSKMALDKKFVKRDLHGLGSGEKTEKRTRNKDRPDRGVWTPLRRSDVSNAGNDHSSSSLAQPTQSNPESAEGEVKENVPSGNRGGEFSASAGGRGNPSIENDSQRNFTRRGASYIVKDDGAVSISEGKPSKKSVGHSAHEKQVWVQKSSSGS

SEQ ID NO: 82497 - protein, 490 aa, Arabidopsis thaliana
MAIIVVTTIFILLSFALYLTIRIFTGKSRNDKSHKLYDYETEIARTKPTFRFLSPGQSEIFTADPRNVEHILKTRFHNYSKGPVGTVNLADLLGHGIFAVDGEKWKQQRKLVSFEFSTRVLRNFSYSVFRTSASKLVGFIAEFALSGKSFDFQDMLMKCTLDSIFKVGFGVELGCLDGFSKEGEEFMKAFDEGNGATSSRVTDPFWKLKCFLNIGSESRLKKSIAIIDKFVYSLITTKRKELSKEQNTSVREDILSKFLLESEKDPENMNDKYLRDIILNVMVAGKDTTAASLSWFLYMLCKNPLVQEKIVQEIRDVTSSHEKTTDVNGFIESVTEEALAQMQYLHAALSETMRLYPPVPEHMRCAENDDVLPDGHRVSKGDNIYYISYAMGRMTYIWGQDAEEFKPERWLKDGVFQPESQFKFISFHAGPRICIGKDFAYRQMKIVSMALLHFFRFKMADENSKVSYKKMLTLHVDGGLHLCAIPRTST

SEQ ID NO: 82498 - protein, 227 aa, Streptococcus pyogenes MGAS8232
MEALKKIAGVTAAQYVTDGMTIGLGTGSTAYYFVEEIGRRVKQEGLQVVGVTTSSVTSKQAEVLGIPLKSIDDIDSIDLTVDGADEVDKDFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPKAG

SEQ ID NO: 82499 - protein, 309 aa, Photobacterium leiognathi
ICLTLSKARCKTLNLPLMVQGNNDNFSTPFTISIEAANDVTTGISASDRAKTVLAAVAPNAKSTDIVMPGHIFPLMAQDGGVLIRAGHTEAGCDVARLAGLEPSSVIVEILNEDGSMARRPQLEIFAEKHGLKLGTIADLIEYRTQQESHIERISEYELNTEYGIFTLVTYRDTIDNQAHFALCKGEIQAKAATLVRVHVKDTLKDILQVGLSQWSLEAAMQRIQTEDGVLVIISQQESPKTLFEKLDMYAKEQPNSPHSGIVQSRNIGLGSQILADLGVKKIRLLSNSNQGYRALSGFGLEVVEYIYD

SEQ ID NO: 82500 - protein, 497 aa, Bordetella petrii
MTAATLAQLRVDNSFAALPAAFYTRLAPQPLTAPRLLHANEQAAALIGLSADALRSDEFLRVFSGQQPLPGGQTLAAVYSGHQFGVWAGQLGDGRAHLLGEVAGPDGNWELQLKGAGMTPYSRMGDGRAVLRSSVREYLASEAMHGLGIPTTRSLALVVSDDPVMRETVETAAIVTRMSPSFVRFGSFEHWSSRRQPDELRILADYVIDKFYPECREPRPGEAPGPDGALLRMLAEVTRRTAELMAGWQAVGFCHGVMNTDNMSILGLTLDYGPYGFMDAFRLDHICNHSDSEGRYAWNRQPSVALWNLYRLGGSLHALVPDVEALRAVLDSYEVIFTRAFHQRMAAKLGLREWRADDEPLLDDLLRLMHDNRADFTLTFRRLADAVRGRPQGLQDLFIDRDAALAWFERLAARHAQEGAGNDAQARAAGMDAVNPLYVLRNHLAEQAIRAAKAGDAGEIDTLLALLRDPCVEQPGRDAYAALPPDWAGGIEVSCSS

SEQ ID NO: 82501 - protein, 156 aa, Photobacterium leiognathi
MKIIEGGLTAPHARIAIVIARFNSFINENLLSGAIDALQRKGQVKAENITVIRCPGAYELPLAAQQIVKQGNYDAIIAIGAVIRGGTPHFDFVAGECNKGLAQVALEYQTPVAFGVLTVDSIEQAIERAGTKMGNKGEEAALSALEMINVLIEITP

SEQ ID NO: 82502 - protein, 439 aa, Aspergillus oryzae
MASTDTTAFFSRADKYLMRTGVPYSPAIMQKAQGTRLYDVNNRQILDFTSGQMSSLLGHSHPEIVEVVQKYVAELDHLLSNMITYPVVELAERLARFLPAPLEKSFFLNTGSESIEAAIKIAKCYTGKFEIVAFAASYHGLTQGSGSATYSAGRKSGGPCMPGQLAFPAPYTYRSPFRKPDGSYDWEAEMDFGWSMIDRQSVGSLAAFIMEPILSTGGILELPQGYLQRMSLECKKRGMLIIMDEAQTGVGRTGQMFAFEQDGIVPDILALSKTLGCGLPLASVSTTAEIERGCTEAGFLWLTTHLNDPLTAAVGSKVLEIVERDNICQRAAERGAQLRDGLLKLQEKYWCIGDVRGRGLLQGIEIISDAETKAPGPDLGQLVSDRAMACGLSCNVVNLPGMGGVFRLAPPVTVTAEEIEEGLRILDEAFGYVLNEKRN

SEQ ID NO: 82503 - protein, 184 aa, Photobacterium leiognathi
MVTVRARVSFKIGQDSHIPAELLSFNGFTSGKEHVAIIFNNADTTSAPLVRLHSECLTGDVFRSSRCDCGEQLNETIVKMQQQGGIILYLRQEGRGIGLYNKIDAYQLQSQGMNTYEANNRLGFDNDLRDFNEAAQALTALKIKRIRLVTNNPKKIKDLIEYGIDIVEVIATQAHIKEDNRDYL

SEQ ID NO: 82504 - protein, 365 aa, Pimpinella anisum
MAPSTLTALAQEKTLNSKFVRDEDERPKIAYNQFSDEIPVISLAGIDDDKRSQICRKIVEACEGWGIFQVVDHGIDTDLISEMTRLAREFFALPAEEKLRFDMTGGKKGGFIVSSHLQGEAVQDWREIVTYFSYPVPARDYSRWPDKPEGWRSVTEVYSDKLMGLACKLLEVLSEAMGLEKEALTKACVDMDQKVIVNYYPKCPQPDLTLGLKRHTDPGTITLLLQDQVGGLQATRDGGKTWITVQPVEGAFVVNLGDHGHYLSNGRFKNADHQAVVNSNSSRMSIATFQNPAPNATVYPLTIREGEKAVMEEPITFAEMYKRKMSKDIEMAKLKKLAKEKVLQEQEAEKAKLQMTPKSADEIFA

SEQ ID NO: 82505 - protein, 152 aa, Bordetella petrii
MLKVSEILRVKGDTLYTASPDMPVAMAVQTMSEQDIGSLVIMESGMLAGMLTFREIIRHLHDHDGQLGQTTIRAIMDDAPVSVSPNTSADEVQRLMLEKHARYIPVMDGPTLMGVISFYDMAQAIVAAQQFENNMLKAYIRDWPMDGDTAKS

SEQ ID NO: 82506 - protein, 840 aa, Oryza sativa Indica Group
MASRRQWGAGAGAGDVPAQERKGEAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDAHNELAVVDYVEDIYRFYRNTENTYRPLCTYMVSQTEINGRMRAILTDWLIEVHYRLMLMPETLYLTVYIIDQYLSLENVPRKELQLVGVSAMLIACKYEETWAPLVKDFLVISDNSFSRQQVLSTEKSILNKLQWNLTVPTMYMFILRYLKAALGDEELEHMTFFYAELALVQYSMLFFAPSVIAAAAVYAARCTLGLSPLWSDLLEYHTGLAEPQLLECARRLVSLHAAAPESRQKVVYKKYASPKLGAVSLHSPAKKLLPPPSPVCVLQFLVCCCCYGHIQFVFFSSWFVVVMACTMSSMACHSLPESGSNLSAADELFQNQRSEQGIYWTLWDSRLSDDLNTTTVYSDNHGSNGGGTQSFDTSEHCSTVPSDSDEQPGYPSQFEPLHMEQTNDMFLSQFSDEEVRRMDAPFQALDMFPDSMHRLMSYEHILNGALVSDSKNQEVNMDQDDMDTCGFPLYFSHGLQDDGGLPSFAKGMVAADTSSMDKAGASATERGDPGSSPPGFEEAVLEELEEVMVQMARTTRICLRDAFYRLAEGSRSPRSAAAAADGAAVAEATRYHAQAAVDLSRSLLEILQLVILMLSVSSSPLAAANPLQCVDDAAAPSPRRDRQDGGEPHLQAAAVLTGSRGGDDAAHACLRRPSSPSPDHRRTGGDSLGFSFQCDLARRIASSLACLTKDTLCM

SEQ ID NO: 82507 - protein, 433 aa, Listeria monocytogenes str. 1/2a F6854
MSWSPKTEAWQELKNTVPYIQKGKIHTVQEQVYISKGPQVKIGDTVMVGENKVLCEVISIEKENNMLLPFNQSDKVAYGDWVYVTDTKITIPADEFLLGKVLNASGDILNEEAGMAKFKQKMPLEAPPIHAFSRAEITDTLETGIKAIDGMLTIGIGQKIGIFAGSGVGKSTLLGMIARNAKADINVIGLVGERGREVKDFLRKDLGEDGLRKSVIVAATSDESHLMQLRAAKLATSIAEHFRDQGKTVLLMMDSVTRFADARRSVDIAVKDLPIGGKTLLMESYMKKLLERSGKTQNGSITGIYTVLVDGDDMNGPVPDLARGILDGHIVLTRELATKNHYPAIDVLGSVSRVMEEIVPESQWKTASKIREWMSIYQENELYFKLGTIEQTSDNAAIFTSKEKSYFIHQFLKQLRDESVTLEETSKLMETLV

SEQ ID NO: 82508 - protein, 358 aa, Bordetella petrii
MAGGAGPTAVKWAILYCLRAMLSSPDWRLCVAPMIDVTDRHCRYFHRLLAPRARLYTEMITTGALLHGNVGRHLDFDAAEHPVALQLGGSEPDALAHAARLGRQWGYDEINLNCGCPSERVQRGAFGACLMAEPALVADCMKAMQDAVDLPVTIKHRLGLDYDESYSFVRDFVGAIHATGCRVFIVHARNAVLKGLSPKDNREIPPLRYDVARQLKADFPDSVIVLNGGLADAAQAVGAAGEFDGVMLGRAAWHTPRVLSEVSMQLWPSVRLPTDAQVVDAMVRYAAGQVAQGVPLRVIVRPLLGLVNGQSGARRWRRMLSDPARLAANDAGLIYEAWRSLQGAPRDHAPAEALPAAG

SEQ ID NO: 82509 - protein, 429 aa, Synechococcus sp. WH 7805
MACGGITISAVSVSIDPQALFSDLGLGEPLLEALQDKGYTHPSPIQAQAIPAVIDGRDVMAAAQTGTGKTAGFTLPVLERLRHGKPAGRGQIRALVLTPTRELAAQVLENVRAYSSHLPLRSDVVFGGVKANPQINRLRGGVDLLVATPGRLLDLHQQGALHFDQLECLVLDEADRMLDMGFIHDIRRLIRLMPVKRQTLLFSATFSAPIRKLASGLLHDPVHLQVTPENQTARSVEQVVHPCDMARKSDLLSHLIRAGDWRQVLVFSRTKHGANRVADRLSKEGLSAAAIHGNKSQGARTRALQGFKQGNIRVLVATDIAARGIDIQQLPHVVNLDLPNVAEDYVHRIGRTGRAGETGHAVSLVAAEEALLLKAIERLTGEELTRQTVDGFEPTVLKAPPLDLSGGRKRPPGKPRARSAPSPVRGRHR

SEQ ID NO: 82510 - protein, 472 aa, Candidatus Protochlamydia amoebophila UWE25
MIVFAFNKSYATVHFLTELYPMGEKMNTLTMLRQRSSQVVETSDSQSVDMRQVASLILSGGEGTRLHPLTLARCKPAINFGGKYRLIDVPISNSLHAGCKKVFLLTQFLSSSLHQHVFQTYMQGPGAGSIEILTAEQKPSKKNWFQGTADAVRQNIDYLLESPFEYFLILSGDQLYNIDFQEMVHFAKKNDSDVVVATIPVNTQDAKRMGILKVDEQNSITSFYEKPQDNDLLQQLRSPSNILEKAGVAPTGERVYLGSMGIYLFKRKALVELLSEDIREDFGKHLIPTKVASGKISAYLYTGYWEDIGTIETFYQANLALTETNPVFNFHNEARPIYTYRYDLPPAKFTTCQIQKSILCEGSIIEADEITHSLLGPRTVIGSGAIIRDSYLMGNDYYVSPVNDHCKLPSEPQIGENCIIKKAIIDKNVRIGKGVQLINKQQLTRYESELVFIRDGIIVVPRGSVLPDGFIL

SEQ ID NO: 82511 - protein, 738 aa, Neurospora crassa
MAQRSRTAGTTADPRDPLLPPPSPAPDSSLHPHSPPRPLIEGKSFTARGVLVGLGVGLIICFSNMYFGLQTGWVSIMSMPASLMGFGVFRLLTQRLKFPFSPVENVLVQTVAGSMAIMPLGCGFVGVIPAMQFLLRDDEGGGPGLDLGLGKLVVWGLGLCYFGVVFGVPLRKQVIIREQLKFPSGFSTAVLISVLHGKTRQRASESERHEDPATFASLAAQEESGSAVVPGLDDDNNGNHHNLEGEEGGEAPAEPHSASWKRNLNLLLVCFLVSGIFTLSTYFIPALRSIPVFGSYLATTWLWTLNPSLAYVGQGIIMGPATTLHMLLGAVIGWGILSPLAKNRGWAPGDVDDWEKGSKGWIVWVSLAIMLADSVVSYRAINTNDAARGGLTRPRLGRRLSDISEASNSEDDEDAYTHLNSGLRQRHSSRLNRIQEDLGEEKEEEFDDAPPDQQVGDKTVAVGLVLSIIFCIGCIHLVFGNLVPLYATVTAVFMALVLSIMGVRALGETDLNPVSGISKLAQLFFAFIIPQSNKNSVLINLVAGAVSEAGALQAGDLMQDLKTGHLLGAAPKAQFYGQVIGATVGAIVSAFIYKLYTVVYTIPGPLFQVPTGYVWIFTARLVTGEGLPPMAKEWAIGSAALFAVTTAARIILVDKVGADKGKRWQALIPGGIAVAVGMYNVPSFTIARTIGGLLGWWWKGVMGWQDTPLIVLASGFILGEGFLSIVNLIMQSAGVPHL

SEQ ID NO: 82512 - protein, 497 aa, Vibrio parahaemolyticus RIMD 2210633
MTEQVKQYIGGEFAISDSKQWLDVTNPATNEVIAQVPCATESEMNAAIASATETFKRWKEVAAPERARLMLRYQHLLKEQHDELAILLSSETGKTLADAKGDIWRGIEVVEQAANICSSMMGETVENVATNIDGYSYIQPLGVCAGITPFNFPAMIPLWMFPMAIACGNTFILKPSEQVPLTAMKLAELFEQAGAPKGVLQIVHGTKEQVDRILTDPVVRAISFVGSVPVGEYIYKTGTDNLKRVQSFAGAKNHMVIMPDANKQQVINNLVGASVGAAGQRCMAISVAVFVGETKEWIPELKEALAQVQPGAWDDESAGYGPLISPQAKQRVVNLINEGKESGANCVLDGTDCQVPGFPNGNWVGPTLFTNVTTDMSIYQEEIFGPVLLTMEVDNLDEAIELINANRFGNGTSIFTANGAAARKYQHSIEVGNVGINVPIPVPLPFFSFTGWKGSFYGDLHAYGKQAVRFYTETKTVTARWFEDDIPSGPNMTIQLS

SEQ ID NO: 82513 - protein, 403 aa, Triticum aestivum
  misc_feature (156)..(156): Xaa can be any naturally occurring amino acid
  misc_feature (190)..(190): Xaa can be any naturally occurring amino acid
MPTKRSVGTLGEKDLSGKKVLLRADLNVPLDDGQRIADDNRIRASVPTIKFLMGKGAKVVLASHLGRPKGVTPKYSLKPLVPRLSELLGVDVVMANDCIGEEVEKLAAALPDGGVLLLENVRFYKEEEKNDPEFAKKLASVADLYVNDAFGTAHRXAHASTEGVTKYLRPAVAGFLMQKELDYLVGAVAXNPKKPFAAIVGGSKVSTKIGVIESLLSKVDILILGGGMIYTFYKAQGHAVGKSLVEEDKLELANSLIEKAKSKGVSLLLPTDIVVADNFAADAESKIVPASAIPDAWMGLDIGPDSIKKFSETLDTTKTVIWNGPMGVFEFEKFAAGTDAIAKKLADITAKGVTTIIGGGDSVAAVEKAGLASKMSHISTGGGASLELLEGKTLPGVLALDDA

SEQ ID NO: 82514 - protein, 342 aa, Methanosarcina mazei Go1
MTKTAAVIKGDGVGPELVDAMLKVAEASGTDVEFVMCEAGAGWWEEHGGNSLIPEETWQILDSSDACFKGPTTTPGGIGSPRSVAVSIRRKYDLYANVRPIKTFPNSSAPLGDVEMVCVREGTEGLYIGEEIQLTDDVSIAIRKITRTASSKIARYAFEDAKKRGYDTVVPIHKSNILKLTCGSFLEEVEKVAHDFPDIEVWPYHIDNIAQQLIKNPQIFNKKVLLSTNLFMDVISEECSALVGSIGLIYSANIGDNFAMFEPAHGSAPKYAGLDKVNPVATVLAGAWMLDYLGEKDKSDAIFKATERVISEGKYVTYDLGGSAKLSQMADEIAKYTEEILK

SEQ ID NO: 82515 - protein, 228 aa, Staphylococcus aureus subsp. aureus Mu50
MPKLILCRHGQSEWNAKNLFTGWEDVNLSEQGINEATRAGEKVRENNIAIDVAFTSLLTRALDTTHYILTESKQQWIPVYKSWRLNERHYGGLQGLNKDDARKEFGEEQVHIWRRSYDVKPPAETEEQREAYLADRRYNHLDKRMMPYSESLKDTLVRVIPFWTDHISQYLLDGQTVLVSAHGNSIRALIKYLEDVSDEDIINYEIKTGAPLVYELTDDLEVIDKYYL

SEQ ID NO: 82516 - protein, 443 aa, Vibrio parahaemolyticus RIMD 2210633
MSYVFHRHCHATLPIIDKGEGVYLFDKQGKQYLDACGGAAVSNLGHSHQAVKKAMLEQLERVPFAHTGFFTSDSSERLAELICQHMPEQFNHVYLVSGGSEAVESALKMARQYFVESGKPEKKQFIARQQSYHGNTLGALAVGGNEWRREPFKPILHPSHHIAPCYAYRYQQSHESELDYSLRAANELEAKILELGADNVMAFVAEPIVGATAGAVPATQGYFKRIREICDQYDVLLILDEVMCGVGRSGSFFAFEQEEAEPDLVCMAKGLGAGYQPIGAVVANDRVYQAIADGSGFFQHGHTFMAHPVACAAAVATIQTIFQDDLLTAVNRQSALLRNELASALAHLPYIGDIRGKGLFFGIELVADKESKSPLSKATLADKRIKQRAMENGLMCYPMGGTIDGVNGHHILLAPPFIIQSHHIDELVGKLSLTLKEVAEIWK

SEQ ID NO: 82517 - protein, 152 aa, Rubrobacter xylanophilus DSM 9941
MSLAGARPEALPAAGGPRLRREAEARLPTRFGEFRVVAYRDAVDGRAHLALVAGEVRGRGRVFAHIHRSCLLGEAFGSLGCGCGALLEGAMQRAQREGRGVIAYVARGGGAPASGAGCPKDGEGACAVGAAIFEDLGLRSVRLLPVGEVLGS

SEQ ID NO: 82518 - protein, 750 aa, Oryza sativa
MATHERKTIDLEQGWEFMQKGITKLKNILEGKPEPQFSSEDYMMLYTTIYNMCTQKPPHDYSQQLYEKYRESFEEYITSMVLPSLREKHDEFMLRELVKRWSNHKVMVRWLSRFFHYLDRYFISRRSLPQLSEVGLSCFRDLVYQEIKGKVKSAVISLTYFLEQIDQEREGEQIDRALLKNVLDIFVEIGLTSMDYYENDFEDFLLKDTADYYSIKAQTWILEDSCPDYMLKAEECLKREKERVAHYLHSSSEQKLLEKVQHELLTQYASQLLEKEHSGCHALLRDDKVDDLSRMYRLFSRITRGLEPVSQIFKQHVTNEGTALVKQAEDAASNKKPEKKEIVGLQEQVFVRKIIELHDKYVAYVTDCFQGHTLFHKALKEAFEVFCNKGVSGSSSAELLATFCDNILKKGGSEKLSDEAIEDTLEKVVRLLAYISDKDLFAEFYRKKLARRLLFDKSANDEHERSILTKLKQQCGGQFTSKMEGMVTDLTVARDHQAKFEEFISTHSELNPGIALAVTVLTTGFWPSYKSFDINLPAEMVKCVEVFKEFYQTRTKHRKLTWIYSLGTCNINAKFEAKTIELIVTTYQAALLLLFNGVDRLSYSEIVTQLNLSDDDVVRLLHSLSCAKYKILSKEPNNRSISPNDVFEFNSKFTDKLRRLKIPLPPVDEKKKVVEDVDKDRRYAIDASIVRIMKSRKVLGHQQLVMECVEQLGRMFKPDFKAIKKRIEDLITRDYLERDKDNPNVYRYLA

SEQ ID NO: 82519 - protein, 458 aa, Escherichia coli O157:H7 EDL933
MKNASNVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLAMILLLMCTMDDMRLSAILLPVWIVFLFVAFKTLRRK

SEQ ID NO: 82520 - protein, 98 aa, Triticum aestivum
  misc_feature (22)..(22): Xaa can be any naturally occurring amino acid
MKEATASGGGATAGANDPRQPXDLPVDYAGFLAVVFGVVGVMLHYKVCSWIAIIFCAQSLANMKNFENDLKQLSMAFMFAVMGLVTNYFGPRPGGTKR

SEQ ID NO: 82521 - protein, 565 aa, Escherichia coli O157:H7
MEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIIAQTQREGLSEEAARQKVFMVDRFGLLTDKMPNLLPFQTKLVQKRENLSDRDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASETLAQYSPLVLNGEGLVLPELKDIQKVSRAIAFAVGKMAQQQGVAVKTSAEALQQAIDDNFWQAEYRDYRRTSI

SEQ ID NO: 82522 - protein, 193 aa, Zea mays
  misc_feature (31)..(31): Xaa can be any naturally occurring amino acid
  misc_feature (35)..(35): Xaa can be any naturally occurring amino acid
  misc_feature (38)..(38): Xaa can be any naturally occurring amino acid
  misc_feature (52)..(52): Xaa can be any naturally occurring amino acid
  misc_feature (60)..(63): Xaa can be any naturally occurring amino acid
  misc_feature (70)..(70): Xaa can be any naturally occurring amino acid
  misc_feature (85)..(85): Xaa can be any naturally occurring amino acid
  misc_feature (87)..(87): Xaa can be any naturally occurring amino acid
  misc_feature (93)..(93): Xaa can be any naturally occurring amino acid
PREAIDRVYFSETPVEVVKEHDQELSKLGAXALIXAMXGHVAQAFTLLKSSXEAQSVVAXXXXDKNVWDXVLKNERVMEFYKSHXQXLVNTFXEETGSTDSVESPEKFEEASPEYALPTASPLSDFVDSAKKTMMEMVDNITNFFQDMFHNPAEAEAGPGSSSKKPSFAEMAAGGSFMALAMAVILVVLFKRA

SEQ ID NO: 82523 - protein, 565 aa, Escherichia coli O6
MEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIIAQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASEMLAQYSPLVLNGEGLVLPELKDIQKVSRAIAFAVGKMAQQQGVAVKTSAEALQQAIDDNFWHAEYRDYRRTSI

SEQ ID NO: 82524 - protein, 563 aa, Pseudomonas syringae pv. phaseolicola 1448A
MTKTSRPLYISYAGPSLLEMPLLNKGSAFTPQERVEFNLIGLLPQNVETIEEQVTRVYSQYKQCASDLDKHIYLRSIQDNNETLFFRLLDSHLDEMLPIIYTPTVGQACQEFSKIYRTHRGLFISYPERDRIDDILRSATKDRIKIIVVTDSERILGLGDQGIGGMGIPIGKLSLYTACGGISPAYTLPIVLDVGTNNRELLDDPMYMGWRHERVSGKEYEDFIALFIDAVQRRWPDVLLQFEDFAQSNAMPLLEKYRDELCCFNDDIQGTASVAVGTLLAACKAKNETLGQQKVVFVGAGSAGCGIAEHIIAAMRIEGLSESEARKRIFMVDRFGLLTEGMDNLLDFQKRLAQKTADVSGWTAGTEAFPQLLDVVTNAGATVLIGVSGQRGLFTEQVIRELHKHCAKPLVMPLSNPTSKVEATPEEILRWTDGNALVATGSPFAPVEINGRTVHIAQCNNSYIFPGIGLGVVACKASRITDRMLMAASNALAECSPMVTGQGDAVLPPLKEIQQVSRKIALAVAKEAQAEGLALETSEEALLEAIERNFWLPGYRAYRRRSV

SEQ ID NO: 82525 - protein, 314 aa, Photorhabdus luminescens subsp. laumondii TTO1
MKQIALLGECMIELNGAPFSTMHQTFGGDVLNSAVYLARASRQKIAVHFVTALGLDSLSEGMITRWQDEGIRTHLILRDPVRQPGLYLIQLDGQGERTFLYWRNNSAARYMVRHPDFSSVMQALQQMDAIYLSGISLAILPVDDREKLLNLLAELAAQGKTIIFDSNYRSALWQSVEETQVCYQKLLAFTSLALVTDDDECKLWGDKSVTETMIRLKQAGVKEAVIKAGAAGCYYQHLVQDTPIELIPTVPVVNVADTTAAGDAFNAGFLAGFLTDCPIQQAAIMGHCLAGTVIQHKGAIIPISATQAVTDSFF

SEQ ID NO: 82526 - protein, 563 aa, Pseudomonas syringae pv. tomato
MTTTSRPLYISYAGPSLLEMPLLNKGSAFTPQERIEFNLIGLLPQNVETIEEQVTRVYSQYKQCASDLDKHIYLRSIQDNNETLFFRLLDSHLDEMLPIIYTPTVGQACQEFSKIYRTHRGLFISYPERDRIDDILRSATKDRIKIIVVTDSERILGLGDQGIGGMGIPIGKLSLYTACGGISPAYTLPIVLDVGTNNRELLDDPMYMGWRHERVSGKEYEDFIALFIDAVQRRWPDVLLQFEDFAQSNAMPLLEKYRDELCCFNDDIQGTASVAVGTLLAACKAKNETLGQQKVVFVGAGSAGCGIAEHIIAAMRIEGLSESEARKRIFMVDRFGLLTEGMGNLLDFQLRLAQKSADVAGWTAGTETFPQLLDVVTHAGATVLIGVSGQRGLFTEQVVRELYKHCAKPLVMPLSNPTSKVEATPEEILRWTDGNALVATGSPFAPVEINGRTVHIAQCNNSYIFPGIGLGVVACKASRITDRMLMAASNALAECSPMVTGQGDAVLPPLKEIQQVSRKIALAVAKEAQAEGLALETSEEALLAAIERNFWLPGYRAYRRRSV

SEQ ID NO: 82527 - protein, 258 aa, Gossypium hirsutum
MASDQTLFHYCLLTLYIIALPTWISLYFLQAPYGKHNRPGWGPTISPPLAWFLMESPTLWLTFFLFPSGQHFYNPKSFLLISPFLFHYFNRTVLYPLRLARNTTQTRGFPVSVAFMAFGFNLLNGYLQARWVSHYKDDYENEELFWWRFLAGLLIFVVGMWVNVRADKVLVGLKKQGDGGYKIPRGGLFELVSCPNYFGEIMEWFGWAVMTWSWVGFGFFLYTCANLMPRARATRLWYLEKFKDDYPKDRKAVIPFIY

SEQ ID NO: 82528 - protein, 176 aa, Alkalilimnicola ehrlichei MLHE-1
MIRHYLGRYPDIADSAWIDESAVVIGDVTLAEDVSIWPMAVVRGDVQFIRIGKRSNIQDGSVVHVAHDGPYSPGGFATHIGEDVTVGHKAIVHACTVGDRCLIGMGAIIMDGAELGDESILAAGALVPPGKKLEGGHLYVGSPAKPARPITDEEREKLVYSARHYVKVKNRHRDGE

SEQ ID NO: 82529 - protein, 301 aa, Pseudomonas syringae pv. tomato str. DC3000
MTLERDAASNVAKVLSEALPYIRRFVGKTLVIKYGGNAMESEELKTGFARDIVLMKAVGINPVVVHGGGPQIGDLLKRLSIESHFIDGMRVTDAQTMDVVEMVLGGQVNKDIVNLINRHGGSAIGLTGKDAELIRAKKLTVTRQTPEMTKPEIIDIGQVGEVVGVNTGLLNMLVKGDFIPVIAPIGVGPDGESYNINADLVAGKVAEALKAEKLILLTNIAGLMNKQGEVLTGLTTEQVDGLIADGTIYGGMLPKIRCALEAVQGGVNSSHIIDGRVPNAVLLEIFTDSGVGTQITNRKRH

SEQ ID NO: 82530 - protein, 563 aa, Pseudomonas syringae pv. syringae B728a
MTKTSRPLYISYAGPSLLEMPLLNKGSAFTPQERVEFNLIGLLPQNVETIEEQVTRVYSQYKQCASDLDKHIYLRSIQDNNETLFFRLLDSHLDEMLPIIYTPTVGQACQEFSKIYRTHRGLFISYPERDRIDDILRSATKDRIKIIVVTDSERILGLGDQGIGGMGIPIGKLSLYTACGGISPAYTLPIVLDVGTNNRELLDDPMYMGWRHERVSGKEYEDFIALFIDAVQRRWPDVLLQFEDFAQSNAMPLLEKYRDELCCFNDDIQGTASVAVGTLLAACKAKNETLGQQKVVFVGAGSAGCGIAEHIIAAMRIEGLSESEARKRIFMVDRFGLLTESMDNLLDFQKRLAQKTADVSGWTAGSEAFPQLLDVVTHAGATVMIGVSGQRGLFTEQVIRELHKHCAKPLVMPLSNPTSKVEATPEEILRWTDGNALVATGSPFAPVEINGRTVHIAQCNNSYIFPGIGLGVVACKASRITDRMLMAASNALAECSPMVTGKGDAVLPPLKEIQQVSRKIALAVAREAQAEGLALETTEEALLEAIERNFWLPGYRAYRRRSV

SEQ ID NO: 82531 - protein, 231 aa, Oryza sativa Indica Group
MDSKDKEKEHEQTASGRNPDVNDVEEEEEDEEGNKRAVVLGPQVPLKEQLELDKDDESLRRWKEQLLGQVDTEQLGETAEPEVKVLNLTILSPDRPDLVLPIPFVPDEKGYAFALKDGSTYSFRFSFIVSNNIVSGLKYTNTVWKTGVRVENQKVMLGTFSPQLEPYTYEGEEETTPAGMFARGSYSAKLKVFKLIKFSSDVLIEFVDDDGKCYLEMSYYFEIRKEWPTIQ

SEQ ID NO: 82532 - protein, 156 aa, Photobacterium leiognathi
MKIIEGGLTAPHARIAIVIARFNSFINENLLSGAIDALQRKGQVKAENITVIRCPGAYELPLAAQQIAKQGNYDAIIAIGAVIRGGTPHFDFVAGECNKGLAQVALEYQTPVAFGVLTVDSIEQAIERAGTKMGNKGEEAALSALEMINVLIEITP

SEQ ID NO: 82533 - protein, 565 aa, Salmonella choleraesuis
METTTKKARSLYIPYAGPVLLEFPLLNKGSAFSVEERRNFNLSGLLPEVVESIEEQAERAWLQYQGFKTEIDKHIYLRNIQDTNETLFYRLVQNHLEEMMPVIYTPTVGAACERFSEIYRRARGVFISYPNRHNMDDILQNVPNHNIKVIVVTDGERILGLGDQGIGGMGIPIGKLSLYTACGGISPAYTLPVVLDVGTNNQQLLNDPLYMGWRHPRITDDEYYAFVDEFIQAVKQRWPDILLQFEDFAQKNAMPLLTRYRDEICSFNDDIQGTAAVTVGTLIAASRAAGSQLSEQKIVFLGAGSAGCGIAEQIIAQTQREGLSEDAARQNVFMVDRFGLLTDRMPNLLPFQAKLVQKCDNLQHWDTENDVLSLLDVVRNVKPDILIGVSGQTGLFTEEIIREMHKHCPRPIVMPLSNPTSRVEATPQDIIVWTEGNALVATGSPFSPVIWKDKVYPIAQCNNAYIFPGIGLGVIASGASRITDEMLMSASETLAKHSPLVNNGEGLVLPALKDIQVVSRAIAFAVGKMAQQQGVAVKTSAEALQQAIDDNFWKPEYRDYRRTSI

SEQ ID NO: 82534 - protein, 355 aa, Apium graveolens
MAPSTITALSQEKTLNLDFVRDEDERPKVAYNQFSNEVPIISLAGLDDDSNGRRAEICRKIVEAFEEWGIFQVVDHGIDSGLISEMSRLSREFFALPAEEKLVYDTTGEKKGGFTISTHLQGDDVRDWREFVTYFSYPISARDYSRWPKKPEGWRSTTEVYSEKLMVLGAKLLEVLSEAMGLEKEALTKACVEMEQKVLINYYPTCPEPDLTLGVRRHTDPGTITILLQDMVGGLQATRDGGKTWITVQPVEGAFVVNLGDHGHYLSNGRFRNADHQAVVNSTSTRLSIATFQNPAQNAIVYPLKIREGEKAILDEAITYAEMYKKNMTKHIAVATQKKLAKEKRLQDEKAKMKI

SEQ ID NO: 82535 - protein, 310 aa, Photobacterium mandapamensis
ICLTLTKDRCQTLNLPLMVQNNHDKFSTAFTVSIEAAADVTTGISAYDRAKTVQAAIAPNASADDIVMPGHIFPLMAQDGGVLIRAGHTEAGCDVARLAGLEASSVIVEILNEDGTMARRPQLEVFGQKHGLKLGTIADLIEYRTQRESHIERLSESELCTEYGVFNLITYRDTIDNQLHYALCKGDINPDSETLVRVHVKDTLKDILHTGATQWSLQAAMQRIQADGGILVIISQIEPSAMILNQINHLDSEHQASLPLPITPQSRQIGLGSQILSELGLCKIRLLSSQSQQYRSLSGFDLEVVEYICN

SEQ ID NO: 82536 - protein, 519 aa, Gossypium hirsutum
IKRIMLPPSKREFKDLFVVFELMESDLHQVIKANDDLTREHHQFFLYQMLRAMKYMHTANVYHRDLKPKNILANANCKLKVCDFGLARVAFNDTPTTVFWTDYVATRWYRAPELCGSFFSKYTPAIDIWSIGCIFAEVLTGKPLFPGKSVIHQLELITDLIGTPSLETISGVRNDKARKYLSEMRKKKPVPFSQKFPNADPLAVRLLQRLLAFDPKDRPTAEEALADPYFKGLSKIEREPSCQPISKLEFEFERRRVTKEDVRELIYREALEYHPQLLKDYLNGHEGSNFLYPSPVGQFKKQFAYLEENGGRSAPVFPLERKHVSLPRSTVHSNGITPNTQSTSVSYENRQDREADARKAMDVISSKPKPTRPPPRVPSEVLSCPYSKPGRVVGSVVPYEDVKNIKDGYHAKNFYRNAVPPQNVSPHCFLLNQEKSGTQTDRNLQTKPQQQFSMVAKPSPGTAFDMNSNPYYRTQAKTERRLPIDAKLLQAQSQFGAVGAAAVAVAAHRNAGTVHYGLS

SEQ ID NO: 82537 - protein, 365 aa, Conium maculatum
MAPTTITALAQEKTLNLAFVRDEDERPKVAYNEFSNEIPIISLAGLENDSDGRRPEICRKIVEAFENWGIFQVADHGIDSALISEMSRLSREFFALPAEEKLRYDTTGGKRGGFTISTHLQGDDVRDWREFVTYFSYPIDARDCSRWPDKPEGWRSITEVYSERLMVLGAKLLEVLSEAMGLEKEALTKACVNMEQKVLINYYPTCPEPDLTLGVRRHTDPGTITVLLQDMVGGLQATRDGGKTWITVQPVEGAFVVNLGDHGHYLSNGRFKNADHQAVVNSSSSRLSIATFQNPAQNAIVYPLKIREGEKAILDEAITYAEMYKKNMTKHIEVATLKKLAKEKRLQDEKANMEKKSKSAHGISA

SEQ ID NO: 82538 - protein, 587 aa, Bordetella petrii
MQSTDNDLSQSPPKLSADEQLKAASDQLRGTILRSLADPLTGAVSDSDAKLLKFHGIYQQDDREQRDERRRQKLEPAYQFMIRVRLPGGVCSAAQWLKLDELARAYGGDSLRLTTRQTFQFHWVLKHNLQATLQGLHEVLLDTIAACGDDARGVMCTADPRLSALHAAVYDIARQASDHAIPRMRAYHEIWWGEQRVASSDAGPEEPFYGQTYLPRKFKIGFVIPPVNDIDVYAQDLGFIAIAGDDGALQGFNVAIGGGMGRTDQAPATYPRLADVIGFVPPEAVIATCDAVMGVQRDYGNRKDRARARFKYTIDEHGLDAVKAEIERRLGFALQPARPFRFDSNGDALGWQTGEDGRHHVTLFIQNGRLVNLPGLPLLEGLREIARVHTGSFRITPNQNVVIADIGDAERPRIEALLRQYQLEAGPSTSALRLNSMACVALPTCGLAMAESERYLPELVGKIEALLRTHGLEREPITIRMSGCPNGCSRPYIAEIGLTGRAPGKYNLYLGGGFHGQRLNRMVLENAAEAAILALLDTTLAHYARDRHEGEHFGDFAVRAGYVEAVTAGRDFNQRRAPGAGATAPHA

SEQ ID NO: 82539 - protein, 182 aa, Photobacterium mandapamensis
MITVRARVPFKIGQKSQIPAELLSFHGFNSGKEHVAIIFKQADTTTAPLVRLHSECLTGDVFHSSRCDCGEQLNETIEKMHQFGGIILYLRQEGRGIGLYNKIDAYHLQSQGMNTYEANNHLGFADDLRDFSEAAKALMALGINKIRLITNNPKKINELQQHGIEIIDVVNTQVHIKQDNED

SEQ ID NO: 82540 - protein, 368 aa, Ammi majus
MAPTTLTALAQEKTLNSKFVRDEDERPKIAYNQFSDEIPVISLAGIDDDSDDKRSQICRKIVEACEGWGIFQVVDHGIDTDLISEMTRLAREFFALPAEEKLRFDMTGGKKGGFIVSSHLQGEAVQDWREIVTYFSYPVPARDYSRWPDKPEGWRSVTEVYSDKLMGLACKLLEVLSEAMGLEKEALTKACVDMDQKVIVNYYPKCPQPDLTLGLKRHTDPGTITLLLQDQVGGLQATRDGGKTWITVQPVEGAFVVNLGDHGHYLSNGRFKNADHQAVVNSNSSRMSIATFQNPAPNATVYPLKIREGEKAVMEEPITFAEMYKRKMSKDIEMAKLKKLAKEKLLQEQEAEKAKLQMTPKSADEIFA

SEQ ID NO: 82541 - protein, 770 aa, Aspergillus oryzae
MESSAVQEPTQQRSLRDRIFNLFRTSSSNDAPGLPARLVTAESAAQNEGSALIYPPREPDARTRLLESYDRGKRGLRNSGVHGTFSSRPEQEEIQKWDASSLQNAGNEERSQSPGGADGHIGSPGDVSGYPQGPENIPSLDSSFTALHMKNHKSLYISYYIPFFNWITQYRWSYIRGDLVAATTIASIYIPMALSLSSNLAHAPPINGLYSFVINPFIYAIFGSSPLLIVGPEAAGSLLTGTIVKTSVRPGPSGEDDEVANAIVVGIATAMAGAMILIAGLTRLGFLDNVLSRPFLRGFITAIGFVIFVDQLIPEVGLTELAKEAGVTHGTTVDKLMFLIRNIGGCHALTTAVAFGSFAIIMVFRTLKKMLQPRYPQVIYLPDRILVVILSAVLTWHLGWDDKGLEILGPLKQNANGLFAFKWPFQFSQMKHVRAAMSTSFVIALLGFFESSVAAKGLSGEARQEGVQGMPVSANREMVALGLANTVGGCFMALPAFGGYARSKVNASTGARSPMSSIFLSIITFVCIMVLLPYLYYLPKAVLSSMISVVAFSLIEECPHDVAFFIRLRGWTELALMLLIFVSTIFYSLELGIALGIGLSILILIRHSTQPRIQILGKIAGTTDRFDNAELHPESVELIEGALIVKIPEPLTFANTGELKNRLRRLELYGSSRAHPSLPPTRTPEHNKNIIFDVHGVTSIDGSGTQVLYEIVDGYADQGVSVFFCRVATRNVFRMFERSGIVERCGGITHFVHGVDEALRLAESEDEIEI

SEQ ID NO: 82542 - protein, 535 aa, Vibrio parahaemolyticus RIMD 2210633
MACLTTNINTHSEQYQENYRSMASLVDQLYTVTAQIEDGGGEKAREHQQKKGKLPVRERILALLDPGSSFLEIGQFAGWDVYPDYVPCAGVVAGVGVVDGTECMIVANDVTVKGGSYYPLTVKKHLRAQEIAEKCQLPCVYLVDSGGANLPRQDEVFPDKDHFGRIFYNQARMSAKGIPQIAVVMGLCTAGGAYVPAMCDVSIIVKEQGTIFLAGPPLVKAATGEEVSAEDLGGADVHCRTSGVADYYAENDHHALELARQAVSQINHLKPVQLKQKTPQEPRFPARELYGIVGTDLKKPFDVKEVIARIVDDSQFDEFKALFGETLVCGFAHIHGMPIGIVANNGILFSESAQKGAHFIELCAQRKIPLLFLQNITGFMVGQKYEAEGIAKHGAKMVTAVACADVPKFTVVIGGSYGAGNYGMCGRAYDPTMMWMWPNARISVMGGEQAAGVMAQVTRDIKTRKGESWSVEEEEAFKRPIAEQYQVQSHAYYASARLWDDGIIDPAKTRDVVGIALSAALNAPIPDSKFGIFRM

SEQ ID NO: 82543 - protein, 310 aa, Photobacterium mandapamensis
ICLTLTKDRCQTLNLPLMVQNNHDKFSTAFTVSIEAAADVTTGISAYDRAKTVQAAIAPNASADDIVMPGHIFPLMAQDGGVLIRAGHTEAGCDVARLAGLQASSVIVEILNEDGTMARRPQLEVFAQKHGLKLGTIADLIEYRTQRESHIERLSESELCTEYGVFNLITYRDTIDNQLHYALCKGDINPDSETLVRVHVKDTLKDILHTGATQWSLQAAMQRIQADGGILVIISQIEPSAMILNQINHLDSEHQASLPLPITPQSRQIGLGSQILSELGLCKIRLLSSQSQQYRSLSGFDLEVVEYICN

SEQ ID NO: 82544 - protein, 350 aa, Candida albicans
MSEQIPKTQKAVVFDTNGGQLVYKDYPVPTPKPNELLINVKYSGVCHTDLHAWKGDWPLATKLPLVGGHEGAGVVVGMGENVKGWKIGDFAGIKWLNGSCMSCEFCQQGAEPNCGEADLSGYTHDGSFEQYATADAVQAAKIPAGTDLANVAPILCAGVTVYKALKTADLAAGQWVAISGAGGGLGSLAVQYARAMGLRVVAIDGGDEKGELVKSLGAEAYVDFTKDKDIVEAVKKATDGGPHGAINVSVSEKAIDQSVEYVRPLGKVVLVGLPAHAKVTAPVFDAVVKSIEIKGSYVGNRKDTAEAIDFFSRGLIKCPIKIVGLSELPEVFKLMEEGKILGRYVLDTSK

SEQ ID NO: 82545 - protein, 259 aa, Cryptococcus neoformans var. neoformans JEC21
MAAPISVEYTQDRASDLRENIAAVQQDIDNAAGTGAKPRLVAVSKLKPASDIKALYDAGYRHFGENYIQEMVDKAAALPDDIKWHFIGSLQSNKSKLAASVPNLFILETLSSTKVADLLQKSLPPSRQSKLNVYLQVNTSGEDSKSGLSPLPSNSAELVDLAMHVIEKCPGLKLLGIMTIGSWDASHDPTKPNPDFECLKRTRTELAKALAENGVQGAPKEDELELSMGMSADFVQAIKEGSSSVRVGTRIFGERPKKK

SEQ ID NO: 82546 - protein, 297 aa, Streptomyces coelicolor A3(2)
MDLTGRRAVVTGGASGLGAKTVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFEFEDPHFARRPYDPWAAYGQSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDDQPGGVAAHALDPEAADRLWEYGADTLSAG

SEQ ID NO: 82547 - protein, 279 aa, Campylobacter jejuni
MQKYLEKANVLIEALPYIRKFNSKIILIKYGGSAMENEELKHCVMQDIALLKLVGLKPIIVRGGGKDISAMCARLFVKSEFKDGLRVSDKATTEVASMVLNHINKNLVHSLQNLGVKAIGLCGKDGALLECVKKDENLAFVGTIQKVNSKILEELLEKDFLPIIAPIGMDEDFNTYNINADDAACAIAKALRAEKLAFLTDTAGLYEDFSDKNSLISKISLEQAKILAPKIEGGMHVKLKSCIDACENGVKKVHILDGRVKHSLLLEFFTDEGIGTLVG

SEQ ID NO: 82548 - protein, 452 aa, Staphylococcus aureus subsp. aureus Mu50
MNYTQQLKQKDSEYVWHPFTQMGVYSKEEAIIIEKGKGSYLYDTNGNKYLDGYASLWVNVHGHNNKYLNKVIKKQLNKIAHSTLLGSSNIPSIELAEKLIEITPSNLRKVFYSDTGSASVEIAIKMAYQYWKNIDREKYAKKNKFITLNHGYHGDTIGAVSVGGIKTFHKIFKDLIFENIQVESPSFYRSNYDTENEIMTAILTNIEQILIERNDEIAGFILEPLIQGATGLFVHPKGFLKEVEKLCKKYDVLLICDEVAVGFGRTGKMFACNHEDVQPDIMCLGKAITGGYLPLAATLTSQKIYNTFLSDSHGVNTFFHGHTYTGNQIVCTVALENIRLYEKRKLLSHIETTSSTLEKQLHALKRHRNVGDVRGRGLMFGVELVTDKDSKTPLEIEKVERIVRKCKENGLMIRNLENVITFVPVLSMSNKEVKTMVRIFKKAVHNILDRKC

SEQ ID NO: 82549 - protein, 395 aa, Campylobacter jejuni
MKMDYKEQSHIVPAYKRFDIVLEKGQGVYLFDDKAKKYLDFSSGIGVCALGYNHAKFNAKIKAQVDKLLHTSNLYYNENIAAAAKNLAKASALERVFFTNSGTESIEGAMKTARKYAFNKGIKGGQFIAFKHSFHGRTLGALSLTANEKYQKPFKPLISGVKFAKYNDISSVEKLVNEKTCAIILESVQGEGGINPANKDFYKALRKLCDEKDILLIADEIQCGMGRSGKFFAYEHAQILPDIMTSAKALGCGLSVGAFVINQKVASNSLEAGDHGSTYGGNPLVCAGVNAVFEIFKEEKILENVNKLTPYLEQSLDELINEFDFCKKRKGLGFMQGLSLDKNVKVAKVIQKCQENALLLISCGENDLRFLPPLILQKEHIDEMSEKLRKALKSF

SEQ ID NO: 82550 - protein, 128 aa, Zea mays
HSTLPGIEARGFIFGPAVALAIGAKFIPLRKPRKLPGEVISEKYVLEYGTDCLEMHVGAIERPGERVLITDDLVATGGTLCAAIRLLERAEADVVECACLIGLPKFKDFYKLNGKPVYVLVESRESDK

SEQ ID NO: 82551 - protein, 340 aa, Bifidobacterium longum
MVSAILEGKPDKNLILVTGRIHPKLAEDVAEQLGIDVLETTAYDFANGEMYVRYTESVRGADVFVLQSHYKPINKAIMEQLIMIDALKRASARSITAVCPLLGYSRQDKKHRGREPISCRLVFDLLKTAGADRIMSVDLHAAQSQGFFDGPVDHLVAMPVLVDYIRDRFQGHLDNVAVVSPDAGRIRVAEQWAQRLGGGPLAFVHKTRDITRPNQAVANRVVGDVAGKDCVLVDDLIDTAGTIAGACHVLQDAGAKSVTVVATHGVLSGPAVERLKNCGAREVVLTDTVPIPEEKRWDGLTVLSIAPLLASAIRAVFEDGSVAELFDTYPEHHGQGFLFA

SEQ ID NO: 82552 - protein, 247 aa, Oryza sativa
MSGRRDDSAKMAKLKELLHRSENRICADCSAPDPKWASANIGVFICLKCSGVHRSLGTHISKVLSVTLDQWSDNEIDNVIEVGGNSHANAIYETFLPQNHSKPHPDSTQEEREKFIRSKYELQEFLEPSLRIVSHQSSDSGKHAGSASHSVSSKSEVGMIEFIGILNVKVKGGTNLAIRDMSSSDPYVVLTLGQQVRKTSVIKANLEPCLETKNSKLSGSLTKNGPFQKWEKPPPKKSQPKPFQKIF

SEQ ID NO: 82553 - protein, 461 aa, Flavobacteria bacterium BBFL7
MVDQQYIKLTHQSHQEFFKSQQTKDVNYRITALKKLKAVIEQKEQQVYKALAADLGKSEFEAFITEYQVITGELDKYIKKTKKWASPRKVRPSLLNFPSKARQYSEPYGNTLIISPWNYPFQLALAPLIGAVAAGNTVILKPSEFSTATSQLLEEIVNESFDAQHVKVIQGDADVAKELTSLKWDYIFFTGSPPVGKAIYQAAAKHLTPVTLELGGKNPCVIHESASLKVAARRIVWGKFLNAGQTCIAPDYILVHNSVKLEFIEHVKAEIINFFGKNPKESPDLPRIIREQHFRKLIEMLEDQKIISGGQHDINTLYIAPTLLDEPQRDSNVMQEEIFGPILPVISYKNQGDIIQWIDSYEKSLGAYIFSNNNRFEQWFIQRFSYGGGVINDSIVQFVNERLPFGGVGNSGIGNYHGKKTFETFSHMKSMVHRGTWLDIPIKYAPYSGKLDIVKRIIRWL

SEQ ID NO: 82554 - protein, 497 aa, Pseudomonas syringae pv. tomato str. DC3000
MTTLTRADWEQRAQNLKIEGRAFIQGEYTAAASGETFDCISPVDGRLLAKVASCDAADAQRAVESARSAFDSGAWSRLAPAKRKATMIRFAGLLEQNAEELALLETLDMGKPISDSLGVDIPGGARALSWSGEAIDKLYDEVAATPHDQLGLVTREPVGVVAAIVPWNFPLMMACWKLGPALSTGNSVVLKPSEKSPLTAIRIAQLAIEAGIPAGVLNVLPGYGHTVGKALALHMDVDTVVFTGSTKIAKQLMIYAGESNMKRVWLEAGGKSPNIVFADAPDLQAAADSAASAIAFNQGEVCTAGSRLLVERSIKDRFLPMVIEALGTWKPGNPLDPATNVGALVDTQQMNTVLSYIAAGHTDGARLVAGGKQILQETGGTYVEPTIFDGVNNAMRIAQEEIFGPVLSVLTFDTAEEAIQIANDTPYGLAAAVWTANLSKAHLTARALRAGSVWVNQYDGGDMTAPFGGFKQSGNGRDKSLHAFDKYTELKSTWIKL

SEQ ID NO: 82555 - protein, 44 aa, Zea mays
IVSLGHFPTPIHKWNLPNLPEGTEVWIKRDDLSGMQLSGNKVRK

SEQ ID NO: 82556 - protein, 217 aa, Oryza sativa Indica Group
MSPFSRHRTLMNIFDKTPHVHRDAFVAPSASLIGDIQVGQGASIWYGCVLRGDANNVQIGSGTNIQDNSLVHVAKSNLSGKVFPTIIGDNVTVGHSAVLQGCTVEDEAFVGMGATLLDGVVVEKHGMVAAGALVWGGNPAKFLRKLTDDEITFIKESASNYSTLAKAHATENAKPVEKTEFEKLFRKKSAHQDEEHDSMIGATREVTPELTPSSSAQ

SEQ ID NO: 82557 - protein, 256 aa, Coprinopsis cinerea okayama7#130
MALDPASPERKQEIKDCLGAIRERVATASSSSPTLVAVSKYKPAGDILACHELGHLDFGENYVQELEEKAKILPSDIRWHFIGTLQSNKAKTLALIPNLYSIQTLGSVKAANALNKALSSDRTTPLRVLLQVNTSGEDAKSGLPPLSSSEDVSASELGKLAAHVIRECPALRLEGLMTIGSLELSIHASETEKNADFERLKQTRDILKAYLETTFGEDGTKQWGQEGTGKLLLTGHEISISILQSAAVDMLLELVT

SEQ ID NO: 82558 - protein, 306 aa, Agrobacterium tumefaciens str. C58
MGVWIDTDMGFDDIAAIMVVQSAGLAIDGISLVFGNATLDAVCRNAAGAVASFGWSMPIHQGRAMPVLGALETAQSILGESGIPTAGQSLPDAPALPKSDAFTALCNWLEGEGEKRILALGPLTNIAALCLARPDLAARISDLTWMGGGLTSGNHTASAEFNAFADPEALAIVLAHGLPLRMVDLDACRKVMASPADVLPIRTADGRNAGLIADLFDGFIGIATSRGRAAMALYDPVAAVGFTSDHLGWQQARIDVELHASLTRGRTVVETRAEKVTDFNAQFAVTVDAGAAKAAILEALRREAAR

SEQ ID NO: 82559 - protein, 627 aa, Bordetella petrii
MTTELLDRIHSPDDVRQLDRRELKALAEELRGFVLESVSRTGGHLSSNLGTVELTLALHRVFDTPHDRIVWDVGHQSYPHKILTGRRAGMASLRQEGGISGFPKRSESEYDAFGTAHSSTSISAALGMAVASRNAGIQRQHIAVIGDGAMSAGMAFEAMNNAGVTPDINLLVVLNDNDMSISPPVGALNRYLARLMSGRFYAAAKNVGRAMLQHVPPVLELARRFEEHAKGMVTPATLFEEFGFNYVGPIDGHDLDALVPTLQNLKALQGLQFLHVVTRKGHGYKLAEADPVLYHGPGKFDPAVGIQQGKASTRKTFTQVFGQWLCDMAERDERLVGITPAMREGSGLVEFERRFPRRYFDVGIAEQHAVTFAAGLACEGQKPVVAIYSTFLQRGYDQLIHDVALQNLDVTFALDRAGLVGADGATHAGNYDIAYLRCVPNMVVAAPSDENEARLLLSTCYEYPGPASVRYPRGAGRGAEISPGLDTVPMGKGIVRRQGRGIAILAFGTLTQAALAAAEALDATVADMRFVKPIDRELILQLAAGHDAIVTVEEAAIMGGAGSAVIEVLHHEGVVVPVLQLGLPDRFIDHGDQAALLAGLGLDAAGIERSIRARFEKSNLQSGAQTK

SEQ ID NO: 82560 - protein, 650 aa, Dunaliella salina
MATRRFLPLLGGAGSVALAGTAGWSLWRPDTASADAAHTGRELSVDNVPSRSEQYQRLASHTKNNPFDVLVIGGGATGAGCAFDAQTRGLQTALIEREDFASGTSSRSTKLVHGGVRYLEKAVFNLDYDQLKLVYEALHERDRLLSNASHLAHPLPILTPCYNWWEVPYYWAGMKMYDLVAGTSTLVPSKFLTSLETLTYLPTMSKNIGGKSLKGSIMYYDGQFNDSRMNVALACSSAAAGATVMNYTECKQLIKDDQGKVIGARCRDRATGAETDVYARVLINATGAFADDVRRYSEPDAQQTVMASSGAHVTLPDFYGSARTGMIIPKTKDGRVIFMLPFQGHVIAGTTDTPIKATSRPRSSEEDIDFILATLSDFLDVRVSRGDVLSTWCGIRPLPAPKKNTTSENVVRDHVIFEDKDGLLNVTGGKWTTYRAMAEQAIDLAMASGKLPKSAKPCQTANYKLLGATNYTYTLMAELAQQHGMPQRYFGKNSSKERNSNGSPRVAMDTEIAHHLSTAYGDNAMRVIAMAEEEGLGKRLIAGHPILEAEVMYTAKHEYCLTIEDFIDRRSRLAFLDVKATEAALPRIAEIMGNTLGWNDKQRTSAITAAVKHLQENFTSGPLVHPGPDAPAHPILAPEPTKPAATVAAA

SEQ ID NO: 82561 - protein, 73 aa, Arabidopsis thaliana
  misc_feature (26)..(26): Xaa can be any naturally occurring amino acid
SYDTIVASTPHATIFARFNRQKAYTXFPATLKANNDITSITSNCGRVNSIHMLPPIGKNNFETLSYLPDLTDS

SEQ ID NO: 82562 - protein, 432 aa, Cryptococcus neoformans var. neoformans JEC21
MGGCMSTPEAPKKTAETKQVPSTSTSSRPPQASTSATATAAGAGTSAANGTANGIKGDTTATNRVGTSGGQGLAAALASTEPPGAQDSKGNKDRSNQIDRQLEDDQKKFRKECKILLLGSGESGKSTIVKQMKIIHQNGYSKDELLSFRGVIYKNVLDSAQALIMAMRKIGVDPEDANNRSYADRILEYRMDAGLDAVIPSEILYNIESLWHDPVIPSVMDRSSEFYLMDSATYFFANIRKIAGPDYVPDEADVLRARTKTTGISETRFNMGQLSIHMFDVGGQRSERKKWIHCFEAVTSIIFCVALSEYDQVLLEESGQNRMQESLVLFESVINSRWFLRTSVILFLNKIDLFKQKLPKVPLVQYFPEYTGGADINKAAKYILWRFTQTNRARLSVYPHLTQATDTSNIRLVFAAVKETILQNALRDSGIL

SEQ ID NO: 82563 - protein, 303 aa, Bordetella petrii
MKQQHLAFADWLQGRAQHIEAVLDECLPAADALPARLHEAMRYAVLGGGKRIRAALVYAAGQACPVNGSAVAIQASMDRAAAAVELIHAYSLIHDDLPCMDDDTLRRGRPTTHVQFDEATAMLAGDALQPLAFELLADMPIAPALVVQATQALARAAGSLGMAGGQAIDLHSVGQALSRDELQTMHSMKTGAMLACSVALGGIVSGASSSTRQALDDYAQAVGLAFQVVDDILDVTADSASLGKTPGKDAAGNKPTYVSLLGLDDARALAEELRGAAHAALTPLGDAGSTLARLADYIVLRDR

SEQ ID NO: 82564 - protein, 185 aa, Vibrio vulnificus YJ016
MRLNIPNILSLMRLFLIPVFVVAFYLPYSWAPFAAAMVFWVAGFTDWLDGMLARKLGQTSRFGAFIDPVADKVLVATALILITEHYHSIWVTIPAVTMIAREIIISALREWMAEIGKRASVAVSWVGKVKTMTQMFALWVLIWRYDDWMVWLGFGALYIATFLTYWSMVQYLMAAKDDLLNEEHH

SEQ ID NO: 82565 - protein, 226 aa, Silicibacter sp. TM1040
MSFDRSIKIAPSILSADFANFGQEIQAIEAQGADWVHVDVMDGHFVPNLTFGPAAVKAFRPHVKTVMDVHLMIAPVDPYIDAYADAGADVLTAHVEAGPHIHRTLQAIRAAGMKAGVALNPGTPAEAVAHLLDLTDLICVMTVNPGFGGQKFIDMTAKIRSLREMIGDRPVHIEIDGGVDPTTAPLVVEAGADVLVAGSAVFRGGSVEAPEVYGENIRKIRAAANA

SEQ ID NO: 82566 - protein, 911 aa, Hyphomonas neptunium ATCC 15444
MPLSTPTPAKGAGRALGLTTFAFTACFAVWTIFAILGLQIQKELGLSETQFGLLVGTPILTGSLSRLFLGIWADQFGGRIVNLAVMLLSALATWLLTFATTYPEFLLAALGIGIAGGSFSVSITYVSKFFPPEKQGSALGIVGAGNVGAAVTKFAAPIVMASMGWKGVANVWAIALVLVALVFFFLTSDDPELAERRRTGAKPRSFASQFEPLRNIQVWRFSLYYFFVFGAFVALALWLPRYLIGVYGFDVKTAGMLAAAYSIPASIFRIYGGHLSDRVGARTVMYWTFLVSVVVTFFLSYPPTSYVVDGVRGPISFRLATGPVAFVIAIFVLGFFMSLGKAAVYKHIPVYYPKDVGAVGGLVGLMGGLGGFVLPILFGVLNDLTGIWTSCFMLLFLIVSASLIWMHLAIRHMEREAAGATLDSLPQLPEMQPIHGEREARALAPKLIEDWRPEEPQFWEETGKKIASRNLWLSIPALFLSFAVWMVWSVVVAKLPQIGFAYTTDQLFWLAALPGLSGATLRIFYSFMVPVFGGRLWTTLTTWSLMLPALGIGFAVQNPETPYWIMLVLALLCGFGGGNFASSMSNIGFFYPKREKGNALAMNAGLGNLGVSAMQFLVPLVITVGVFGFLGGQPQATEEGGELFLQNAGFIWVPLIIASAFAAWFGMNDLSSAKASFSDQAVIFKRRHNWIMCWLYTGTFGSFIGFSAAFPLLTKTQFPEINVLQIAFLGPLVGALSRSFTGWIADRFGGARVTLAVFVLMMVGTVGVLYFLANKDAPGAFIGFFVSFIVLFFATGVGNASTFQMIPAIMRKEIDRLEPQMSGADRLRQAEKESAAITGFTSAIAAYGAFFIPKSFGMSLAASGSAAPALYGFLAFYVSCLLVTWFVYARPGGLLFDVENRKRSGPATAAA

SEQ ID NO: 82567 - protein, 196 aa, Synechococcus sp. WH 5701
MSRLVGLQAPEFTATAVVDQEFQTVTLSQYRGKYVVLFFYPLDFTFVCPTEITAFSDRYGDFTSRNTEVLGVSVDSQFSHLAWVQTDRKQGGLGDIAYPLVADLKKEIASAYNVLDEDAGVALRGLFIIDPDGVIQHATINNLAVGRNVEETLRVLQAFQHVKANPDEVCPANWTPGEKTMNPDPVGSKEFFAAVN

SEQ ID NO: 82568 - protein, 251 aa, Vibrio parahaemolyticus RIMD 2210633
MIKAQIYDVFCDELAQGNPCGVVELNHWLSDSELLQITHQVAQPVTSFVVKSGSDYHIRWFTLAGEINLCGHGSLGAGAALISKYHQNEVILQSSHGYITVSELDGMYRIVMPSWQAKPHAIPLGISGFSNRPIDAFTTRDLVVVLESEDDVVCYQPNFDELIKIDEFHAVIVTAQSSDSGYVLRYFAPKIGISEDLATGSAQCSLAPYWFEKLGKEKLTARQLSRSGGYFEVARGSESTIVLSAQVKSRT

SEQ ID NO: 82569 - protein, 294 aa, Antirrhinum majus
MEQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSQDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRVMGTPNEETWPGVTSLPDFKSAFPKWPAKELAAVVPNLDASGLDLLDKMLRLDPSKRITARNALQHEYFKDIGFVP

SEQ ID NO: 82570 - protein, 447 aa, Silicibacter sp. TM1040
MATATAKDVDRAVVSARRAFDDGRWSGLAPAARKKVLHRIADKIEAEALALTVLGVRDNGTEFNMALKAEAGSAAGTFRYYAEALDKVAGEVAPTAPDVLGLVHRAPVGVVGAIVPWNFPLMIGAWKLAPALAMGNSVVLKPAETASLSLLRLAEICADCGLPDGVLNVVTGPGAVTGAALSEHMDVDVMVFTGSGATGRRLLVASARSNLKRCYLELGGKSPNIVFADAKDLDHVAKVSAMGIFRNSGQVCVAGSRLLVEASIHEEFVARVVAHAQALRVGDPLDMNTQIGAVNSETQLAANLAHVERAAAQGGEVLCGGGRILSETGGTYMAPTVVAGVTQDADLFQKEVFGPVLSVTAFESEDEALRLANATDYGLAAGVWSQDLSRAHRCVAGIRAGVVHVNTYGGADNTVPLGGVGQSGNGHDKSLHALEKYVDLKTAWIQL

SEQ ID NO: 82571 - protein, 295 aa, Hyphomonas neptunium ATCC 15444
MADLKGKVAVITGAASGIGLAGVEVFIAAGARVIAGDIQDEKGKALETRFGPEKLRFVHCDVTDMDQLKAVMDAAPAAFGSLDIVWNNAGHGGTNTSVEELDLDGYDQTMNLLLKQVFAGTKFAIPHMKDKGGAIINTSSISAVSAGYAPITYSVAKKGVAHFSKLAAAELSKYKIRVNAILPGFIATSIFGASLGLPREVADQMAEMLYQAGGKMQPIGRVGKGTDIAEMAAFLASDAGEFITGGEFLVDGGMTVGPRHSWDATAASPVLESLGISPEQAEQMRLAQQAAAAQS

SEQ ID NO: 82572 - protein, 280 aa, Antirrhinum majus
AYGVVYKARDIETNEDIALKKIRLEQEDEGVPSTAIREISLLKEMHHENIVNLKDVVHREKRLYLVFEYLDLDLKKHMDSCPEFSQDLHMVKMFLCQILRGVAYCHSHRVLHRDLKPQNLLIDRGSNTIKLADFGLARAFGIPVRTFTHEVVTLWYRAPEVLLGSRHYSTPVDVWSVGCIFAEMVNQKPLFPGDSEIDELHKIFRIIGTPNEDIWPGVTSLPDFKSSFPKWPPKELATIVPNLGATGLDLLCKMLQLDPSKRITAKKALEHEYFKDIVLP

SEQ ID NO: 82573 - protein, 305 aa, Antirrhinum majus
MEKYEKLEKVGEGTYGKVYKALEKSTGQVVALKKTRLEMDEEGVPPTALREVSLLQMLSQSLYVVRLLSVEHVDCAKNGKPLLYLVFEYLDTDLKKFIDSHRKGPNPRPLPPQQIQSFLFQLCKGVSHCHAHGVLHRDLKPQNLLLDKDKGVLKIADLGLARAFTVPLKSYTHEIVTLSYRAPEVLLGSSHYSTAVDMSSVGCIFAEMVRRQALFPGDSEFQQLLHIFRLLGTPSDEQWPGVSSLRDWHVYPQWEPQNSAPAVPSLGPDGLDLLTKTLKYDPADRISAKAALDHPYFDTLDKSQF

SEQ ID NO: 82574 - protein, 312 aa, Antirrhinum majus
MAEEKSKSSAMDAFVKLEKVGEGTYGKVYRAMEKSTGKIVALKKTRLHEDEEGVPPTTLREVSLLRMLSRDPHVVRLLDVKQGQNKEGKTVLYLVFEYMDTDLKKYIRSFKQTGESIAPMNVKSLMYQLCKGVAFCHGHGVLHRDLKPHNLLMDRKTMMLKIADLGLARAYTLPIKKYTHEILTLWYRAPEVLLGATHYSPAVDMWSVACIFAELVTQKALFPGDSELQQLLHIFRLLGTPNEEIWPGVSTLVDWHEYPQWTAQPISSAVPGLDEKGLNLLSEMLHYEPSRRISAKKAMEHPYFDELDKSGL

SEQ ID NO: 82575 - protein, 455 aa, Silicibacter sp. TM1040
MTAHQPDANFLKEHNARSLWHPMAHPGDSLANPPTIVTGASGVRIKDVDGHEVVDAVGGLWNVNLGFSCQPVKDAIAAQLDVLPYYSIFRGTTNDQVIQLAEELRDFFAPDGLSRAFFTSGGSDSVETALRLARQYHKVRGEPARVKYLSLKKGYHGTHFGGASVNGNANFRTAYEPLLAGCHHIPAPYTYRNPFNETDPERLAQLCLAALEDEIAFQGAGTIAAFIMEPILGAGGVIPPHESFMPGVAEICRRHGILLIADEVITAFGRTGSWSGSRHWGVQPDMMCTAKAITNGYFPFGALMLSERLVEVFEKDDTGKAAIGHGYTYSGHPVGAAAALACLAETKRLNVPENAAARGAQIFEGLQDLAARYDLIGDVRGGHGLMSALELVSDRATKAAVDKKVINRLQEVAYQNGAMVRVSGPNIILSPPLVLTEADAAQILSALDAGFAAVN

SEQ ID NO: 82576 - protein, 469 aa, Staphylococcus aureus subsp. aureus Mu50
MARKLHRELNNRHIQLIAIGGAIGTGLFLGSGQTISLTGPSLLFTYMIIGVVLFAFMRALGELLLSNTRFNSFVDIANEYLGPFGGFVIGWTYWLCWIVSSMSDLTAMGQYFAFWYPQVPNWITVLFIVLILISFNLLGARLFGELEFWFSIIKVVTIIAMVIVGLVLIFFSFKTHYGHASFTNLISHGGMFPGGTFGFLMSFQIAVYSFIGIELIGVTAGETKDPEKTLPKAINNVPIRILLFYIGGLLVIMSVIPWNDIDPNSSPFVKLFTLIGVPFAAGVVNFVVLTAAASATNSGIYSNSRILFGLSQQGLGPKVLNKTNSHGVPYLSMLVSSIALLIAALLNYIFPNAIQLFIYVTTLSTVLFLVVWAMIIVAYLMYLKKHPEAHKNSKFKLIGGKPIAYIILAFFFFVFILLFFSDETRAAIYISPFWFIFLFFFYKKYKTNAEKLAYEQRQNDSGHFRYDNQ

SEQ ID NO: 82577 - protein, 477 aa, Colwellia psychrerythraea 34H
MNTKTTSSAVSIFPAIMCGGSGTRLWPLSRALFPKQFLPLVNDTSMLQDTLLRLPENSKEAVFICNEEHRFLVAEQVRQLSSSQGTILLEPEGRNTAPAVALAAINALEKDKGALLLVLAADHVIQDTAAFHQAVEQASIVAQQGKLVTFGIVPTHAETGYGYIKKGNVQSSGTFDVAEFVEKPKQDIADEYLASGDYLWNSGMFLFKASRYLEELAKHRGDILENCQRAMKGVEQDLDFMRPNKADFLACASESIDYAVMEKTDSAVVIPLDAGWSDVGSYSALWEVCQQDDDKNVLKGDVIAQQTTNSYIHSQNKLIATVGVDNLVIIDTPDAVLVANKDKVQEVKQIVEQLKADKRSEAVLHREAYRPWGKYDCIDTGERFQVKRITVKPGAKLSVQMHHHRAEHWIIVSGTAKVTIDEKVVLLTENQSAYIPVGAVHALENPGKLPLEMIEVQSGSYLGEDDIVRFEDKYGRS

SEQ ID NO: 82578 - protein, 381 aa, Vibrio parahaemolyticus RIMD 2210633
MSKRDFYEVLGVSRDASERDIKKAYKRLAMKFHPDRNQGDESAADKFKEVKEAYEVLTDSQKKAAYDQYGHAAFEQGGGGFGGGFGGGGADFGDIFGDVFGDIFGGGRRGGGGHRAQRGADLRYNMELTLEEAVRGVTKEIEVPTLVHCDSCDGSGAKKGSSAETCGTCHGHGQVQMRQGFFAVQQTCPTCHGKGKIIKDPCNECHGQGRKQKTKTLNVKIPAGVDTGDRIRLSGEGEAGEMGAPSGDLYVQVHVKEHHIFERDGNNLYCEVPVSFAMAALGGEVEVPTLDGRVSLKVPSETQTGRMFRMRGKGVKGVRGGGIGDLIVKLVVETPVNLSSRQKELLKEFEESCGGEAATKHKPKSEGFFNGVKKFFDDLTS

SEQ ID NO: 82579 - protein, 413 aa, Colwellia psychrerythraea 34H
MTDLRQQALDYHALPTPGKISVSLTTAAETSQDLSLAYSPGVAEPCREIANNPDDVYKYTGKGNTVAVITNGTAVLGLGNIGPMASKPVMEGKSLLFKRFANIDSFDIEVKHKTVEEFVNTVANIADSFGGINLEDIKAPECFAIEKALIERCKIPVFHDDQHGTAIVTAAGMMNALDIQGKDIKQANIVCLGAGAAAIACMELLIKCGAQREKIYMLDTKGVIHTRRDDLNEYKKLFANNTDKRTLDDVIEGADVFVGVSGPDLLSQKQVKAMADRPIVFACSNPDPEIKPELALAARDDLIMATGRSDYPNQVNNVLCFPFIFRGALDVRARTINDAMKIAAVHAIRALAKEPVPAEVLKASCEKDLSFGKDYIIPKPMDPRLCGAVARAVAQAAVDSGVAALDMPENYMA

SEQ ID NO: 82580 - protein, 183 aa, Methanosarcina mazei Go1
MSESSIKIENVVASTKLAEEFDLTVIESEFEGAEYNKQKFPGLVYRVSDPKAAFLVFTSGKVVCTGTKNVADVHTVVGNLAKKLNSIGIKTIENPQITVQNIVASADLHTILNLNAIAIGLGLENIEYEPEQFPGLVYRIDEPKVVVLIFSSGKLVVAGGKSPEDCERSVEVVRQQLDSMGLL

SEQ ID NO: 82581 - protein, 499 aa, Burkholderia vietnamiensis G4
MKASTILSDLGIAHLAGAGDIEVRSPINGEVVGRVASQTVSDVDAALASAQEAYKAWRNVPAPRRGELVRLLGEKLREQKQALGSIITLETGKILQEGLGEVQEMIDICDFAVGLSRQLYGLTIASERPGHRMAETWHPMGVCTVISAFNFPAAVWSWNAALALVCGNAVIWKPSEKTPLTALAVDKILHDALKEFGDAPAGLTALINGGRDVGAKLVSDSRSNIVSATGSTEMGRAVGIEVARRFGRSLLELGGNNAGIVSNTADLELALRGILFSAVGTAGQRCTTLRRLFVQESIYDKVVDRLKTFYAKVAIGNPLEQGTLMGPLIDGQSFSRMQAALEQAKSEGGKVFGGERHVVAGNENGFYVRPAIVEMPSQTDIVLQETFAPILYVLKYSDFNEALEANNAAHHGLSSCVFTTDLRESERFLSASGSDCGIANVNIGPSGAEIGGAFGGEKETGGGRESGSDAWKAYMRRATNTVNFSSALPLAQGIDFNID

SEQ ID NO: 82582 - protein, 325 aa, Xanthomonas axonopodis pv. citri str. 306
MSDTTMTAIAIRDGKGDADALYATEQPRPRPAPGQVLIRVHAAGINRPDLLQRAGHYPPPPGAPETLGLEIAGEIVEPAGRWKVGDRVCALLGGGGYAQYAAVDARHVLPIPAGMDLVHAAALPETIFTAYANLFEHGRLAAGQWLLLHGATSGIGVTAIQMAKAAGAHVLATARSAVKAAQARELGADVAIDSTTASFVEVAKAHGGVDVALDMVGAAVFADTLEALNPHGRIVYIASQAGATIEVPIPVLMRKQAVITGSTLRPRSADEKARLAAEVERVVWPWIEQGKLRVLLDKRFPLREAAAAHRYLEQGSHLGKVVLEM

SEQ ID NO: 82583 - protein, 96 aa, Brassica napus
  misc_feature (59)..(59): Xaa can be any naturally occurring amino acid
MAAAEGQWVLMATGRTPTNIAVIKYWGKRDEALILPINDSISVTLDPDHLSATTTVAVXPSFPSDRMWLNGKEISLLGGRSQSCLREIRKRARDFE

SEQ ID NO: 82584 - protein, 377 aa, Zea mays
  misc_feature (33)..(33): Xaa can be any naturally occurring amino acid
  misc_feature (45)..(45): Xaa can be any naturally occurring amino acid
  misc_feature (128)..(128): Xaa can be any naturally occurring amino acid
  misc_feature (204)..(204): Xaa can be any naturally occurring amino acid
  misc_feature (261)..(261): Xaa can be any naturally occurring amino acid
  misc_feature (312)..(312): Xaa can be any naturally occurring amino acid
MASSPRSPPAPTPEFEISRQSRLFAALSKKVIXLDELRMLAAQGXPDAAGVQATVWKLLLGYLPNDRALWPVAVGAEELAKKRGQYAAFKGEFLRNPVSHCRFCSYLWPHYNVNAEHVHNGFLHRSEXTREEHPLSLGKTSAWNQFFEYSEIMEQIDRDVKRAHPDMHFFCSDSSFAKSNQESLKNALLIFAKLNAGIGYVQGXNEILAPLFVFRSDPDDKNAVWTGSLFCFVELVSGFRDNFCQKLDNSAVGVRATLADXAKLSQLVAKHDGGLQQHLEITTEVNPQFYAFRWIPLPLTQEFNFADTIHIXWDTVLSDRDSLQDTLLRITCQRTSAITSTPPTNCSAPISFAPEALLCLFSRVWLSPSSIAKGIQN

SEQ ID NO: 82585 - protein, 489 aa, Burkholderia vietnamiensis G4
MQKSPTEARHRETAVDVRSAEFIQYTSNGSAAISAQIQEESNSALGHGLKQRHVVMLSIGGSIGAGLFVGSGHAIAEAGPAAIVAYIFASLLVVLVMRMLGEMACAMPDSGSFSTYAGKAIGPWAGFTIGWMYWWFWVLVVPLEATAAANILNSWFPDVAVWKFCLGVTLLLTATNLVSVKHYGELEFWFATIKVVAIILFIACGVAAILGFIPGLHINATANIFSDGGFAPKGWAPIAGAMLTTMFTFLGTEVVTIAAAESANPAREISRAITSVVWRISLFYLGSILVIIAIVPWNDPSLTTIGSYQAVLQKIGVPYAKFIIDALILVAVGSCLNSAIYTASRMIFSLGARGQAPRAVTRTSRSGVPVAAVLASTLVAFVGCAANYLAPKSVFDALLSTTGAIALLVYLVIALSQLRMRRRILLTSKLKVRMWLHPFLGLFVVFLITGALVVMVSGETHRQEVVATLAFSGLLAVAGYAHQRWQRRR

SEQ ID NO: 82586 - protein, 535 aa, Vibrio angustum S14
MAQLTSKVDTASQWFKNNNDEMQLLVDDLNSHLEIIHQGGGESALEHQKKQGKQPVRQRIHQLLDKHSPWLEIAPFAALNVYSEAVPCAGIIAGIGYIHQHACMIIANDPSVKGGTYFPLTVKKHLRAQEIAEKCHLPCIYIVDSGGANLPHQAEVFADKDHFGRIFFNQAQMSAKGIPQIAVVMGLCTAGGAYIPAMSDVSIMVKDQATIYLAGPPLVKAATGEEVTAQELGGADVHCKTSGLADYYANDEAHALSLARDAIASCNIPSANTHHNSTASLPKYSMDDIYGIVGTNIRIPFDIKELIARLVDNSEFDEFKAMYGNTLVCGFGAIEGHPVGIIANNGILFSESAQKGAHFIELCCKRKIPLLFLQNITGFMVGKRVEAEGIAKHGAKMVMAVACANVPKFTVIIGGSYGAGNYGMCGRAYDPTLLWMWPNARISVMGGEQAAEVLSKITQAIRQRENKPWTEQDEQQIKQPILELYDTQGHPYYASSRLWDDGIIDPKSTRNVLAQALSITQHVPIKETRFGIFRM

SEQ ID NO: 82587 - protein, 439 aa, Yersinia pestis CO92
MLSLDQIPHHIRHGIVGSRLIQIRGRVTQVTGTLLKAVVPGVRIGELCYLRNPDNSLSLQAEVIGFAQHQALLIPLGEMYGISSNTEVSPTGTMHQVGVGEHLLGQVLDGLGQPFDGGHLPEPAAWYPVYQDAPAPMSRKLITTPLSLGIRVIDGLLTCGEGQRMGIFAAAGGGKSTLLASLIRSAEVDVTVLALIGERGREVREFIESDLGEEGLRKAVLVVATSDRPSMERAKAGFVATSIAEYFRDQGKRVLLLMDSVTRFARAQREIGLAAGEPPTRRGYPPSVFAALPRLMERAGQSSKGSITALYTVLVEGDDMTEPVADETRSILDGHIILSRKLAAANHYPAIDVLRSASRVMNQIVSKEHKTWAGDLRRLLAKYEEVELLLQIGEYQKGQDKEADQAIERMGAIRGWLCQGTHELSHFNETLNLLETLTQ

SEQ ID NO: 82588 - protein, 974 aa, Vibrio vulnificus YJ016
MRRGRESFFYFKGKCMSTAFEVDTNTIATIFSSQVPVVEGIYDLTPDQVLLDQAEHESEVRSYPRRLPIAIKQAYGCLVEDTRGQIFLDCLAGAGTLALGYNHPEINQALKEQLDSGLPYQTLDIATTAKTNFIKSVKAFLPEELGNNCVIQFCGPSGADAVEAAIKLAKQTTGRNTMFAFRGAYHGMTNGTMGMMGNLNTKARRTGLMSDVHFMPFPYSLRCPFGLGGDEGAKASIRYIERLLNDDEAGIMKPAAIIVEPVQGEGGVIPAPAFWLRELRRICDEHGMLLIFDEIQCGVGKSGYNFAFEEAGIVPDVLCLSKAIGGGLPMSLLVINKKHDTWRPGEHTGTFRGNQLAMVSGAKALEIITRDNLVEHANVAGQYLRHGLEKIQQRVDCIAEVRGKGLMLGVEIRKPGSELNKFGEPVSDGQLTLAIQRAALERGLMVEKGGRDGSVIRFLPPLIISFEQIDFALRILEEAILAAGGNLKAVEENAEWKKHFIHTGVNGSKEFASVMNHTTAALKNAFEEVDAPYSGMDPKALESAIYAVDLDNKNAPLKEIIDETTELVVKNSIFTQHPDCIAHLHTPPLMPAVAAEAMIAALNQSMDSWDQSSSATYVEQKVINWLCDKYELGAKADGIFTSGGTQSNQMGLMLARDWIADKLSGHSIQKLGLPDYADKLRIICSKKSHFTVQKSASWMGLGEKAVLTIDAHANGTMDVTKLEASVEQAKAEGLIPFAVVGTAGTTDHGAIDDLNTIADVAEKHDLWMHVDGAYGGALILSSQKARLKGVERAQSVSVDFHKLFYQTISCGAVLVNDKQNFKFLLHHADYLNREHDELPNLVDKSIATTKRFDALKVFMTMQNVGPKALGAMYDHILGQTLEVADLVRNTEGFELLAEPSLSTVLFRSTLGSDLDELNKTLRLEALTRGVAVLGETIVDGKTALKFTILNPCLKMSDFESLLSKINTLAAELAQ

SEQ ID NO: 82589 - protein, 366 aa, Aspergillus oryzae
MVRNIVVIGGTSHPQLTQNICGVLGIPPADVLLSKFSVGETRVEIKESVRGKDVYIIQSGGGKVNDHLLELLITISACKTASAKRVTAVLPLFPYSRQSDIPYNKTGAPLAAVSNGAFGEDSVNKINNFQPRPGYKQWVAQAGTLVADLLACAGADHIITMDLHDPQYQGFFDIPVDNLYGRPLLKSYIQRNIPNYKRAVIVSPDAGGAKRATAIADSMGIEFALIHKERRPTRITDRQNATMMLVGDVKGRTAILIDDLADTSNTITRAAKLLKKEGAAQVYALVTHGILSGDAIDRINASALDKVVVTNSVDQTEHLRQCPKLEVLEVGHVFAEAIRRVHHGESISVLFHHKIRIWEMEEGKDT

SEQ ID NO: 82590 - protein, 270 aa, Oryza sativa
KKKKGGDKAKGGSSSSSGRKREQQGAQPSSQQQQQQQKEVFWAPAPLTTKSWADVEEDDDDAVHAALQEEVESEDEDLDDEVDDGAVDEPEHEVDDTSAEPAGKKAAVPVAPPKDTERQLSKKELEKKELPELDAVLAELGISGGSSNAAQDENNAEKKGSNQTGDGDAPAPSESKSSKKKKNKKAKEAKESQEPADGTEETASAEPDEDTTSVDVKERLKKMASMKKKKSGKESDTAAKIAAAEAAARSARLAAAKKKEKNHYNQQPVR

SEQ ID NO: 82591 - protein, 177 aa, Synechococcus sp. WH 7805
MTEPTGPLNAVFSSPRVDPGAWVADSAVVMGDVQISAAASLWPMAVARGDLAPIAIGSGSNVQDGAVLHGDPGAPVIIGSDVTVGHRAVVHGATLEDGCLIGIGAIVLNGVTVGRGALVAAGAVVTRDVPAGSLVAGVPAQVKRQQDEDALDAQREHARRYAELARTWQQMLQIQTH

SEQ ID NO: 82592 - protein, 329 aa, Bordetella petrii
MASNLVKAVRIEQHGGPEVLKIVDVEVPPPAPNEVTIRQHVAGLNFIDIYYRTGLYPHPLPHGLGFEAAGVVEAVGADVAHLKKGDRVAYGQSPIGAYAQARNVPAAQVVKLPKGVAFDEAAALMLKGLTVQYLFRQTYRLQGHETILFHAAAGGVGLIACQWAKALGVKLIGTVSSPEKAELARANGAWQTIDYSRENVVERVLELTGGKKVPVVYDGVGKDTWETSLDCIEPRGLMVSFGNASGPVSGVNLATLNQKGCLYVTRPSLGLHVNTQEKLNAAASEMFDLVLKKKIKVRIDQRYTLEQAGEAQTALAARKTTGATVLTLD

SEQ ID NO: 82593 - protein, 94 aa, Brassica rapa
TRSTRAGRMRSTWGDDCLEFKPERWISGSDSGRFINHDPFKFVAFNAGPRIYLGKDLAYLQMKSIAAAVLLRHRLTVVTGHKVEQKMSLTLFMK

SEQ ID NO: 82594 - protein, 452 aa, Streptococcus mutans UA159
MKVVKFGGSSLASATQLEKVLNIIKSDEERRFVVVSAPGKRDAQDTKVTDALIRYYRSYTSDKDVTADQSWIINRYRAIIDELGLGQNILEKITKAIVDLANLPIEDNDFLYDTFLAAGEDNNAKLIAEYFRKNGLSARYIHPKKAGIIVTSEPGNARIIPSSYDKLEELRDSDEVLVIPGFFGVTIDNQICTFSRGGSDITGSIVAAGVKADLYENFTDVDGIFAAHPGVVHKPHSISELTYREMRELAYAGFSVLHDEALIPAYRGKIPLVIKNTNNPEHPGTKIVLAHTGATIPVVGIAGDDDFVSINLSKYLMNREIGFGRKILQVLEELNIRWEHIPTGIDDMSIILRGRELTPIKEQEIISQLTRKLEVDEVEIERNLSIIMIVGENMKNHIGVTAKAAEAFSKKHINLEMISQGSSEVSVMFVIKTEQEKQAVRALYQTFFMKDE

SEQ ID NO: 82595 - protein, 294 aa, Pinus contorta
MEQYEKVEKIGEGTYGVVYKARDRLTNETIALKKIRLEQEDEGVPSTAIREISLLKEMQHGNIVRLQDVVHSEKRLYLVFEYLDLDLKKHMDSCPELAKDPRLIKTFLYQILRGIAYCHSHRVLHRDLKPQNLLIDRKTNALKLADFGLARAFGIPVRTFTHEVVTLWYRAPEILLGSRHYSTPVDVWSVGCIFAEMVNQRPLFPGDSEIDELFKIFRVLGTPNEETWPGVTSLPDFKSAFPKWPAKDLATVVSGLEPAGIDILSKMLCLEPSRRITARSALEHEYFKDLGFVP

SEQ ID NO: 82596 - protein, 183 aa, Methanosarcina mazei Go1
MSESSIKIENVVASTKLAEEFDLTVIESQFEGAEYNKQKFPGLVYRVSDPKAAFLVFTSGKVVCTGAKNVADVHTVIGNMAKKLNSIGIKTMENPQITVQNIVASADLHTILNLNAIAIGLGLENIEYEPEQFPGLVYRIDEPKVVVLIFSSGKLVVTGGKTPEDCESGVEVVRQQLDNMGLL

SEQ ID NO: 82597 - protein, 90 aa, Elaeis guineensis
MATRQERAELDAKARQGETVVPGGTGGHSLEAQEHLAEGRSRGGQTRREQLGTEGYQEMGRKGGLSTTDESGGERAAREGIQIDESKFRT

SEQ ID NO: 82598 - protein, 356 aa, Bordetella petrii
MAGKKHKIAVIPGDGIGKEVVPEGLRVLDAAATRYGIDFQWDHFDWSCDYYAKHGQMMPDDWAEQIGSHEAIFFGSIGWPATVPDHEALWGSLFRFRRDFDQYINLRPVRLMPGVPSPLADRKPGDIDFFIVRENTEGEYSNSGGRLFAGTEREVVIQESVFTRVGADRVLKFAFDLAQKRGKHLTAATKSNGISISMPWWDERVADVASHYPDVRWDKYHIDILCAHFVQHPDWFDVVVASNLFGDILSDLGPACTGTIGIAPSANLNPERKFPSLFEPVHGSAPDIYGKNIANPIGQIWSGALMLDFLGYPQASQAVVAAIETVLADGPRTRDMKGTASTQDVGKAIAELVAAG

SEQ ID NO: 82599 - protein, 714 aa, Pseudomonas aeruginosa PAO1
MTDAIRYEKGQDNVVVLTMDMPGQSANTMNGVYREAMAKTIARLEAEKEGIAGVVLTSAKKTFFAGGDLNELIKVTKADAPAFYQGILELKGQLRRLETLGKPVVAAINGAALGGGWEICLACHHRIALDNPGVQLGLPEVTLGLLPGGGGIVRMVRLLGLEKALPYLAEGKKVRPAEALKAGLIHELADSPEEMLEKARAWILANPAAKQPWDSAGYKIPGGTPASPNVAQMLAIAPSVLRDKTKGCFPAPEKIMCAAVEGAQVDFDTAQLIEARYFTELTTGQVAKNMIGTFWFQLNEINAGKSRPQGYPVRATKKVGVLGAGMMGAGIAYVSAAAGIEVVLKDVSLEAAEKGKAYSARLLDKKVARGHLSAEKRDAFLARIVPSVSEADFEGCDLIIEAVFEDRALKGKVTAEAEKHALADAVVASNTSTLPITGLAQAVARPEKFIGLHFFSPVDKMPLVEIIRGEKTSDETLARGFDYVLQIKKTPIVVNDSRGFFTSRVFGTFTNEGIAMLGEGVSAAMIDNQARQAGMPVGPLAISDEVSLSLMTHIRNQTARDLEAEGKALPTHPAFAVIDLMVNEYKRPGKAAGAGFYDYPANGRKHLWAELKSRFEKPDAQISAEDVRDRLLFIQAIETVRCVEEGVLHSTADANIGSIFGIGFAAWSGGALQFINQYGLKDFIARAQYLVEQYGERFEPPALLLEKAAKGELF

SEQ ID NO: 82600 - protein, 82 aa, Phoenix dactylifera
ELDAKARQGETVVTGGTGGLSLEAQEHLAEGRSRGGQIRRDQLGTEGYQEMGRKGGLSTMEESGGERAAREGINVDESKFRT

SEQ ID NO: 82601 - protein, 434 aa, Candidatus Protochlamydia amoebophila UWE25
MSYIRSVKGREILDSRGNPTVEVELITDQNVMVKASVPSGASTGENEALELRDGDLNYYFGKGVLKAIANINGPIAQILVGEQVYDQERLDRMLIEADGTDNKGHFGANAILGVSLALARAGALTANLPLYRYIGGVHAHLLPCPMMNIINGGAHADNSLDFQEFMIRPVGASTLREAVRWGAEIFHTLKGILKKAGHVTAVGDEGGFAPNLSSNEEALELILLAIEKAGYQPGKQVVLAMDCAASEFYDKTTKQYFEKKKKQKNQVFAERTAEEQIAYLETLCQNYPIDSIEDALAEGDWCGWQRLTERLGRKIQIVGDDIFVTNPKFLEKGIELGVGNAILVKINQIGTLTETLQTIRLAQTNNYACIISHRSGETEDSIIADISVAANTGQIKTGSLSRSDRIAKYNRLLAIEAELESTALYQDSNRFQIF

SEQ ID NO: 82602 - protein, 436 aa, Vitis vinifera
MESDLGKLFIGGISWDTDEDRLKEYFRTYGEVVEAVIMRDRTTGRARGFGFVVFADPAVAERVVMDKHMIDGRTVEAKKAVPRDDQHLLNRNTGRTKKIFVGGLASTVTESDFKKYFDQFGTINDVVVMYDHNTQRPRGFGFITYDSEEAVERVLHKTFHELNGKMVEVKRAVPKEHSPGPSRSPLVGYNYGLGRNNNFLNNYGQGYNMSSVGSYGIRMDGRFNPVASGRSGFPPFGAPGYGMGMNLEQGLSPSYSGNSSFSNNPGYGRILNPYYSGNSNRYSTPIGYNAGNGRSDSVLNSTPRNVWGNGSLNNATNPASGNFGVSFGNGGANWGSSPIPAQGGGSALGFTSGSVAAASSFAPSTGGYEGSYEELYRSGSVYNDSTWRTPTSELDGPGSFSYGLGNAASDVTANSAEDYIGSYSVANRQSNRGIAA

SEQ ID NO: 82603 - protein, 356 aa, Silicibacter sp. TM1040
MARFHPLEVTDIKKTIRDAVVVTLKPLNGAAAEFDFTQGQYLTFRRDFDGTELRRSYSICAGKDEGILQVGIKRVDGGAFSTWANTVLKVGDTVEAMPPQGRFFTDLDAAAEKHYLGFAGGSGITPVLSILKTTLQAEPQSRFTLVYANKGINSIMFREEIEDLKNRYMGRLSVIHVLETDAQEVDLFTGLVTQEKCAELFERWIPIQSVDTAFICGPEPMMLGIAEALRTAGLSDEQIKFELFASNQPGRAAKKATSGDAAASAPVTAAITLDGATRSVTLDRNTSVLEAALENAMDAPWSCRAGVCSTCRCRVIEGEVEMAANHALEDDEVAKGFVLSCQAYPLSDALVVSYDE

SEQ ID NO: 82604 - protein, 145 aa, Arabidopsis thaliana
  misc_feature (39)..(39): Xaa can be any naturally occurring amino acid
RPTRPEDEGRACAILYSFDVVTSPDQATMAGPFTDLKNXSSFPATLPASSDMTCITSLGGRVCCLNGCSPIDYRKVETLCYLHDLTDEKLAMEDDYLLPNKRNPRGECEHKHGLVLRGHENTPGYYHGRYWALWELTLAGCTDFT

SEQ ID NO: 82605 - protein, 200 aa, Arabidopsis thaliana
  misc_feature (25)..(25): Xaa can be any naturally occurring amino acid
  misc_feature (63)..(63): Xaa can be any naturally occurring amino acid
  misc_feature (80)..(80): Xaa can be any naturally occurring amino acid
  misc_feature (151)..(151): Xaa can be any naturally occurring amino acid
  misc_feature (161)..(161): Xaa can be any naturally occurring amino acid
MFSSAVVVTSRVKATMAVQSHRLEXSVAFPATRQTNKDIISYRGNGGRVICLKVWPPFGKKKXETLSYLPDLRDVKWAKXEVDYLLRNKWIPCVEFELEHGFVYREHGNTPGYYDGRYWTMWKLPLFGCTDSAQVLKEVEECKKEYPGAFXFRIIGFDNTXRQVQCISFHCLPSPPSFHPKLNFLFLKHSYELSLLISIS

SEQ ID NO: 82606 - protein, 386 aa, Oryza sativa Japonica Group
MMIHRQSLQHNHTEGEEKPKPDDDSTVASGGKDVGEDDGRIPLPGPPLFHNVSLIMSRRSRCVLLAFGYAYPAYECYKTVELNKPEIEQLIFWCQYWILVALMTVMERFGDFTISWLPFYSEAKLMFFIYLWYPKTKGTTYIYGTFFRPYISQHENEIDRNLLELRARATDVVVLYFQKAATVGQNTFFDVLKYVASQSPSQRSSQQPSQEPQQPKQQQAPVQQQPTQKQAPTVLRRSASIAARQAAMAQQSQDAKTVPSSPKIKRQASTKAAPVASTKLTGAAAPSTPKSDADAPKKNEAAPASLQVATPATKADVPASEPSAPLPEAEEADKMAIDEADDAVEGTEEGDPVPGETVEERPMEETIRVTRSKLRRRTASEDPAGN

SEQ ID NO: 82607 - protein, 347 aa, Candidatus Blochmannia floridanus
MNQLYQRSFLRLMDFSMNEIMYILRLSHFLKQQKSNHTETQKLHKKNIVLIFENHSTRTRCAFEVAAFDQGARVTCLTPNISQIGHKESIKDTAKILGRMYHGIQYRGYNQDTINIFAQYSNVPVWNGLTEQFHPTQMLADLMTMQEQVPHKSFCKIKLAYVGDARNNIGNSLLEAASIIGFDLRLVSPREFWPQQELLTTCRKLTKLNKVNILLTENIQEGVKDVDFLYTDVWVSMGENEKVWTHRISLLSPYQVNQDMINYTGNSNVKFLHCLPALHNNETTIGKKIAHKHNLFNGLEVTNEIFESKHSIVFDQAENRLHTIKALMISTLLPNLYHKNITFHTKN

SEQ ID NO: 82608 - protein, 387 aa, Chlamydomonas reinhardtii
MAPGFGNFATADDASTSSGYQDQGPLARLLSKLRQFKALAADKDLANSELAPLIRALPLDTELQQLLAKFHWYPGHNFTTTVDLANLKGALQKYKYIKIGQLGSGSYGVVHKAINRETNELLAIKKVVHSIENGLSDSTIREISTLRELQHDNIVRLKDIIATVNGTHVHLVLEFLDCDLRHYLDTYAEASNINRIKSIVFQILRGIRHAHANSIMHRDLKPQNVLVGVHSGNVKITDFGLARCFLPNEDRAYTERVVTLYYRAPELLLGAQHYTSAVDLWSVGCIMAEMVNFEPLFRSDSEIGLLFRMFEQLGTPTPDAWHELSGLAYYSENFPRFVPRRFEDMVPRLANDAVGLDLLRRMLCYDPRQRITASEALVHPWFNDVVV

SEQ ID NO: 82609 - protein, 357 aa, Methylobacillus flagellatus KT
MATMKAAVFVSPGKIALRDKPVPEIGPLDALIRITTTTICGTDVHILKGEYPVAAGLTVGHEPVGIIEKLGSEVHGFKVGQRVIAGAITPSGHSNACLCGIGAQDGPDSPHGFKVAGGWKFGNTIDGSQAEFLRVPDAMANLSPIPDHLSDEQVLMCPDIMSTGFSGAERGNIKIGDTVVIFALGPIGLSAVAGAKLLGATKIIGVDSIPDRLNIARALGADHVINFKTHDPVQEILKLTDGRGVDVAIEALGVQQTFESSLRVLRPGGTLSSLGVYSSDLRLPLDAFGAGLGDFTIVSTLCPGGKERMRRLMEAVGSGRADLSNLVTHRFKLSEIEEAYDLFANQRDGVIKVAITP

SEQ ID NO: 82610 - protein, 1103 aa, Ustilago maydis 521
MSQRVSQIAGHLSGPAPLLKGQVAIITGAGQGIGEATAKLFASHGAHVVVSDLDAKKAQDVAAQITKSGGSAIALAGNVMDKDFGERVVKAAVDKWGKLNIIVNNAGFTADKMAHTTDDATFQLMLDCHITAPFRIIRAAAPYFRIKDESKRENMAIVNVSSTSGTHGNVGQVNYSAAKSGVLGLTKTMCKEWGPFGVRVNCVAFGWINTRLTQAKEAGASIEIDGKKIALGIPGRPTGGDSKQQSVTAVADIPLRRPGDAEEAAASILFLASPLASYVSGQILEVTGGRVSHVPRRNSRFGPRGNAACCLSRDFTILHLVSLKLLTIIPLWHRVLNMPPTATNQGSSDDKAAASTSTFDPFAHIRSFKYSGSLKAVYPLSPKPKIPPSIRRPNYAREGVRMWLSFWWQVRIPLLAVSLPFVSMRRARFADVPDATTLLAFLLLGLALDSFKQFLESRNIKVNNKADQDGVRKAAALAREVLEIAAAHAKPGVTTDELDKIVFAEAIKRDCYPSPLGYHGYPKSVCTSINEVICHGIPDQRPLEDGDILNLDVTLFHKGYHGDLNATFPVGKKAEDDAESMKLIRVARECLDAAINICGPGVPYGEIGRVIQPLAESQGCAVVKNYTGHGISNCFHAAPTVYHHATKKSYGIMKPGHIFTIEPMLNLGHRTGVEILTAKGGPRHIDTTERRKLLEQQIKSREERKKRRKLDNGGASTPVSDTATETPAPENTNPQPMFLICAAAAALSACGDRDEPLDVDGLLDLITSVGGGGAKRLISTPSSDPTISHAAAATNKTVKLDFEAYEPTEEQLKKRRTEVPISSLVVCHGLFGSKQNWRSLGRAMSARFGVPVFALDLRNHGTSPHIDGLAYSDMAQDVIEFMSSHNLTNVGLIGHSMGGKVSMSVALHPDLPSGMVRNLVSVDMSAKRGPLSPEFERYIDAMIEIRDKPCRSRNEADTILQATEPDLGVRQFLLTNLTRDPPGAETWSWRIPVDLIRKNIAQIGDFPYNPPQASSQDIVGADANAPERSWHGETLFVKGSKSKYVNRRNIPTNQRYFPNSKLVHMQTGHWCQAEKPNEFVQVVEDFLTGRTHDETQQALKPRS

SEQ ID NO: 82611 - protein, 506 aa, Phaseolus vulgaris
MARKMLIDGEAELVPGVEQGMNFDFDLFIIGAGSGGVRAARFSSNYGAKVGICELPFHTISSETIGGVGGTCVIRGCVPKKILVYGASYGASYGGELEDARNYGWELSEKVDFNWKKLLQKKTDEINRLNGIYKRLLSNAGAKLFEGEGKIVGPNEVEVTQLDGTKLSYSAKHILIATGSRAQRPNIPGQELGITSDEALSIEDLPKRVVILGGGYIAVEFASIWRGMGSEVHLVFRKELLLRGFDDEMRTVVARNLEGRGINLHPRTNLTQLIRTENGIKVITDHGEELIADVVLFATGRAPNSKRLNLEAVGVELDKAGAIKVDEYSRTSIPTIWAVGDVTNRMNLTPVALMEASCFAKTVFNGQTSKPDYSNIACAVFSIPPLSVVGLSEEEAIEQTKGDLLIFTSSFNPMKNTTKGRQEKTERKTVMKLIVEAETDKVLGASMCGPDAPEIIQGIAIALKCGATKAQFDSTVGIYPSASEEFVTMRTVTRTVTGNGKPKTNL

SEQ ID NO: 82612 - protein, 181 aa, Cytophaga hutchinsonii ATCC 33406
MATSEEILEQTIKSTIRDIVDFPEPGIIFKDITPLLKDPQLCKAIVQSITDQLRPLQPDALACLDSRGFWFGLSIAMELGIPMIPIRKKGKLPYETVYEEYALEYGTNTIEMHTDAVQPGCRVAIHDDILATGGTAEATSKLIKKAKGEIIAYSFLIELDFLKGKDKLAPYCTTIQSLINY

SEQ ID NO: 82613 - protein, 421 aa, Bordetella petrii
MNNADLTRRKDAATPRGVGVMCNFYADHADNAELWDIEGRRYIDFASGIAVLNTGHRHPRLVDAIEAQLRRFTHTAYQIVPYASYIELAEQINRLVPGDFPKKTALFTTGAEAVENAVKIARSATGRSALIAFSAAFHGRTLLGMALTGKVVPYKAGFGPFPADVYHAPYPDPTHGVSVADALAGLQALFKTDVDPRRVAAIVIEPVQGEGGFNICPPEFMQTLRALCNEHGILLIADEVQTGFGRTGKMFAMEHYGVAADLTAMAKGLAGGMPLSAVCGRTEIMDAPPPGGLGGTYAGNPLAVAAALEVVQLMQADDLPARGAAQGERLQRHLEALRPGVPELAEVRGLGAMVAAEFRHPHDDSPHPDFTRQLQARALEKNLLLLSCGVDGNVIRFLFPLTIADDTMSEAMDILAQVLTA

SEQ ID NO: 82614 - protein, 550 aa, Phaseolus vulgaris
MATSFPFSPSLSLNTLSRNTLFFTKTIPFSRSSFLPRSLSKSLISISTRRCTFTVRAQSQNGADAVAPHYDFDLFTIGAGSGGVRAARFAANNGASVAICELPFSTVSSETTGGVGGTCVIRGCVPKKLLVYASKFAHEFEESNGFGWRYGSEPKHDWSSLIANKNAELQRLTGIYKNILNNAGVKLIEGHGKIIDSHTVDVNGKQYSAKHILVAVGGRPFIPDIPGKEYAIDSDIALDLPSKPGKIAIVGGGYIALEFAGIFNGLQSEVHVFIRQKKVLRGFDEEIRDFITEQMSLRGIEFHNEESPQAITKSADGTFSLKTNKGTVDGFSHIMFATGRRPNTKNLGLETAGVKLAKDGAIEVDEYSQTSVPSIWAVGDVTNRINLTPVALMEGGALVKTLFQDNPTKPDYRAVPSAVFSQPPIGQVGLTEEQAVQQYGDIDIFTANFRPLKATLSGLPDRAFMKLLVSAKTNQVVGLHMCGEGAPEIIQGFAIAIKAGLTKAEFDATVGIHPSAAEEFVTMRTPTRKIRKSQSSEGKSGSDVKAAAGV

SEQ ID NO: 82615 - protein, 545 aa, Staphylococcus aureus subsp. aureus Mu50
MNKDKQLHNDKINLSQLVLLGLGSLIGSGWLFGAWEASSIAGPVAIISWVLGFLVIGTIAYNYIEIGTMFPQSGGMSNYAQYTHGSLLGFIAAWANWVSLVTIIPIEAVSAVQYMSSWPWHWAKPMRYLMENGSISTYGLLAVYLIIVIFSLLNYWSVKLLTSFTSLISVFKLGVPMLTIIMLMLSGFDTSNYGHSASTFMPYGSAPIFAATTASGIIFSFNSFQTIINMGSEIKNPEKNIARGIAISLSISAVLYIILQSTFITSMPQSMLQHSGWNGINFNSPFADLAILLGINWLAILLYIEAFVSPFGTGVSFVAVTGRVLRAMEKNGHIPKFLGKMNEKYHIPRVAIIFNAIISMIMVTLFRDWGTLAAVISTATLVAYLTGPTTVIALRKMGPTMTRPFRAKILKVMAPLSFVLASLAIYWAMWPTTAEVILIIILGLPIYFFYEYRMNWRNTKKQIGGSLWIIVYLIVLSILSFIGSKEFKGLNMIHYPFDFIVIIVVALIFYYIGTTSSFESVYFRRATRINTKMRESLNNESKSSH

SEQ ID NO: 82616 - protein, 548 aa, Lactococcus lactis subsp. lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 82617 - protein, 109 aa, Glycine max
MASSSASPRPSAAAEHSKRILGFMAHAKQRKDSFIQFFAMTGILLLSMRSLSQKYKIHGLQEDIHALRVEHDSLTDRINNIKNDLLREASHDPTGLFASRLRHLFAEQH

SEQ ID NO: 82618 - protein, 343 aa, Saccharum sp.
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEETTFVDPKLRGKYCVCFDPLDGSSNIDCGVSIGTIFGIYMIKDKDNVTLSDVLQPGKDMLAAGYCMYGSSCTLVLSTGTGVNGFTLDPSLGEFILTHPDIKIPKKGKIYSVNEGNAKNWDVPVAKFVEKCKYPKDGSPPKSLRYIGSMVADVHRTLLYGGVFLYPADQKSPNGKLRVLYEVFPMSFLMEQAGGQSFTGKERALDLVPTKIHERSPIFLGSYDDVEEIKALYAEQAKSSSA

SEQ ID NO: 82619 - protein, 469 aa, Candidatus Protochlamydia amoebophila UWE25
MMEIKKFDVAVLGGGPGGYPAAIRAAQRGKSVALIEAKELGGTCLNRGCIPSKALIAGAEVVDRIHEAKEFGIHVGEVNIDYAQLAFHKDRVIERMRKGLEGLMATNKITVFKGFGQFISPREIKIKGQDNTSITADQIIIATGSEPRNISAFPFDYERIHDSTSLLAMKTLPEKLIIVGGGVIGCEFASLYATLGVHVTILELLPRLISSEAIEVSQALTKAFIKRGIQVETGVKVQKIEQVEMGIQVQVEEGKHYVADCCLVAVGRSLNTKNIGLDKAGILVQENGMIAVNDKMQTNVDGIYAVGDIASKWWLAHVASHQGLIAADQICGKSSRMYYHAIPSVIFTHPEIATVGLSLEEATKRGYKAKLASFPFQALGKSQAALQAEGFAQIVVEEKSGQILGAQVVGYEASVMIAEMTLAIANELTVECVAETIHAHPTLPEAWLESALLGEGLPLHLPPKTQKKG

SEQ ID NO: 82620 - protein, 143 aa, Pseudomonas aeruginosa
MALQRTLSIIKPDAVSKNVIGEILTRFEKAGLRVVAAKMVQLSEREAGGFYAEHKARPFFKDLVSFMTSGPVVVQVLEGEDAIAKNRELMGATDPKKADAGTIRADFAVSIDENAVHGSDSEASAAREIVYFFADTEVCERIR

SEQ ID NO: 82621 - protein, 525 aa, Glycine max
MDGYDGTVRLGAINLKHDRAADFDSATAAPDVSVSSPVTRQKAAAAKQFIENHYKNYLQGLQDRKDRRRALQRKVQESQVSAEEQEEMMRNLERRETEYMRLQRRKIGIDDFEQLTVIGKGAFGEVRLCRAKDTGEIFAMKKLKKSEMLSRGQVEHVRSERNLLAEVDSRCIVKLHYSFQDSDFLYLIMEYLPGGDIMTLLMREDILSEDVARFYIAESILAIHSIHQHNYVHRDIKPDNLILDKNGHLKLSDFGLCKPLDDKYSSILLENDDLTSQESTSETEGYSVSPWLMPKEQLQQWKRNRRALAYSTVGTLDYMAPEVLLKKGYGIECDWWSLGAIMYEMLIGYPPFCSDDPRMACRKIVNWKTCLKFPDEPKISAEAKDLICRLLCDVDSRLGTRGIEEIKAHPWFKGVQWDMLYESEAAYKPTVTGDLDTQNFEKFPEVDGPPSVTATVGPWRKMLTSKDNNFIGYTFKKSDILKSLESSDADIRVNGSSKTPSLITLLGRIDLQDTIIPESEQKPEA

SEQ ID NO: 82622 - protein, 310 aa, Synechococcus sp. WH 5701
MSNGELPAALITAFAERPLQGNGAAVVALEQPASAPWMQAVAAQLRQSETAFLLPLSRLGSGDDAADEWALRWFTPRCEVPLCGHATLASALALGHWGLLTPGASTRLHSRSGPLLVSLGQTGAGRAQLVLPSGGLEPSPLPSELAPSLGGTPLRSWRSALGYWVALLPPEFPLAGLDGDALAQELPAELRQGLVLMQPLVASGHCPTVQGLPADYQLRFLAPGLGISEDPVTGSAHALVAPWWCDQLGRERVVGWQPSPQAGGMVCERLSSGMIRLSGSGQLLWDGRLSAGVDAGQDGDWSCCLLPGPG

SEQ ID NO: 82623 - protein, 477 aa, Burkholderia vietnamiensis G4
MSTDDKIQTYEQEDLKRDLKNRHIQMIAIGGAIGTGLFYGSSWAIRTAGPAILLVYLVAAIAIYFVMRALGEMAVEEPVSGSYISYSNRYIHRFAGFLNGWNAFIFLLATSAADLNALGNYMHFWFPGIPIWVTAGAAVSLMFVVNIIGVKIYGEAEFWFSLVKVVAIVAMIVFGVGMVLFGIGNNGVPIGYHNLIDHGGFFPKGAGGTFLAIVMVAFAFGGVENLGLAAGEAQDVKTTMPKAVNATFWRLLIFYVGAIAVLLLVFPWTSLTSKGSPFVEVFTKIGIPAAAGIMNLVVIMAVLSAVNASVFTNSRTFYNLSLQKNAPAFLGVTNSRKVPHRAILMVFATMFAGVMLNYLMPEQAFELFSSVTVFALVCAWGSIVISHLRFRKNKIRKGEDGQLGYKMPFYPYSNYIALIFLAAVLIGIAILPDMRMSLVVSAVWVLVVFIAYTFYVRKESTRESIASETGDAKDLLA

SEQ ID NO: 82624 - protein, 323 aa, Rhodobacter capsulatus
MSYAMVVTAPGGVENFRLLERDVPQPGPGEVLLRQTAIGLNYIDVYFRTGLYPWGVPADLITGGEAAGVIEAVGPGVDLPVGQRVAYTVRNGAYASHRVIAAEDLVPIPEGISDEIAAAVMLKGLTVHYLIHHSYPAAAGDCVLVHAAAGGVGLLAGQWLKHKGVRALGTAGTAEKCALALAHGYDAVIDYKTRDFVAETMRLTEGKGVKAVYDSVGAVTVKKSVEVLETFGTLVSFGQSSGPALDFRITDLSRGSLRLTRPTLFHHTAQPGWLRKASAEMFDLILKGTIRVEIGQRYDLKDVAAAHTALESRKTTGCTILTP

SEQ ID NO: 82625 - protein, 316 aa, Xanthomonas axonopodis pv. citri str. 306
MSSVVVVGSFNVDHVWRCDALPVPGATIAGRYSTGPGGKGFNQAVAAARAGARTHFLCALGDDAGGALARSLAAHDGFALIAEPSNEPTGTGGIYVDGHGRNTIVIGAGANAVLSPAFIENQRPLVAAAKVLLAQLESPAETVESALALAHECGVLTVLNAAPANAPTSIGLLKLSDVLTPNETEFAALLGRHVGERINADDVAALDGNTLHSLCRKLLPGGTVVVTLGAVGAFISHAEEQLRGDTQAHYRVGAESAQTIDTTGAGDAFNGALVASLAQLPAASFATHVRFATRYAARSTEVEGAAVSMPRLRADD

SEQ ID NO: 82626 - protein, 163 aa, Zea mays
  misc_feature (10)..(10): Xaa can be any naturally occurring amino acid
ARKLSLTRAXFYIVMQCLGAICGAGVVKGFQPNPYQTLGGGANTVAHGYTKGSGLGAEIIGTFVLVYTVFSATDAKRSARDSHVPILAPLPIGFAVFLVHLATIPITGTGINPARSLGAAIIYNKDHAWDDPWIFWVGPFIGAALAALYHQLVIRAIPFKSRS

SEQ ID NO: 82627 - protein, 246 aa, Kineococcus radiotolerans SRS30216
MTIHDKIIAITGASSGIGEATARHLASRGAAVVLGARRTDRLEQLVEEITAAGGRAAAVRVDVTDPDDLHSLVDRAVEGFGRLDVLVGNAGVSRISPMTDVDVEGWSAMVDVNVKGVLNGIAAALPVFRAQGSGHLVTVVSTSGLKIVPTQAVYAGTKNAVRTIVEGLRQESTDGVLRTTSISPGYVRTEFIDSALDDPRLREQVKQTMAELGIDPTAVARAIAFAIDQPDDVEIGDLTIRPTRQG

SEQ ID NO: 82628 - protein, 140 aa, Triticum aestivum
MLKFLSRVVVEYNPLDPRKAAAVELLAQCNGRKAKDSNPTCSVELRRLPSPAAADDPKAQPPPRVLVTYLNGAEEAFVAADGATAQGMRDQILARGRLLETEQLFREAGEKWPVVIPEEELGMSFPGIKPKKAEEKPQAS

SEQ ID NO: 82629 - protein, 388 aa, Agrobacterium tumefaciens str. C58
MSILNSLSARSLAAPESGIVEVVNYARGRDNLLPLWVGEGDLPSPDFINQAAIDGLNNGETFYTWQRGIPELRQALSHYYERHFAASLPPEHFYATGSGMQAIVLAVQALTSPGDEMVYLSPTWPNIVAAIGVAGAKAVPVGIDFRDGRWDLDINRLESAITGKTKALFINTPSNPTGWTATRDNLRDVLALARKHDLWIVADEIYALYHYAGSRAPSFLDVMEPDDKIVFANSFSKNWSMTGWRVGWLVAPPAIGQVIENLIQYSTSGVAQFMQRGAVAALDHGDGFIRENYERALTSRDILCDALIATNRVETLKPDGALYAFLKIDGVTDSRATALDIVDKTGVGLAPGTAFGPGGELFLRACFLRNPRQIEDAADRLASYILGR

SEQ ID NO: 82630 - protein, 456 aa, Vibrio angustum S14
MSMTAEKNLYLRCEGDTNTTEARTQWYRNLNSPQTEAMLEQDSEYFLHQSMSTPCMNALAAANGIYIEDISGKRYMDFHGNNVHQLGYGHPKVLERIQQQLIELPFAPRRFTHQAAIDCAKKLTEIAGGELDRVLFAPGGTSVVGMALKLARIVTGNAKVISLWDSFHGASLDAISVGGEACFRQGMGPLMAGVERIPPPITYRGAFPREDNSDLHYADYLEYVIEKEGGVGAFIAEGLRNTDVQVPSKAYWQRVREICDKHNVLLIIDDIPNGMGRTGHWFSYQAFGIEPDILCIGKGLGGGVVPFAALITKDKYNQAADISLGHYTHEKSPIGCAAALATIDVIESEKLLDKVKQDQDFVSERLSQMQKSYPVIGDIRGLGLLWGIELVTDRLTKTRAHDAAEQVLYRCLELGLSFKVSQGNVLQLSPPLIIKREDLARALDIVEQAISEIIIN

SEQ ID NO: 82631 - protein, 216 aa, Vibrio vulnificus YJ016
MQLMSEKSQCVIVGIAGASASGKSLIASTIYNELRAKVGDHQIGVITEDCYYNDQSHLSMEERVKTNYDHPNALDHDLLCEHLEKLMKGESVEVPEYSYTEHTRTENTTTMTPKKVIILEGILLLTDPRLRDLMHATVFMDTPLDICLLRRVKRDVEERGRTMESVLKQYQKTVRPMFMQFIEPSKQYADIIVPRGGKNRIAIDVLKAHIAKLLKA

SEQ ID NO: 82632 - protein, 431 aa, Oryza sativa Indica Group
MGRRIFHCLESHSPRHAVQCTGEDQEKYYDELVSYLEEELGLKMHKARRFDLDCTNHLVKHHPMLPDRNLSAQAQIDSDTINESPQALPTNISSQIVSCSVDEAPQALPTSSSPISNNTEGLSLQALPTSSESAAGVTIDDLHSFCSQEFITDPVNRLSDRIDSEYVLLVNPAMPHLLGNSSDATDLDCTNQLVENHPKLPDQNLSAQAQIDGDTINEAPQALPTSVGSQIGGCSVDETLQALPASSSLISSNTENLSPQALPTSSESAAGVTIDDLRSLCSQEFFTDPVVVHAFNSQDPHLLGEGTHWSLLVFDRNLGGRPCLAHHDSSPGDANLRAARRLAASLLPYLPPETKCTKAPTPKQNNGTECALYMIKCAEVICGWWRNHAAGGSESHWLGVVARGVTMDSVDNLRAQLIHDIGQLLNGSSSS

SEQ ID NO: 82633 - protein, 339 aa, Silicibacter pomeroyi DSS-3
MPSLTEPKLIAGNANLPLARSIARRMSLYRGVDQGLVDARVERFNDGEIFVEVFENVRGEDMFIIQPTSNPANDNLMELLIIADALRRSSASRITAVIPYFGYARQDRRTKARTPISAKLVANMLTGAGIERILTMDLHAAQIQGFFDIPVDNLYASPIFALDVQTQFKQQMSDLMVVSPDVGGVARARELAKRINAPLSIVDKRREKPGEVAEMTVIGDVTDKICLIVDDICDTAGTLCKAAQVLLDNGAREVHSYISHGVMSGPAVERVSNSVMKSLVITDSIQPTPEILAAPNIRVVPTAPIFTQAILNIWNGTSVSSLFEDKTLRPIYESLYHMD

SEQ ID NO: 82634 - protein, 638 aa, Clostridium thermocellum ATCC 27405
MIVLGCNNISLSFGVTTILKDISFSINDTDKVGVVGVNGAGKSTLFKIIAGEYIPDSGEIYTAKNSKLGYLAQNSGLDSSNTILEEVLAVFSHFTEMESRIKDLEKSMSTEKDENQLNSIMKEYSRLTDEYARLGGFEYQSRAKGVLKGLGFEEDQFSLNVMNLSGGQKTRLALARLLLTEPDILLLDEPTNHLDIKAVEWLEEFLSNYKKCLMVISHDRYFLDKITNKTLEIENCECKLYNGNYSRYLNQKAVDREIQQRHYEQQQKEIARMEAFIEQQRRWNRERNIIAAESRLKAIERMEKIEAPKNLPEKIRIKFKSGFASGNDVLFVEGLGKSYPGKPLFKNVKFNIRKKERVFILGPNGCGKSTLLKILTGKIDDYEGSFRYGHNVNPGYYDQEQEGLNPNNTVIDEVWSADEKLTQTEIRNVLAMFLFKGEDVLKPVSTLSGGEKSRISLIKLMLSEANFLIMDEPTNHLDINSREVLESALADYDGTLLIVSHDRYFIDKLATRIIELGETSCIDFKGNYTEFHEYKSKLNSGSDNQSKNVKMTASKMEHIATKEEKARKRKLEKQLVETEKEITDTEARIKEIENQMTNEEVVSDHVKLVELHNELNELNLKLEQLYELWDNLMSENSR

SEQ ID NO: 82635 - protein, 474 aa, Silicibacter pomeroyi DSS-3
MANAKGKVTQIIGAVVDVQFDDALPEILNALETENNGKRLVLEVAQHLGENTVRTIAMDATEGLVRGAVVTDTGGPISVPVGAATLGRILNVIGEPVDEKGPVNATETRAIHQPAPSFDEQSTSSDILVTGIKVIDLLAPYSKGGKIGLFGGAGVGKTVLIMELINNIAKVHSGYSVFAGVGERTREGNDLYHEMIESNVIKLENLEESQVALVYGQMNEPPGARARVALTGLTLAEQFRDQSGTDVLFFVDNIFRFTQAGSEVSALLGRIPSAVGYQPTLATDMGAMQERITSTKAGSITSIQAVYVPADDLTDPAPATTFAHLDATTVLSRAISELGIYPAVDPLDSSSRILDPQVVGEEHYQVARDVQGILQRYKSLQDIIAILGMDELSEEDKLTVARARKIQRFLSQPFDVAKVFTGSDGVQVPLEDTISSFKAVVAGEYDHLPEGAFYMVGGIDEVIAKAERMAAEAA

SEQ ID NO: 82636 - protein, 466 aa, Colwellia psychrerythraea 34H
MSDTPTKFTDLGLSEALLKAVRDKGYETPSPIQAQAIPAVISGRDVMAAAQTGTGKTAGFTLPLLQRLSSSKGNKVSSNNVRALILTPTRELAAQISESIEVYGKYLNLHSMVVFGGVKINPQIARLRQGVDVLVATPGRLLDLYNQRAVKFSQLEVFILDEADRMLDMGFIRDIKKLMTALPKDRQNLLFSATFSPEIRALAKGMVNNPLEISVDAENSTAEKVTQWLTAVDKKRKPAVLTHLIKENNWQQVLVFTKTKHGANKLTKHLEAEGLTAAAIHGNKSQGARTKALAAFKDGSVKILVATDIAARGIDIDLLPQVVNFDLPNVPEDYVHRIGRTARAGNTGQALSLVCADELDLLWGIEHVIQQHIERKVIEKFIPANELGESRVIKPLKQGKPPKSAKPHGAGKGRVEHKDGQRSGRNANGNNAGGNKAKPGNDSSRRKKPEYDGTGPKPRRAIRPTK

SEQ ID NO: 82637 - protein, 519 aa, Vibrio vulnificus YJ016
MFEFPQFSKHSVKNDVLSGLTVALALVPEAVAFAFVAGVDPMVGLYAAFIVGLVTSIFGGRPGMISGATGAMAVVMVSLVSSHGVQYLFAAIMLAGILQIAAGLFKLGKFIRIVPHPVMIGFVNGLAIVIFLAQLGQFKMADAAGGLTWLPQDQMLLMLGLVALTMAIIHFLPKLTTAVPSSLVAIVTVTGLVIGFDLETRTVVDFLRTMSGDEGATLAGSLPSFALPMVPFDLETLQIIFPYAVILAAIGLIESLLTLTVLDEMTNTRGQSNRECIGQGMANMTCSVFGAMGGCAMIGQSMINVNSGGRGRLSGIVAAVALLMFILFAAALIEMIPLAALVGVMFMVVIGTFEWATFKLARRVPKQDFFVIVLVTVVTVMTDLAVAVAVGVIASALMFAWNHAKHIYADTRINEEGSKEYKIHGPIFFGSTANFLELFNAQQDPSDVIVDFADSRVTDHSAIEAIETLAERYSAVGKTLHLRHLSPDCRKLLDKAGSLVEINVKEDPSYKVATDVLAG

SEQ ID NO: 82638 - protein, 433 aa, Brassica napus
QAVFHDLLGQGIFNSDGDTWLFQRKTAALEFTTRTLRQAMARWVNRAIKLRLPILETARLDSEPIDLQDLLLRLTFDNICGLTFGKDPRTCAPGLPVNTFSVAFDRATEASLQRFILPEILWKFKRLAGLGLEVSLTRSLVQVDNYLSEIIKTRKQDLTSKPNNDGAQHDDLLSRFIKKKETYSDEVLQRVALNFVLAGRDTSSVALSWFFWLITQNPTVEDKILREICAVLIETRGDDVALWIDEPLACEELDRLVYLKAALSETLRLYPSVPEDSKRAVKDDVLPDGTFVPAGSSVTYSIYSAGRMRSTWGDDCLEFKPERWISRSDGGRFINHDPFKFVAFNAGPRICLGKDLAYLQMKSIAAAVLLRHRLTVVTGHKVEQKMSLTLFMKYGLLVNVRNRDLTAIAADLREKTDCESNAVNDGVGNGVRR

SEQ ID NO: 82639 - protein, 338 aa, Hyphomonas neptunium ATCC 15444
MQHRRLGKSAIYVSDICMGTMTFGTQTDEKEAFRILDASLDAGINFFDTAENYPVPPDLKYGGLTEEIFGRWMKTKDRDSIILATKVCGPSHGWIKGSQRAGMTALDRHNIRRAVEASLTRLQTDYIDLYQTHWPDHGTEFDETMEALDDLVREGYVRIVGCSNEDAWGLMKSIETSNRLGTVRYQTIQNNFSLNNRRFEDALAKICDREGVSLIPYSPLGGGVLSGKYQNGAFPEGARFSAYANKGGRHTAMAQRFVNEKSLAATARYMEIAKEAGMSPVTLATAWSKQHSFVASTIVGVSKFDQLEEILAAGDLVLSDDVMKACEKVTREILYPMG

SEQ ID NO: 82640 - protein, 322 aa, Capsicum annuum
MSISNNSFAAVAAIFSLVLLCSMQCHAQLSSTFYDRACPNALNTIRKSVRQAVSAERRMAASLIRLHFHDCFVQGCDASILLDETPTIVSEKTALPNLGSVRGYGIIEDAKRELEKTCPGIVSCADILAVAARDASTLVGGPSWTVKLGRRDSTTASHTLAETDLPGPFDPLTRLISGFAKKGLSTRDMVALSGSHSIGQAQCFLFRDRIYSNGTDIDAGFASTRRRRCPQEDQNGNLAPLDLVTPNQLDNNYFKNLRQRKGLLQSDQVLLSGGSTDDIVLEYSNSPRAFASDFAAAMIRMGDISPLTGSNGIIRTVCGAIN

SEQ ID NO: 82641 - protein, 292 aa, Rhodobacter capsulatus
MSKKYPIISVVGSSGAGTSTVKATFDQIFRREGVKAVSIEGDAFHRFNRADMKAELERRYAAGDATFSHFSYEANALEDLERVFREYGETGKGRTRRYVHDANESAKYGVEPGHFTDWAPFEEDTDLLFYEGLHGCVTNDQVNIAAHADLKIGVVPVINLEWIQKIHRDRAQRGYTTEAVTDVILRRMHAYVHCIVPQFSQTDINFQRVPVVDTSNPFITRWIPTPDESLIVIRFRNPRGIDFPYLTSMIHGSWMSRANSIVIPGNKQDLAMQLILTPLIERLVREGRRARA

SEQ ID NO: 82642 - protein, 226 aa, Candidatus Protochlamydia amoebophila UWE25
MVKLILMRHGQSQWNLANLFTGWVDIPLSFKGIEEAIEAGKQIKNYPIDLIFTSSLIRAQMTAMLAMSVHTSGKVPVILHTGEGRLEEWASIYSSESQSQTIPVIRAWELNERMYGELQGINKEEMAKKYGAEQVHIWRRSFDVPPPNGESLQMTAARTIPYFENTIVPHLKEKKNIFIAAHGNSLRSIIMKLDGLTTDQVVKLELATGVPVIYDFNHDEYIKQQK

SEQ ID NO: 82643 - protein, 298 aa, Cytophaga hutchinsonii ATCC 33406
MQNTHKYILIIGSGTMGSGIAHSFAQFGFQVFLCDSNAAALNKAMLQISTNLERQISKGIIPDSEKETIISRITPITDFKEAAKTVSLVVEAVPELLEIKADLFKELDMHCPPETILASNTSSISITTLASYTSRPEKVIGMHFMNPVPVMQLVEIINGLLTSSETTRRIEEISTQLNKIPVQTADYPGFISNRILMPMINEAIYCVQERVAGIAEIDQIMKLGMAHPMGPLQLADYIGLDVCVNILNVLYKGFGNPKYSPCPLLVNMVHAGLLGSKTKKGFYDWTNPKNLVSNDIIL

SEQ ID NO: 82644 - protein, 369 aa, Vibrio parahaemolyticus RIMD 2210633
MPISTPQEIIDDIRAGKMVILMDDEDRENEGDLIMAAEHITPEAINFMATYGRGLICLTMTKARCENLGLPPMVQDNNAQYTTNFTVSIEAAEGVTTGISAADRARTVQAAVAPNAKAADLVQPGHIFPLAAQDGGVLTRAGHTEAGCDLARLAGLEPASVIVEILNDDGTMARRPDLEIFAEKHGLKLGTIADLIEYRNNTETTIERVAECKLPTEHGEFTLVTYKDTIDSQVHYAMCKGDLAGEAPLVRVHLQDVFTDVLRSDRNAERSWTLDKAMKRIGEEGGVLVVLGNEESTELLIHRVKMFEAQDKGEAPTLAKKQGTSRRVGVGSQILADLGVHDMRLLSSTNKKYHALGGFGLNVVEYVCE

SEQ ID NO: 82645 - protein, 156 aa, Vibrio parahaemolyticus RIMD 2210633
MKVIEGGFPAPNAKIAIVISRFNSFINESLLSGAIDTLKRHGQVSEDNITVVRCPGAVELPLVAQRVAKTGKYDAIVSLGTVIRGGTPHFDYVCSECNKGLAQVSLEYSLPVAFGVLTVDTIDQAIERAGTKAGNKGAEAALSALEMINVLSEIDS

SEQ ID NO: 82646 - protein, 316 aa, Kineococcus radiotolerans SRS30216
MPRTPQLSLPDLSGRRALVTGASDGIGFGIARRLAGAGAEVLLPVRNRTKGEAALARIREQHPTAKVTLHDLDLSSLSSVAALGDELRAEGSPIHLLINNAGVMTPPQRQTTVDGLELQLGTNHLGHVALVAHLLPLLRAGRARVTSQISVAARSGAVHWEDLNWEDSYHGMRAYSSSKIALGLFGLELDRRSRAEGWGITSNLSHPGVAPTSLLAARPELQRERNTPQIAVIRRLSRAGILVGTVDSAQLPALHAATAPQAQGGRLYGPTGPGNLGGGPGEQPLYRPLRDQTEADRVWTVSQALAGVSFTTTARI

SEQ ID NO: 82647 - protein, 411 aa, Colwellia psychrerythraea 34H
MKAITKSSKLHNVCYDIRGQVAVEAKRLEDEGHKILKLNIGNPAPFGFEAPDDILKDVIHNLPNSQGYSESQGIYSARVAVMQYFQQQGIKDVMVDDIFIGNGVSELIVMAMQALLDNGDEVLIPAPDYPLWTAAVSLSGGKPVHYRCDEQNHWFPDLEDMESKITKKTKAIVLINPNNPTGAVYSEEVLHAIIALARKHGLIIYSDEIYDKILYDEAKHVPTAALATDVFIITLGGLSKNYRIAGFRAGWMVISGPKLHAEDYIKGIKLLSSMRMCANVPSQHAIQTALGGYQSINELIRDDGRLIKQRNVAYKMINDIDGLSCNPAMGALYLFVKVDNKKFNITNDERMVLDLLKQEKILLVHGRAFNVKEHNYFRLVFLPHVDELIPALEKLKSFFASYKQVQPSKSA

SEQ ID NO: 82648 - protein, 461 aa, Vibrio angustum S14
MKHPNVLQITLVVALGGLLFGYDTAVISGATESLQIFFNLNPAELGFAAASALIGCVIGSIAAGYTSTKYGRRGALLIAALLFFISALGSAVPDQYWTFIFYRIIGGIGVGIASMVSPMYIAEIAPRQKRGALVSCNQFAIIFGMLVVYFVNYGIALMGSESWLNEMGWRYMFGSEMIPAGLFFFLLFSVPETPRWLAMRGRDEQAKELLSKISKGKDFDSQWKEIKDSLVEVSTASITSRKILPILVIGIMLSVLQQVTGINVFLYYAPVILKSFSSSSTDIALLQTILVGAVNLTFTVIAIITVDKYGRKPLMMLGAGLMAISMIAIGTAAYLNAIGGYLLVFVLTYIAAFALSLGPVTWVLLSEIFPNNVRSKALSIAVFAQWVANYAVSQTFPMMNDQNSWLFKEFNGGFPFWFYGVMGLVTIYFVHRFVPETKGKSLEELEELWEKPDELETVTHN

SEQ ID NO: 82649 - protein, 188 aa, Picrophilus torridus
MKIYIIDNGGQWTHREWRTVRDLGVDSTIVPNTVDADVLADADGIILSGGPASIESEISKLGNIKEYMHRYNYPVLGICVGAQFIAIDSGGRVSKALHAEYGKKIVNFTSKDGIFYNIPDSINAWENHNDEIKSISDDYIICAYSDTCRVQAFYHKNRDIFGVQFHPEVNNTEHGTTIFKNFIEKCRR

SEQ ID NO: 82650 - protein, 183 aa, Salmonella typhimurium LT2
MTATAQQLEFLKNSIKSIQDYPKPGILFRDVTSLLEDPKAYALSIELLVERYKNAGITKVVGTEARGFLFGAPVALGLGVGFVPVRKPRKLPRETIAETYELEYGTDQLEIHVDAIKPGDNVLVVDDLLATGGTIEATVKLIRRLGGKVTDAAFIINLFDLGGEQRLEKQGITCYSLVPFPGH

SEQ ID NO: 82651 - protein, 642 aa, Salmonella typhimurium LT2
MSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPAHVKFLLATTDPQKLPVTILSRCLQFHLKALDVEQIRHQLEHILNEEHIAHEPRALQLLSRAADGSLRDALSLTDQAIASGDGQVSTQAVSAMLGTLDDDQALSLVEAVVDANGERVMSLINEAAARGIEWEALLVEMLSLLHRIAMVQLSPAALGSDMAAIEQRMRELARTVPPGDLQLYYQTLLIGRKELPWAPDRRMGVEMTLLRALAFHPRMPLPEPETPRQSFAPVAPTAVMTPPQLQQPSAPAPQTSPAPLPASTSQVLAARNQLQRAQGVTKTKKSEPAAASRARPVNNSALERLASVSERVQARPAPSALETAPVKKEAYRWKATTPVVQTKEVVATPKALKKALEHEKTPELAAKLAAEAIERDPWAAQVSQLSLPKLVEQVALNAWKEQNGNAVCLHLRSTQRHLNSSGAQQKLAQALSDLTGTTVELTIVEDDNPAVRTPLEWRQAIYEEKLAQARESIIADNNIQTLRRFFDAELDEESIRPI

SEQ ID NO: 82652 - protein, 651 aa, Pseudomonas syringae pv. tomato str. DC3000
MIHLFRTKLVDSAAIMIRLQSLTLQRGPQRLLEDAELTLHAGHKAGLIGANGAGKSSLFALLRAELTPDAGDCLLPADWRIAHMRQEVDTLERLAVDYVLDGDERLREVQSSLAEAEAAQDGAAQARLHSELDSADGYTADARARKLLAGLGFTNEQMERQVGSFSGGWRMRLNLAQALMCPSDLLLLDEPTNHLDLDAILWLEDWLKSYPGTLLLISHDRDFLDAVVDHIAHVEQRKITLYRGGYSAFERARAERLAQQQQAYEKQQVQRAHMEKYIARFKAQATKARQAQSRIKALERMEELSAAHVDSPFNFVFRESDKISSPLLDLSDARLGYGDKTVLEKVKLQLTPGARIGLLGPNGAGKSTLIKNLAGELEPQSGRLVRGENLTVGYFAQHQLDSLDAKATPLLHLQRLAPTEREQTLRDFLGGFDFRGARLDEPVLNFSGGEKARLALALIAWEKPNLLLLDEPTNHLDLEMRLALTMALQEFGGAVLVVSHDRHLLKSTTDDFLLVADGRVQEFDGDLDDYTRWLADYRLRNAPVSNTPVNADKTDKKAQRQQAAALRQQLAPHKREADKLERDLGLVNEKLAKVEEALADSTNYEAANKDKLRDLLAEQAKLKVRESELEDAWMQALELLESMQAELEALS

SEQ ID NO: 82653 - protein, 513 aa, Photobacterium profundum
MSAKKPLALVILDGWGYREDNSDNAIANANTPVMDSLIANEANTLISASGFDVGLPDGQMGNSEVGHTNIGAGRVVYQDLTRITKSIADGDFFENEALTTAMDKAINAGKAVHIMGLMSPGGVHSHEDHIAAAIEMAAKRGAEKIYLHCFLDGRDTPPRSAQNSLERFDALFAELGKGRTASLVGRYYAMDRDNNWDRVEVAYNLLSAAKADFTVDSAVAGLTDAYSRDENDEFVKATEIRAEGQESAAMVDGDTVIFMNYRADRAREITRAFEADFTSFVRTQTPALAEFVMLTRYAANIKLPAAFPPATLKNTLGEWLSKKGKKQLRISETEKYAHVTFFFNGGVEDEFDGETRSLVASPKVATYDLQPEMSAPELTEKLVAAIKGGEFDTIICNYPNGDMVGHTGVYDAAVKACEALDGCIGQVVEAIKSVGGQLLITADHGNAEMMINPETGGVHTAHTNLPVPLIYVGDKSLTLKDGGKLSDLAPTMLSLSDIEIPAEMTGQVLFDLK

SEQ ID NO: 82654 - protein, 105 aa, Arabidopsis thaliana
  misc_feature (9)..(9): Xaa can be any naturally occurring amino acid
  misc_feature (15)..(15): Xaa can be any naturally occurring amino acid
  misc_feature (17)..(20): Xaa can be any naturally occurring amino acid
  misc_feature (27)..(27): Xaa can be any naturally occurring amino acid
  misc_feature (31)..(32): Xaa can be any naturally occurring amino acid
  misc_feature (41)..(41): Xaa can be any naturally occurring amino acid
  misc_feature (44)..(45): Xaa can be any naturally occurring amino acid
  misc_feature (48)..(48): Xaa can be any naturally occurring amino acid
  misc_feature (51)..(52): Xaa can be any naturally occurring amino acid
  misc_feature (55)..(57): Xaa can be any naturally occurring amino acid
  misc_feature (71)..(71): Xaa can be any naturally occurring amino acid
  misc_feature (77)..(77): Xaa can be any naturally occurring amino acid
  misc_feature (84)..(84): Xaa can be any naturally occurring amino acid
  misc_feature (86)..(86): Xaa can be any naturally occurring amino acid
  misc_feature (90)..(90): Xaa can be any naturally occurring amino acid
  misc_feature (97)..(97): Xaa can be any naturally occurring amino acid
  misc_feature (101)..(101): Xaa can be any naturally occurring amino acid
MPKHYRPAXKKKEGXAXXXXTRTKAVXYLQXXLAIFRKLCXLKXXFPXQPXXKVXXXHKTYYHTKDIAFLXHDPLIXKFREIKXHXARKXKKAVAKXKTGXLADK

SEQ ID NO: 82655 - protein, 709 aa, Ustilago maydis 521
MMPNLARSDNDDRTNSVLSTSSHTHVDNNDALASSPHSKMTAWPVKHAEPVAESKAHPPSTAPASQSVADPLPVPSTAQVGRRSIGRQQRADRPPPPKCMLSCIESIESCTQNVVRFNERMELNRAQAEAQRAEKRDSPIASKAIIPLAFVILSWVFLAYVWRLCSRLIQQNPQGAVLGSRSEGVGLLVGFVILWLMTMWSYVVVISKGPGLVKDYVSESDPPSAAAQGQWWSPASAAPQPQQYQEGAAQPMPISGRMHQSSDIAAMQASSSADGHAIASASSTLSFPYPSFNADLQRFGGDRASSDSMRVLPGSVEPKHTVDSADFTHSYDEYRRTIAEEDAVAAADTLAADVEAQLDAEMRSTMPSAEASDVATDAQLPDVVGPLAAAAIAGGQGVRQGAEMLNDSACGAPRTDDTNAAASGWSVPRRTLPNDPPPLSASSQYCHRCRRVKPPRAHHCRRCGTCVLKMDHHCPWVGGCVGAHNQRFFFIFVLWVTLLELYTLVTTAVCFHRGVQSLQVGSAWRLDGFLISLLPICAVFLMFTGALLGTHVWLMGRNMTTIEHVAVSRMQARERVLVDRWVGMQKQAGLAGFKMKRQLVREWDAEWGALTTEANRWWLGGSNEVDFTQHSNDATSQGAQEKPCATSSRNRKQQGAFQTNIQQSLGASLLFWILPLGDHPNDGLVFPMNPRFGQFGVWRKRQDWPVALQ

SEQ ID NO: 82656 - protein, 235 aa, Triticum aestivum
GNSSLWNQYFQESEILEQIDRDVKRTHPDKSFFSAKSNQESLRRILIIFSRLYPSVRYVQGLNEVLAPLFYVLKNDLDTSNSTSAEADTFFCFVELISGFKNNYCKHLDNSRVGIRATLSKLSQLLKKHDEELWRHMEVITKVYPQYYAFRWITLLLTMEFSFNVCIHIWDAMLGDPEGPPDTLLRICCAMLILVRKRLLVGDFTANIQLLQHYPQTNIDHLLHIANRLRGTMPS

SEQ ID NO: 82657 - protein, 208 aa, Triticum aestivum
NKFVQKSRPVPVRNSRDIVDPRVRKTYDLNFKEENNDGSQKISGDSLKNVYKSFVSEYPIVSIEDPFDQDDWVHYAKMTEECGVEVQIVGDDLLVTNPTRVAKAIKEKSCTALLLKVNQIGSVTESIEAVKMSKHAGWGVMTSHRSGETEDTFIADLAVGLSTGQIKTGAPCRSERLAQYNQLLRIEEELGAAAVYARLKFRAPGGPF

SEQ ID NO: 82658 - protein, 621 aa, Vibrio parahaemolyticus RIMD 2210633
MTLDISKYPTLALANTPEELRLLPKETLPTLCDELRTYLLNSVSQSSGHLASGLGTVELTVALHYVYNTPVDKLIWDVGHQAYPHKILTGRRDQMPTIRQKDGLHPFPWREESEYDTLSVGHSSTSISAGLGLAISAQKEGKGRKVISVIGDGAITAGMAFEAMNHAGDVHPDMLVILNDNEMSISENVGALNNHLAKVLSGSLYTSIREGGKKVLSGVPPIKELVRRTEEHLKGMVVPGTLFEEFGFNYIGPIDGHDVNELVKTLKNMRELKGPQFLHIMTKKGKGYEPAEKDPIGYHGVPKFDPSHNCLPKSSGGKPTFSKIFGDFLCDMAAQDPKLMAITPAMREGSGMVRFSKEFPDQYFDVAIAEQHAVTLATGMAIAGDHPIVAIYSTFLQRGYDQLIHDIAIMDLPVMFAIDRAGLVGADGQTHQGAFDLSFMRCIPNMVIMAPSDENECRQMLYTGHKHTGPSAVRYPRGSGMGTEIEKEFTALEIGKGRVVRKGEKVAILSFGTFLPNALEAAKNLNATVADMRFVKPLDEALIRQLADEHDVLVTLEENAIAGGAGAGVIEFMMKEKIIKPVLNLGLPDKFIHQGTQEELHEELGLDAKGIEKSIAEYLAK

SEQ ID NO: 82659 - protein, 294 aa, Vibrio parahaemolyticus RIMD 2210633
MQQTLTSFQERNNQQLNLWLEQLPYQEQPLIQAMKYGLLLGGKRVRPFLVYITGQMLGCKPEDLDTPASAIECIHAYSLIHDDLPAMDDDDLRRGQPTCHIKFDEATAILTGDALQTLAFTIIADGPLSPSAENQRVNMIKALAHSSGANGMCVGQALDLGAENRQVSLAEMEEIHRKKTGALIDCAVKLGALAAGEKGIEVLPHLERYSKAIGLAFQVQDDILDIISDTETLGKPQGSDQELNKSTYPSLLGLEGAIEKAHTLLQEALQALEAIPYNTQLLEEFARYVIERKN

SEQ ID NO: 82660 - protein, 791 aa, Pseudomonas aeruginosa PAO1
MVEYVVSLDKLGVHDVEHVGGKNASLGEMISNLAGAGVSVPGGFATTAQAYRDFLEQSGLNDRIHAALDALDVDDVNALAKTGAQIRQWVMEAEFPARLDSEIRQAFAALANGNDNLAVAVRSSATAEDLPDASFAGQQETFLNIRGVDNVIRAAKEVFASLFNDRAIAYRVHQGFDHKLVALSAGVQRMVRSETGTAGVMFTLDTESGFRDVVFITGAYGLGETVVQGAVNPDEFYVHKPTLEAGRPAILRRNLGSKAIKMIYGDEAKAGRSVKVVDVDRADRARFALSDAEVTELAKQAMIIEKHYGRPMDIEWAKDGDDGKLYIVQARPETVKSRASATVMERYLLKEKGTVLVEGRAIGQRIGAGPVKVINDVSEMDKVQPGDVLVSDMTDPDWEPVMKRASAIVTNRGGRTCHAAIIARELGIPAVVGCGNATQILQDGQGVTVSCAEGDTGFIFEGELGFDVRKNSVDAMPDLPFKIMMNVGNPDRAFDFAQLPNEGVGLARLEFIINRMIGVHPKALLNFAGLPADIKESVEKRIAGYPDPVGFYVEKLVEGISTLAAAFWPKKVIVRLSDFKSNEYANLIGGKLYEPEEENPMLGFRGASRYISESFRDCFELECRALKKVRNEMGLTNVEIMVPFVRTLGEASQVVELLAGNGLKRGENGLKVIMMCELPSNALLADEFLEFFDGFSIGSNDLTQLTLGLDRDSGIVAHLFDERNPAVKKLLANAIAACNKAGKYIGICGQGPSDHPDLARWLMEQGIESVSLNPDSVLDTWFFLAEGQDQA

SEQ ID NO: 82661 - protein, 211 aa, Vitis vinifera
MASSDSWMKEYNDAVKLADDINGMISERISFSAPGVDAQRHASAIRRKITILGTRLDSLQSLLSKLPGKQPLTEKEMNRRKDMVANLKSKANQMASTLNMSNFANRDSLLGPEIKPADAMNRTTAANYERQMRDLRNWKRQYIVQNILHWQLIDNLDQHVDITDSRLKRVQKNLAILNKRTKGGCSCLCLLLSVVGIVILIVAIWLLVKYL

SEQ ID NO: 82662 - protein, 803 aa, Oryza sativa Japonica Group
MIPQLYIFLGLLLFSLHGAPPYSAAAVNDTLLAGESIAVSDKLMSRNGKFTLGFFQPSVVSKSGNITSPNWYVGIWFSNISEFTTVWVANRDNPVTDLQLNQTRLKLSNDGNLVISSNASTIWSSATVANTTIATTMNTTSVVLANNGNLMIIGSSSTSNVSWQSFEHPADVMLPGAKFGWNKATGATIKYFSKKNLIDPGLGLYYFQLDNTGIVLARSNPAKTYWSWSSQQSSKAISLLNQLMSINPQTRGRINMTYVDNNEEEYYAYILLDESLNVYGVLDISGQLIINVWSQDTRSWQQVYTQPISPCTAYATCGPFTICNSLAHPVCNCMESFSQTSPEDWEVGNRTVGCSRNTPLDCGNMTSSTDVFQAIARVQLPSNTPQRVDNATTQSKCAQACLSYCSCNAYSYENNICSIWHGDLLSVNSNDGIDNSSEEVLYLRLSAKDVPSSRKNNRKTIVGVIIATCIASFLVMLMLILLILRKKCLHTSQLVGGIVAFRYSDLCHGTKNFSEKLGGGGFGSVSKGVLSDSTIIAVKKLDGAHQGEKQFRAEVSSIGLIQHINLVKLIGFCCEGDKRLLVYEHMVNGSLDAHLFQSKATILNWTTRYNLAIGVARGLSYLHQSCKECIIHCDIKPENILLDASFTPKIADFGMAAFVGRNFSRVLTTFRGTVGYLAPEWISGVAITPKVDVYSFGMVLLEMLSGKRNSQKVCIDDNSNQVAPFPVTAISKLLEGDVRSLVDPKLNGDFSLEEAERLCKVAYWCIQDNEVDRPTMSEVVLVLEGLHNLDMPPMPRLLAALAL

SEQ ID NO: 82663 - protein, 368 aa, Brassica napus
IDLQDLVLRLTFDNICGLAFGKDTRTCAPGLPENGFATAFDRATEASLQRFIMPEFLWKLKKWLRLGLEVSLSRSLGEIDGYLAKVISTRKQELMSQQESGAQGHDDLLSRFMMKKKEAYSDTFLQHVALNFILAGRDTSSVALSWFFWLITMHPAVEDKIVREICSVLIETRGTENNPALWPGEPLNFDEIDRLVYLKAALSETLRLYPSVPEDSKHVENDDVLPDGTFVPAGSSVSYSIYAAGRMKSTWGEDCLEFIPERWISPIDGKFINHDQYRFVAFNAGPRICLGKDLAYLQMKSIAAAVLLRHRITVVPGHRVEQKMSLTLFMKNGLLVNLHKRDLEGTIKSLVVAKGDGVIDGKCDGVAV

SEQ ID NO: 82664 - protein, 540 aa, Glycine max
MATRRLSLLLSRSLSSTSFQAASLLHSLGRNSGKWGNFNRFSTAAAVEDLITPQVPITYTKHLINGQFVDAASGKTFPTYDPRTGEVIAQVAEGDAEDINRAVSAARKAFDEGPWPKLTAYERCKIILRFADLVEKHGDELAALETWNNGKPYEQSATAELPTFVRLFRYYAGWADKIHGLTVPADGNYHVETLHEPIGVAGQIIPWNFPLLMFAWKVGPALACGNTVILKTAEQTPLTALYVAKLFHEAGLPPGVLNVVSGYGPTAGAALASHMDVDKLAFTGSTETGKVVLGLAAQSNLKPVTLELGGKSPFIVCEDADVDQAVELAHFALFFNQGQCCCAGSRTFVHEHIYDEFLEKAKARALKRVVGDPFKKGVEQGPQIDVEQFQKVLRYIKSGIESKATLECGGDQIGSKGFFVQPTVFSNVQDDMLIAKDEIFGPVQTILKFKDIDEVIRRSNATHYGLAAGVFTKNVHTANTLMRALRVGTVWINCFDVFDAAIPFGGYKMSGIGREKGIYSLNNYLQVKAVVSPVKKPAWL

SEQ ID NO: 82665 - protein, 408 aa, Prochlorococcus marinus str. AS9601
MSGFNFDVITLFPKAFELINNLGVITRALDKKLIDVNLHDLREYGEGSYRQVDDKPYGGGAGMVLKPEPIYKAYESIRKSSKSKTLLMTPQGKILKQKDLARWSTLDQIIIICGQYEGFDERIRCLADEEISLGDYVLSGGEIPAISIINGLTRLLPGTLGDPDSLIDESHNSPLLEYPQYTRPLTFKDMKVPDILVSGNHEEIKSWRRKKSFERTLERRSDLISNENYKKSPQSKRIIKENNQFMKFRIGNGYDIHRLVEDRDLIIGGVKLNHPENLGLDGHSDADVLSHSIMDALLGALSLGDIGKYFPPSDEKWKNADSLFLLSKVIDLIRQDGWEINNIDSVLVAERPKIMPHVKLMKKNISEILNIDENLIGIKATTNEKLGPEGREEGISCHSVVLLEKNEF

SEQ ID NO: 82666 - protein, 157 aa, Triticum aestivum
TRLARPSLSKMCYNRRMEKNTMFLLSLLRVVAARSILAAYTIPFFIIPRTVHPLLGWPLYLLGSFSLSSIVINVFLLHPMTVLTTWFGFIGALLVMAFPWYLNGVVRALAVFAYAFCCAPLIWASLVKTMSSLHVLIERDAFRLGEPNQNAEFTKLY

SEQ ID NO: 82667 - protein, 388 aa, Mycobacterium avium
MAVHNLKDLLAEGVSGRGVLVRSDLNVPLDSDGEQGRITDPGPDHRVGADVERTGRGGRQGGGRRAPRASQEWAGPGVVAGPGGRRARRAAGPARAAGLGRGGHRRPGPRRGVDRRRRPAAGKHPVRRPRNVQGRRRAARAGRQMAELVGPTGAFVSDGFGVVHRKQASVYDVATLLPHYAGTLVAEEIAVLEQLTGSTKRPYAVVLGGSKVSDKLGVIESLATKADSIVIGGGMCFTFLAAQGFSVGKSLVETEMVDTCRRLLDTYVDVLRLPVDMVAADRLAADAAPQTVPADAIPDDLMGVDIGPGSVKRFTALLSNAETMFWNGPMGVFEFPAFAAGTKGLAEAIAAATGKGAFSVVGGGDSAAATAVELQLLFPLVRLIARLA

SEQ ID NO: 82668 - protein, 362 aa, Colwellia psychrerythraea 34H
MSNIAILAGDGIGPEVMVEAKKVLNTVASKFDFEITTQDYDIGGAAIDNHGNALPDSTMAGCIESDAILFGSVGGPKWANLPPTEQPERCALLGLRSHFDLFCNMRPATLQPALSSLSTLRSDISEQGFDVLVIRELTGDIYFGEPKGRRGEGEEETGFDSMFYSRREVKRISHLAFQAAQKRNNKVTSVDKANVLATSQLWRQVVEEVAVEYPDVELEHLYVDNAAMQLVRDPNQFDVMLCPNLFGDILSDICAMITGSMGLLPSASLNSDGFGMYEPAGGSAPDIAGLGVANPIAQILSAALMLRYSLNQGAAAKAIEDAVSNALDNGVLTADLLPANERKNAKSTSEVGDYICKQIESA

SEQ ID NO: 82669 - protein, 272 aa, Oryza sativa Indica Group
MANDWRSGELGLNRQWVEERRRTCCCTAPLRPPSSVDHLFNPTRATSGAPQDLPQCQLIASMGDSIFFKLKIELVFLTVDFDKGVTWLYSMITLGQARLGANVGHQQQGGEPTVDQGFKALRWYGEPGEAHAASASASAPTGAGGRASCARVRTGPPGDGGGGYPNLPDAAIPDAATLREQWRFAVRQYSRWYSHAWGTAILAGAAFFGLGWLVKGSNPLPSRAEPHASNAKEEGLPVCNVNSLNLVVSFQKFHIGNANIEFGELSDKRDEL

SEQ ID NO: 82670 - protein, 416 aa, Glomus mosseae
MSLSNKLSIRDLNVKDKRVLIRVDFNVPLDGTTITNNQRIVAALPTIKYALEQKAKTVVLMSHLGRPDGKKVDKYSLAPVAKEVERLLGKKVTFLEDCVGEGVENYVKNACDGEVILLENLRFHAEEEGSSKGPDGKKVKADLEKVKEFRRSLTALGDVYINDAFGTAHRAHSSMVGVELPQKAAGFLVKKELEYFAKALESPERPFLAILGGAKVSDKIQLIDNLIAKVDSLIICGGMAFTFKKTLENVKIGNSLFDADGAKTVGEVMEKAKKHDVEVVLPVDYITADKFAKDAQVGYATDQEGIPDGWMGLDCGEKSVELYKQTIAKAKTILWNGPAGVFEFDNFAKGTKATLDCAVEAAQSGKIVIIGGGDTATVAAKYGVEDKLSHVSTGGGASLELLEGKDLPGVSALSSK

SEQ ID NO: 82671 - protein, 196 aa, Oryza sativa Indica Group
MARDVVEAAAAADGRHHHKAVVAADGGGGGGAGTAALVWDCGSALYDSYELTSFRRQLDAAVLSCCGRSLSMPHQPSSSSTQQQQMPAGRRRRRRRRLPAMLRRLFGKVLLRLRFPVASRAARGGWYDYGAHGDGRPGSPWSGALTSIPEESASPENGPSSSPLVDDGPSALRKAQSERFVGSKTASSMVQFDVVL

SEQ ID NO: 82672 - protein, 416 aa, Agaricus bisporus
MSLSNKLSITDLALTGKRVLIRVDFNSPIQDGKITNPARINAALPTIKYALDNGASKVILMSHLGRPDGKAISKYSLKPVASELEKLLKKPVFFLHDCVGPDIEKAVLEAPEGAVVLLENLRFHIEEEGSAKNEEGKKIKADPSKVTQFREQLTRLGDVYVNDAFGTAHRAHSSMVGIKLPRRASGFLVKKELDYFAKALENPERPFLAILGGAKVSDKIQLIENMLDKVNCLVIGGGMAFTFKKTMQNVAIGNSLFDKPGSEKVAGIVEKAKKNNVEIVFPVDYVVGDKFDANANHKIVTDDEGVPDGWMGLDVGPKSNELFREAVLKAKTILWNGPPGVFEFPAFAKGSKVLLDATVEAVQKGATVIVGGGDTATVVANHDAEEKLSHVSTGGGASLELLEGKTLPGVAELSNK

SEQ ID NO: 82673 - protein, 143 aa, Brassica napus
HASAIRLQPVGVSRKLRNFVQTHKAPDLRNLQDVSDFITKAGYGSESEGDEEAATVTLSSDLGRVNKGSTKSAVKLQEIGPRMTMQLVRVEEGLCSGGIIFSEDGNVDGKNKQDGDEEDAASEEESEDGEEGSEEDMDEDAED

SEQ ID NO: 82674 - protein, 332 aa, Vibrio angustum S14
MSENSPELCRLLQQLFTDTFAKEKVRFIAEEGGTGKAFSALPFDHLVFTGSSTTGKAVMANAAKNLVPVTLELGGKSPAIIADDYDIKKALERILGGKTYNSGQTCVAPDYLYVPEDLLPEVINKAKKIIAKRFVDTNHQDYTSIIDSQSFKRLVTTLEDAKAKGADIYNLIPNSSPDLHSRKFPLHLVTGVDDTMQVMQREIFGPILPIIGYQSIEQVISLINKGDRPLALYLFSNSKDLQQKVIQQTRSGGVTINDVMLHVAQDDLPFGGSGHSGIGHYHGKEGFERLSKMRPVMYQASLSSMKLLYSPYSSLGKRMINFIINRKFGKYD

SEQ ID NO: 82675 - protein, 181 aa, Pseudomonas syringae pv. tomato str. DC3000
MAIRKFQDHTPALGERAFIDHSAMVIGDVEIGADSSIWPLTVVRGDMHRIRIGARTSVQDGSVLHITHAGPFNPDGFPLLIGDEVTIGHKSMLHGCTIGNRILVGMGTTIMDGAVVEDEVIIGAGSLVPPGKVLESGFLYVGRPVKQARALTEKEIAFFPYSATNYVKLKDQHLAEGFDKP

SEQ ID NO: 82676 - protein, 213 aa, Candidatus Blochmannia floridanus
MRQNVLFEFGTPIVRVLNALDALSNGRGILVVDDENRENEGDMIFAAENMTVKQMALAIRYGSGIVCLCLTEEKCRQLKLPMMVKNNSNHYKTAFTVTIEASKGITTGVSAKDRLTTIKTSIEDYAKPSDLNRPGHVFPLRAHNGGVLSRSGHTEAAVDLTTLAGLKPFGVICEVTNEDGSMARTTEIIKFSKQYDMPVLTISDVIAYRMSNL

SEQ ID NO: 82677 - protein, 526 aa, Synechococcus sp. WH 7805
MATGPAALRLESLIGNPSKELLSGLVVAFAMIPEAIAFSGIAGVDPQVGLFGAFCLSITIAFVGGRSAMITSATGSTALLMTGLVATGESRGPGLGLTYLLVAGIVTGLLQLLWGWLRLAYQMRFVPLGVLSGFVNALALLIFQAQFPQLGINLHFGEAEAAGHAHDLLPQGAQLPVVWGLVLLGLLIIYGLPRLTRALPSQLVAIVVLTAISMSFSFDIPTVQSLGDLPSGLPVFQIPFGALADGRVPFSLETLGIVLPTAMAISLVGLMETFLTQDILDDRTDSTSNKNREARGQGIANIVSSFFGGMAGCALVGQSVMNIDNGGRSRLSTLFSGVSLLAMILLARPWLQQIPMAALVAVMISIAVSTADVAGLRKIRSIPKSDTAVMLMTFAVTMLTTPHNLALGVLAGVALAGILFSRKVAKVIRVEPVDVAPDLRRYVVTGQLFFVSKIYFLQGFDVHDHPAKIIIDMTSAHIWDQSGVGALNQLIRKLKQGGSEVEVLGLNTESRDLFERIGSQPEGAHG

SEQ ID NO: 82678 - protein, 432 aa, Mycobacterium smegmatis str. MC2 155
MADLTPAQISAVDAAHIWHPYSKIGADAFPPVVAVGAKGAWLTVIDPSDGARIDVLDAMASWWTAVHGHGHPVLDAAISRQLSTMNHVMFGGLTHEPAARLAQLLVELTPDGLDTVFFSDSGSVSVEVAVKMALQYWRSLGRGAKHRLMTWRGGYHGDTFTPMSVCDPDGGMHSLWTDVLAAQEFAEAVPREYDPAYSAAFEKQLAANAGSLAAVIVEPVVQGAGGMRFHDPRYLADLRAICDRHDVLLIFDEIATGFGRTGKLFAAEHAGVSPDIMCVGKALTGGYITLAATLCTARVAQTISSGEPGALMHGPTFMANALACAVGVAAVELLIDSDWPARVAAIEEGLRSGLEPARALPGVADVRVLGAIGVIEMREPVDMPLATTTALAHGVWLRPFGKLIYAMPPFICTPEEVAQITAGMVGVARALT

SEQ ID NO: 82679 - protein, 207 aa, Methylobacillus flagellatus KT
MPLFQNATFHISAHNLSDLPAPAGIEVVFAGRSNAGKSSALNTLANHNRLAFVSKQPGRTQLINFFSLGNDRFLVDLPGYGYAKVPEAVRKHWQLTLASYLSQRPCIGGLVLVMDCRHPLTPLDRQMLNWYSPSGKPIHALLTKADKLSRQAANQTLQQVRKELEASWGNCSVQLFSSLKKQGVEEAETVIGRWLFAPEDDVPDAVA

SEQ ID NO: 82680 - protein, 578 aa, Pseudomonas syringae pv. tomato str. DC3000
MPTAPTPQIPPVQRELSLRAVITGIVLGILLTPSNVYAGLKIGWSFNMSIIALLIGYAIWQGLAKRSPHQPPWTLHESNINQTVASAAASIISGGLVAPIPAYTLLTGQQLDAIPMMAWVFSVSFLGIWIAWYLRPSLLNDTSLKFPEGMATLETLLHIYNHGREAATRLKVLLNAALLSGLAKWVDTFVWAFPRWSPSASLERLTFTADPSLLLVGFGAIIGIRVGVTLLLGALLAWGGLAPWLLAQGLVTLPAGSSGPQFAALVEWLLWPGVSLMVCSTLASLAIRLWGLHRSTKANSGTIWAVPKAGPALGLLLSIILVVSLQALLFGINLWMALLTIPLAICLAAVAARVVGATGIPPIGAIGQLSQLSFGIVAPGQVTINLMSANTAGGSAGQCTDLMNDFKVGKAIGATPRKQLVAQTLGIFVGSIVGVLAYMALIPDPQSMLLTEEWPAPAVATWKAVAQTLTHGLDSLSASIRWAIFIAGLTGLLLGVLDSTLPARRARYLPSAAALGLAFVLPASVSLMMALGAVLTWTVSGRWASLTERFAITAAAGLIAGESITGVGASLWQMFGNG

SEQ ID NO: 82681 - protein, 489 aa, Oryza sativa Indica Group
MGRSMLPEQQEDVSRKSKKEKKSKKDKKRKLEAEAEVVVVEAAAATSTDEATKSSKKKRAKGDLGQGEEAENGGGKVVAVTGKGSADAKYAPLSSFAATALPPQVLDCCKGFERPSPIQAYAWPYLLDGRDFIGIAATGSGKTIAFGVPALMHVRRKMGEKSAKKGVPRVLVLSPTRELAQQIADVLCEAGAPCGISSVCLYGGTSKGPQISALKSGVDIVIGTPGRMKDLIEMGICRLNDVSFVVLDEADRMLDMGFEPEVRAILSQTASVRQMVMFSATWPPAVHQLAQEFMDPNPIKVVIGSEDLAANHDVMQIVEVLDDRSRDSRLVALLDKYHKAQRGWSAVSVHGDKAQHDRTKALSLFKEGSCPLMIATDVASRGLDIPDVEVVINYSYPLTTEDYVHRIGRTGRAGKKGVAHTFFTQENKGLAGELVNVLREAGQVVPPALTKFGTHVKKKESQIYGSHFKEIKADAPKSTKITFGDSDED

SEQ ID NO: 82682 - protein, 490 aa, Colwellia psychrerythraea 34H
MQEHQELGLQDNQLVRSFSYINGRWHSSDSYISVTNPANGKVIAQVSNAGVVETELAVKAAKDALKMWSAKSANERATLMRNWFNLIMENQDDLGRILTLEQGKPLAEAKGEIGYGAAFIEWFAEEGKRVYGDTIPAPSGDKRIIVIKQPVGVVASVTPWNFPNAMIARKAAAALSAGCTFVVRPATQTPLSALAMAELAERAGIPAGVFNVVVGEDAHGIGKVLTQHPDIAKFTFTGSTPVGKALISQCATSVKKVSMELGGNAPFIVFDDADIDAAVQGALVSKYRNAGQTCVCTNRIFVQKGVIEQFTKKFTSAVAALAIGDGLTDGVSIGPMISSDAVCDVELLVKDSITAGAILALGGERDQAGDAFYQPTILTNVTNDMPIAKNEIFGPVTPIISFEDEDEVIAMANDTEYGLASYFYARDIGRIWRVAEGLEYGMVGINEGMISNAAAPFGGVKQSGNGREGSKYGLDDYLEIKYLCMGGLGK

SEQ ID NO: 82683 - protein, 233 aa, Triticum aestivum
MALFIHALWGGGKPLALVLTTVLLCVLRPGGQLPKGKEEFSSMADVYNHELTPLQKHVAFFDRNKDGVIHPSETYEGFRAIGCGVALSAFSAVFINGLLGPKTIPENMKVGAFKFPIYVKNIHKGKHGSDSGVYDANGRFVPEKFEEIFKKHAHTRPDALTGKELNELLQANREPNDLKGRVGGFTEWKVLYSLCKDKEGFLHKETVRAVYDGSLFVKLEQERKQAKESAKKK

SEQ ID NO: 82684 - protein, 357 aa, Hyphomonas neptunium ATCC 15444
MPQPASAITPPAVSSLPSARQCQEARLKALSALIGRTPMLSIRLRFRGRERVIHAKAEHYNLTGSIKDRMALSILACAYRSGALQPGDTIAEATSGNAGIALTALGRALGHPVEIFMPDWMSGERKNLLRSLGANLNLLSREAGGFLGAIAATETLAASRKDVFLPCQFSNGDNSAAHAQTTARELINQLATLDARPDAFVAGVGTGGTVMGVGRAFKSAFPDVKVHPLEPQESPTLSTGYKVGQHRIQGISDDFIPALVKLEQVDEVIAVSDGDAIRMAQRLARELGLGVGISSGANLIGALIAAERLGDTACVATVFCDDNKKYLSGALACEEPHKEGHLTPEIELLDFEATICG

SEQ ID NO: 82685 - protein, 93 aa, Hordeum vulgare
MASGQQERSQLDRKAREGETVVPGGTGGKSLEAHDNLAEGRSRGGQTRREQMGEEGYSEMGRKGGLSTNDESGGERAAREGIDIDESKFKTKS

SEQ ID NO: 82686 - protein, 438 aa, Bacteroides fragilis NCTC 9343
MKVKPDLSFWKLWNISFGFFGVQIAYALQSANISRIFATLGADPHSLSYFWILPPLAGIIVQPIIGAASDKTWTRFGRRIPYLFAGSLLAVWVMCLLPNAGSFGMAVGTAMIFGLVALMFLDTSINMAMQPFKMLVGDMVNEKQKGLAYSIQSFLCNAGSLMGYLFPFIFTFIGISNTADKGTVPDSVIYSFYIGAAILILCVIYTTVKVKEMPPKEFEEFHGITADEKKEKADFISLLKHAPKVFWTVGLVQFFCWAAFMYMWTYTNGAIAATVWGTTDVQSAGYQEAGNWVGVLFAVQAIGSVIWAVILPLFKARKQAYALSLVLGGIGFISTLFFHNEYLLFISYLLIGCAWAAMLAMPFTILTNSVSGKNMGAYLGLFNGTICVPQIAAALVGGGLLHLVGGHQVNMLVLAGVLLIAGAICVYFIKETMAHHEA

SEQ ID NO: 82687 - protein, 370 aa, Bradyrhizobium sp. ORS278
MATHKLLLLPGDGIGPEVMAEVKRLIGWLNGKGLASFETEDGLVGGAAYDAHGASISEGDMDKAKAADAIIFGAVGGPKWDGVPYEVRPEAGLLRLRKDLGLFANLRPAVCYPALADASSLKREIVEGLDIMIVRELTGGVYFGEPKTITDLGNGQKRAIDTQVYDTYEIERIARVAFDLARKRKNKVTSMEKRNVMKSGVLWNEVVTAVHAREYKDVTLEHQLADSGGMNLVKYPKMFDVIVTDNLFGDMLSDIAAMLTGSLGMLPSASLGEVDAKTHKRRALYEPVHGSAPDIAGRGLANPIAMLTSFGMALRYSFDLGALADKLDAAIAAVLASGLRTADIKAEGSTPASTTQMGEAIIKELETLTA

SEQ ID NO: 82688 - protein, 557 aa, Staphylococcus aureus subsp. aureus COL
MALSTFKREHIKKNLRNDEYDLVIIGGGITGAGIALDASERGMKVALVEMQDFAQGTSSRSTKLVHGGLRYLKQFQIGVVAETGKERAIVYENGPHVTTPEWMLLPMHKGGTFGKFSTSIGLGMYDRLAGVKKSERKKMLSKKETLAKEPLVKKEGLKGGGYYVEYRTDDARLTIEVMKRAAEKGAEIINYTKSEHFTYDKNQQVNGVKVIDKLTNENYTIKAKKVVNAAGPWVDDVRSGDYARNNKKLRLTKGVHVVIDQSKFPLGQAVYFDTEKDGRMIFAIPREGKAYVGTTDTFYDNIKSSPLTTQEDRDYLIDAINYMFPSVNVTDEDIESTWAGIRPLIYEEGKDPSEISRKDEIWEGKSGLLTIAGGKLTGYRHMAQDIVDLVSKRLKKDYGLTFSPCNTKGLAISGGDVGGSKNFDAFVEQKVDVAKGFGIDEDVARRLASKYGSNVDELFNIAQTSQYHDSKLPLEIYVELVYSIQQEMVYKPNDFLVRRSGKMYFNIKDVLDYKDAVIDIMADMLDYSPAQIEAYTEEVEQAIKEAQHGNNQPAVKE

SEQ ID NO: 82689 - protein, 433 aa, Vitis vinifera
MQKDQNMSVSPTPTARIRHRRRSNEVPSEFGKSNGSHLLVNDHNKYKSMWIRAYSSMWMIGGFIAIIYLGHLYIWAMVVVIQIFMARELFNLLRRAHEDKHLPGFRLLNWHFFFTAMLFVYGRILSQQLVNTMSTDKFFYKLVSGLLKYQMVICYFLYIAGFMWFILTLKKKMYKYQFGQYAWTHMILIVVFTQSSFIVGNIFEGIFWFLLPASLIVINDIAAYFFGFFFGKTPLIKLSPKKTWEGFIGGSVATVISAFVLANILGHFPWLTCPRKDLSTGWLRCDPDPLFKPEHYPLLEWVPQWFPWKEISVLPVQWHALCLGLFASIIAPFGGFFASGFKRAFKIKDFGDSIPGHGGITDRMDCQMVMAVFAYIYHQSFVVPQSYSVEMILNQILRNLTFEEQHALYMKLGQIFQERQLGLSSSSMSSYVM

SEQ ID NO: 82690 - protein, 491 aa, Agrobacterium tumefaciens str. C58
MSSQIIPVEPFDCVVFGGTGDLAERKLLPALYHRQVEGQFTEPTRIIGASRSVMTHEEYRKFAQDALKEHLKAGEYDDAQVTLFLNRLFYVPVDAKSGNGWDVLKKLLDEGKERIRAFYLAVAPGIFGDIADKIREHKLITRSTRIVVEKPIGRDLASAQELNDTIGHVFKEEQIFRIDHYLGKETVQNLMALRFANALYEPLWNSAHIDHVQITVAEAVGLEGRAGYYDKAGALRDMVQNHILQLLCLVAMEPPASMKSEAVRDEKLKVLRSLKPIDTSNVEKLTVRGQYRAGASAGGPVKGYLEELEGGVSNTETFVAIKAEIANWRWAGVPFYIRTGKRLATRVSEIVVTFKQIPHSIFDDAAGKIEANKLVIRLQPDEGVKQSLLIKDPGPGGMRLRQVSLDMSFAEAFNVRSPDAYERLLMDTIRSNQTLFMRRDEVEAAWDWIDPILKSWEELGQSVQGYTAGTWGPSGSIALIERDGRTWHDAD

SEQ ID NO: 82691 - protein, 379 aa, Alkaliphilus metalliredigens QYMF
MGVYLDNAATSYPKPKEVVDAVYDFMLNNGATSGRGAYERAMMADGLVYDTRKMIANLFNFHDPKKVIFTANITESLNLAIRGIVKEGDHVITSSIEHNAVWRCLKTLERDRGISLSVVPASKEGYTNPLDVKDLIQKNTVLIVINHASNVFGTIQSIGEIGAIAREHSIPFLVDAAQTAGVLPIDIKKDNVDLLAFTGHKSLLGPMGTGGLVVNWDGEMDPLKVGGTGGDSAYEYQPDYFPNKLETGTLNVSGIVGLRSALKFIQKEGIERIYEKEKDLVGYALNRLEEIRGISIYGPKDPNKIVGVISFNLQGITGEEVAYTLDQEYGIMVRVGLHCAPGPHRIIDKVKEGTVRIGIGYFNEKEDIDLLVNALKKIN

SEQ ID NO: 82692 - protein, 126 aa, Desulfovibrio vulgaris
SSITKEQVVEFIANMTVLELSEFIKELEEKFGVSAAAPAMMAVAAGPAEAAPAEEEKTEFDVILKAAGANKIGVIKVVRALTGLGLKEAKDKVDGAPSTLKEAVSKEEAEEAKKQLVEAGAEVEVK

SEQ ID NO: 82693 - protein, 515 aa, Coprinopsis cinerea okayama7#130
MAEIHDQFDTILILDFGSQYSHLITRRCREHKVYAELLPCTTKIKDINFKPKGVILSGSPYSVYDKDSPHVDPAVFDLGVPILGICYGLQELAWNLGGEVTKCDHREYGFAEVKINKIGSGNGVDALFEGLGDEMQVWMSHGDQLSKPPANFHVIGHTQSAPYAALAHDSKPIYGIQFHPEVTHSPRGKEVIGRFILNICGCKPTWTMEEFIGKEINRIREICGPKGRVIGAVSGGVDSTVAAKLMHEAIGDRFHAIMVDNGVLRKDEAKQVYEMLNRDLGVNLTVVDASERFLSRLEGIEDPEQKRKIIGNTFIHVFEDEAAKIEAAAEAEEAKGADAKGRVEWLLQGTLYPDVIESISFKGPSATIKTHHNVGGLLKDMKLKLIEPLRELFKGPGLAIRILGPVTREQVKILQHADSIYIEEIRKAGLYDQISQAFAVLLPVKAVGVMGDARTYEQVIALRAVQSEDFMTADWYVFPPDVLRRISSRITNEVAGINRVTYDISSKPPATVEWL

SEQ ID NO: 82694 - protein, 471 aa, Streptococcus mutans UA159
MDLRIKNKAKKIKAVFFDIDDTLRIKDTGYMPDSIKKVFESLQEKDILTGIASGRAPYGVVPEIRQLNPDFFVTINGSYVINHKGEELSNDPIPKDIIEKYVVWCQEIGIEYGFAGKDKAVVSKRTELVDKALVPVYGFCPVEPDFYKNHEVYHMWTFEDVGDSLQLSDELKEDVRLVRWHENSSDVIKNGISKASGLAHVLKKVHLKPENVLFFGDGPNDMEIFDYVGLKVAMGNGHGDLKEKADFITKNVEEDGILYALEELGLVEKELQFPQLDVTNDDAPMALIKTNYGDLKVKLFPKQAPKTVANFVALAKDGYYDGVIFHRVIKDFMIQGGDPTGTGMGGESIYGERFEDEFSEELYNLRGALSMANAGPNTNGSQFFIVQNQNLPYSAKELERGGWPKEIAAAYAENGGTPHLDRRHSVFGQLVDQASYEALDNIANVDTGVADKPIDDIVIESIEVIDDENRG

SEQ ID NO: 82695 - protein, 174 aa, Triticum aestivum
MAPAVMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 82696 - protein, 248 aa, Corynebacterium diphtheriae
MTTGKLILLRHGQSEWNASNQFTGWVDVNLTEKGEAEAKRGGELLKAQGVLPSVVYTSLLRRAIRTANIALNAADRHWIPVVRDWRLNERHYGALQGLNKAETKEKYGDEQFMAWRRSYGTPPPELEDSSEFSQANDPRYANLDVVPRTECLKDVVERFVPYFKEEILPRVKNGETVLIAAHGNSLRALVKHLDNISDADIAELNIPTGIPLVYELDEAGTVLNPGGTYLDPEAAAAGAAAVAAQGAK

SEQ ID NO: 82697 - protein, 479 aa, Prochlorococcus marinus str. AS9601
MTDSSFDFDLIVIGAGYGGFDAAKHAAGKGLKVAIVESSDMGGTCVNKGCVPSKALLAASGKVREIADYEHLAKFGIHASPVRFERSKIADHANNLVLNVRENLTKTLKRSGVEIILGIGRIEGNQKVGVRDKNGIDKIFTCKNIVIATGSSPFVPRGITLDNRTVFTSDDAVKLEWLPRWIAIIGSGYIGLEFADVYTALGCEVTMIEALENIMPTFDPDITKIAKKNLIQARDIDTKSNVFATKITPGCPVKIELTDAKSKEVVETLEVDAVLVATGRSPNSNNLNLESVGIETVKGFIPVDDQMRVKNGDEIIPNIWAVGDVTGKLMLAHTAAAQGTIAVDNICGGNVEINYKSIPAATFTHPEISSVGLSEVEAKEISTKENFTLGVVKSFFKANSKALAELESDGLLKLIFNKDNGKVLGAHIFGLHAADLIQEISNAISRNQDVLELSKEVHTHPTLSEVVEVAYKQAASQIK

SEQ ID NO: 82698 - protein, 482 aa, Vibrio vulnificus YJ016
MTQPLRRTKIVTTLGPSTDKDNVLEEIIRAGANVVRMNFSHGSAEDHKTRAEKVRNIAARLGRQVAILGDLQGPKIRVSTFKEGKIFLSVGDLFTLDSDLPKGEGDQKSVGLDYKALPQDVGPEDILLLDDGRVQLQVLTVDGNKVNTRVIVGGPLSNNKGINKKGGGLSADALTEKDKQDILLAAEIKVDYLAISFPRNGADMDYARRLARDAGLEAKLVAKVERAETVRNDENIDDIIMASDVIMVARGDLGVEIGDPELIGVQKKLIKRAKELNRVVITATQMMESMIENPMPTRAEVMDVANAVLDGTDAVMLSGETAAGKYPVETVRSMAEVCIGAEKTWEPGSQNYRIDKSFVTAEETIAMSTIYAANHMEGVKAMVTLTESGRTALMTSRLNSTLPIFALSPNERTLNRCSLYRGVTPVFFDTKVETGFDVAMAALSTLRKKKLLDFGDLVIITQGDIMDVEGSTNCMRILPVFD

SEQ ID NO: 82699 - protein, 633 aa, Aspergillus nidulans FGSC A4
MRVSVPLHSIRRSCNSSIANAATRLTPQRLYLSYGRRSSIVQAHPRTQARPIASYTHPHHASAISVLSTAVDTSSPDFRENERQMQEVLNRMNSLHSTISQGGPQKAKDKHVARGKMLPRDRVSALIDPGTSFLELSQLAGHEVYPGEDVPAGGIITGIGTVEGVTCMIVANDSTVKGGTYYPVTVKKHLRAQAIAQENKLPCIYLVDSGGANLPHQADVFPDKEHFGRIFFNQARMSSQGIPQISVVMGPCTAGGAYVPAMSDETIIVENQGTIFLAGPPLVKAATGEVVSAEDLGGGQLHSTISGVTDYLAVDDAHAIVLARRSISNLNYPKAKQPLESNDDIKEPLYDPAELNGIVGTNLRRQIPVHEVIARIVDGSEFAEFKRDYGTTLVTGFARIHGHRVGIVANNGILFSESSLKGAHFIELCAQRNIPLVFLQNISGFMVGADAEKGGIAKNGAKLVTAVACADVPKFTVVFGSSAGAGNYGMCGRAYSPRFLFMWPNAKIGVMGSEQLSSVMEAVGRTADPELKARIDRESEATFSSARLWDDGIIPPAHTRHVLGLSLAAALGVCIITISCHRATMTIKKEETPYNGWMISGQFKNLLAGDHEASMDETTERTQCYIRYKSSHY

SEQ ID NO: 82700 - protein, 446 aa, Bacillus pumilus SAFR-032
MKIHEQAQNLQAKDDQLIWHHMKGTNKDNESMVIHEAEGAWVTDIHGNRCLDGMSGLWCVNVGYGRKELAEAAYKQLKTMPYYPLTQSHVPAIQLAEKLNEWLGGDYVIFFSNSGSEANEAAFKMAKQYHAQKGESTRTKFISRYRSYHGNTAAALAATGQAQRKYKYEPLGQGFIHVAPPDMYRHPEDQENLASAAAIDQAMTWELSETIAGVIMEPIITGGGILMPPKGYLKKVKDICESHGALLIVDEVICGFGRTGKRFGFMHEEVKPDIITMAKGITSGYLPLSATCVKREIYEAYAGEDTYDRLRHVNTFGGHPASCAVALANLEIMENEQLVERSETLGRDMLERLQELKEHPFVGDVRGKGLLFGIELVQDQQTKKPAEPHVVGQLIAECKKRGLIIGKNGDTVAGFNNVAQLAPPLNITDDDASFIINTLKESMAQL

SEQ ID NO: 82701 - protein, 274 aa, Zea mays
MEGKEEDVRLGANRYSERQPIGTAAQGTEEKELTSWSFYRAGIAEFVATFLFLYISILTVMGVSKSSSKCATVGIQGIAWSFGGMIFALVYCTAGISGGHINPAVTFGLFLARKLSLTRALFYMVMQCLGAICGAGVVKGFQEGLYMGAGGGANAVNPGYTKGDGLGAEIVGTFVLVYTVFSATDAKRSARDSHVPILAPLPIGFAVFLVHLATIPITGTGINPARSLGAAIVYNRSHAWNDHWIFWVGPFIGAALAAIYHVVIIRALPFKSRD

SEQ ID NO: 82702 - protein, 499 aa, Mycoplasma hominis
MKKIILTIIDGLGLRKERQGNAYLQAKHPCFDYLFSMCPNSVLQASGQYVGLPEGQIGNSEVGHLNIGAGRVVYTGLSLINKAIENNTFKDNEILNDVIDKTIKNNTTLHVMGLLSNGGVHSLDLHLFEILKLAHSKGLKNVSVHVFGDGRDVKPQSIKNSLETLKDLCQKFGYKISSISGRFYAMDRDSIFSRNQEAYDAILGQSKNVIENIDDYIESQYKKGIFDEFFEPAQLKDGVFVKNGDSIIFFNFRPDRARQLSHMFIGSNLYTYKPKNQVQIDNFVSLMKYEGINSKIAFKEMEVVNPLGKVLESNDIKQLRLAETQKYAHVTFFFDGGVDIEYKNENRILVDSLKVDSFADYPHMSAKEITDSLLNNIEKNDFIIMNYANPDMVGHTGNLNATIEAIEFLDSQFQRILEYVSLNHENVTWFITADHGNAEITEDENNKPATKHTTSPVMFICTDKNVNLGNGSLCDVAPTILDYLKINKPKEMTGKSLLK

SEQ ID NO: 82703 - protein, 466 aa, Sinorhizobium fredii
MSKRFRSRSAARAARHRLRRGEQDMSNRLNTTPNDLSAFWMPFTANRQFKKEPRLFVGAKDMYYTTHDGRTVLDGTAGLWCVNAGHCRPKITEAIREQAGELDYAPAFQLGHPKAFELANRLVDIAPEGLNHVLYTNSGSESVDTALKVALAYHRAKGNGSRFRLIGRERGYHGVNFGGISVGGIVANRKMFGTLLTGVDHLPHTHLPAKNAFTRGEPKHGGDLASELERIVTLHDASTIAAVIVEPVAGSTGVLIPPKGYLQKLREICTKHGILLIFDEVITGYGRLGTPFAAQYFDVKPDIITTAKGLTNGVIPMGAVFVTSEIHDAFMTGPEHLIEFFHGYTYSGNPIASAAALGTLDTYKEEGLLTRAAELASYWEEALHSLKDCPHVIDIRNIGLIGAVELEPIAGEPTKRAFSAFLKAYEKGLLIRTTGDIIALSPPLIIEKHQIDELIDKLRDVLKNNI

SEQ ID NO: 82704 - protein, 403 aa, Pseudomonas aeruginosa PAO1
MNNSFWKAGHAPTLFAAFLYFDLSFMVWYVLGPLGVQIAGDLQLSTQQRAMMVATPILAGAVLRFLLGLLADRWSPKSAGILAQVIVIAALAAAWLLGVNSYAQALLLGLFLGFAGASFAVALPLASQWYPPQHQGKAMGIAGAGNSGTVLAALFAPGLAAAFGWNNVFGFALLPLVLTLLVFAMVARNAPQRPAPKAMGDYLKALGDRDSWWFMFFYSVTFGGFLGLASTLPGYFHDQYGLNPVTAGYYTAACVFAGSLMRPLGGALADRIGGIRSLLMVYTLAAICIAAVGFHLPSAMAALGLFVVAMLSLGAGNGAVFQLVPQRFHKEIGVMTGLIGMAGGIGGFCLTAGLGAIKQSTGDYQLGLWLFASLGVLAWFGLHGVKRRWRTTWGSAAVTAARV

SEQ ID NO: 82705 - protein, 553 aa, Bacillus pumilus SAFR-032
MTFSSLEREQMLQEMTKKPYDVFIIGGGITGAGTALDAASRGMRVGLAEMQDFAAGTSSRSTKLVHGGLRYLKQFEVKMVAEVGKERAIVYENGPHVTTPEWMLLPMHKGGTFGKFSTSIGLRVYDFLAGVKHNERRSMLSAKETLAKEPLVKKDGLKGGGYYVEYRTDDARLTIEVMKEAVKFGAEAVNYAKVKEFIYDKGKVVGVVIEDVMTQKTYDVYAKKIVNATGPWVDQLRDKDHSKEGKHLQHTKGIHLVFDQSVFPLKQAIYFDTPDKRMVFAIPREGKTYVGTTDTVYKKQLEHPRMTKADRDYVIKAIQYMFPDLNITENDVESNWAGLRPLIHEEGKDPSEISRKDEVWTSSSGLITIAGGKLTGYRKMAEHIVNLVRDGLKEETGKDFGPCKTKHMPISGGHVGGSKNMAAFVQAKTSEGAAVGLTEPIAQKLAEKYGSNVSSLFKRVDQLQGEADKRKIPAYVLAELVYAIEEELAVTPVDFFLRRTGSLLFNINWAKKYAQPVVDYMAERFGWDEAVKQKLQTELDQLFHEAVVPLDAE

SEQ ID NO: 82706 - protein, 415 aa, Hyphomonas neptunium ATCC 15444
MARTVLKFGGTSVGDLDRIANVAEIVAARAAKGEKMAVIVSAMSGETNKLVALADGAAGKDLPRSLYDDEYDVVVASGEQVTAGLLALALRRRGLKARSWLGWQLRLKTDNSHGRARIMGFDDSSLPDSIDSGEIAVVAGFQGVTDDFRVTTLGRGGSDTSAVAVAAALGAQVCDIYTDVDGVYTTDPRIVPKARRIDKISYEEMLEMASLGAKVLQTRSVELAMNHGVPVRVLSSFVKPGEESPGTLVCSEEEIVEKQVVSGVAYSRDEAKVTLYGVPDKPGSSAKIFSALARAGVNVDMIVQASSREASKANLVFTCTDRDSPFARETLEGLQAEVGYDRIEVIRDVSKISIIGVGMKSHTGVAEKMFTALSEKSINIDVIATSEIKISVLIAAPYTELAVRALHTAFGLDAD

SEQ ID NO: 82707 - protein, 136 aa, Oryza sativa Japonica Group
MRLTSHCSFCFRELNEKGSPLPKFGEWDVNDPASAEGFTVIFNKARDEKKTGGNSQGQDLAAKSEQPSGQGLYPAKPNSSAILVISFTLQVHKCLVDSAREQVILKHNFTPATLALECFFNLKKWFCCMQPTAAES

SEQ ID NO: 82708 - protein, 249 aa, Salmonella enterica subsp. arizonae serovar 62:z4,z23:--
MGNWKLNGSRHMVNELVANLRKELAGVAGCDVAIAPPEMYIDLAKRAAAGSHIMLGAQNVDLNLSGAFTGETSAEMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKADAKIAEQVIIQYGGSVNASNAAELFAQPDIDGALVGGASLKADAFAVIVKAAEAAKQA

SEQ ID NO: 82709 - protein, 394 aa, Methanosarcina mazei Go1
MSMTIGLAGKPNAGKSTFFKAATLADVEIANYPFTTINANHGVTYVRAECPCKEKGKTCGKCVDGVRLVPIDIIDVAGLVPDACKGRGLGNTFLDELRQAQAIIHVVDASGGTDAEGNPVDIGDHNPLDDVAFLNREITMWLYGILERNWVKLSRKIQAEGLKLEVVISEQLAGAGIKESHVNAALIETGLSRIDHIKWTEEDMIRLCDTMREISKPMLIAANKTDIAPRENLEKLRELDRIVVSTSAAAELVLRSAAKAGVIKYTPGDRDFELLTEEITKAQKKGLEAIHKVLERFGTTGIQECINRTVFELLDLIVVYPVEDEGKWSDKLGNMLPDAYLMKKGSTCHDLAYQIHTEIGDRFLYAVDARTRLRLGEKHELKNGDVIKIVSTAK

SEQ ID NO: 82710 - protein, 398 aa, Zea mays
MASPGVVAAALLVAVLAAFCGTDPLRMGSMAGFPGFEAHFVDLPDPAEMPPHADERERLRGAEVRFRGDVQGPESVAFDPQGRGPYTGVADGRVVFWDGERWVPFATASPRWTQELCGGPKASPVEYLPNEHICGRPLGLRFDKKTGDLYIADAYFGLLKVGPEGGLATPLATEAEGVRLNFTNDLDLDDEGNVYFTDSSIHYQRRNFMQLVFSGDPSGRLLKYNPQTKETTVLHRNLQFPNGVSMSKDGSFFVFCEGSRGRLSRYWLKGEKAGTVDLFAILPGFPDNVRTNEKGEFWVAIHCRRGLYARLMSRHVKLRKFLLSLPIPAKYHYLMQIGGRLHALIIKYSPEGQVLDILEDTKGEVVRAVSEVEEKDGKLWIGSVLMPFIAVFDLAKAS

SEQ ID NO: 82711 - protein, 490 aa, Salmonella enterica subsp. arizonae serovar 62:z4,z23:--
MDRLTPIRCWPAIISLVITLTIWFVIPCPADVTPQAWQLLALFIGTIAAIIGKAMPIGAIAIVAIMLVAMTGVTHPGKPSAALNDALSGFSNQLIWLIGLSIMLSQSLLKTGLGARIGYGFIALFGKRTLGIAWALTLAETLIAPVTPSNTARGGGIIHPVMRAIAESLGSQPGNCENGSTGRYLALVNYNINPISSAMFVTATAPNPLIVSFLTKGTDGVLNMTWGMWAIAALLPAIISLVVMPIVIWWLYPPAVTRTPDAPQFARQKLNALGPLSLAEKITLAVFILLLCLWAGVPAMLMGSGWTVNPTSAALIGLSILLLTGVLSWDDILKCRGAWDTIVWFAALVMMADFLSKLGLVGWLATSVGSAINHLGVHWSIATLLLILLYVYSHYFFASTTAHITAMFAAFFAAGLGLGAPPALLGLMLGFSSSLMMSLTHYGTGTAPIIFGSGYVTLAEWWKTGLVMSVVNLTIWGVTGAFWWHWLGYW

SEQ ID NO: 82712 - protein, 434 aa, Salmonella enterica subsp. arizonae serovar 62:z4,z23:--
MSLWLSHPLFLPSLVVGITVLLWATSLLPEFITALLFFTVAMAAKIAPPDMIFGGFASSAFWLVFSGFVLGIAIRKTGLADRAARALSAKLTDSWLLMVSSVVLLSYALAFVMPSNMGRIALLMPIVAAMAKRAGIADGTRAWYGLALAVGFGTFQLSATILPANVPNLVMSGAAEGSYGIHLNYVPYLLLHTPILAWLKGAVLIALICWLFPGAPCTPREAEASAPMSRNEKRLAWMLTVVLTMWVTESWHGIGPAWTGLAAAVVTMLPRIGFISGDEFASGINIRACIYVAGILGLALTVTQTGIGNAVGETLLHVMPLDTQKPFTSFLALTGITTALNFIMTANGVPALYTTLAESFAAATGFPLLSVIMIQVLGYSTPILPYQASPIVVAMALGKVPAKAGMLLCLALAAVTYLVLLPLDYAWFRVLGKL

SEQ ID NO: 82713 - protein, 408 aa, Zea mays
MAAPQPVAQAPEAPPSAQVVGNAFVQQYYLVLHQSPDLVYRFYQEASRLGRPASAAGAAGMDSVTTMEAIGEKIMEMDVSKAEIRTVDSQESLGGGVTVLVTGHLTGRDGVRREFSQSFFLAPQEKGYFVLNDMFRFVGEIPAPTAVEAQPEADAVVLSVAANGTSTLAVEPATPDDHAVPQQEHHVVDRSPPQPEEEEEAEVYDPPPEEVVDEEQPVPEVINEVPNNVAAVLATTVAPVLQEEAPKKSYASIVKVMKEVSLPAPAPPTRTAPPKPEKQSPALAPVKDVLPFSSNPENGNIQEPEDDAHAIYVRNLPLNATETQLEDEFKKFGTIKQNGIQVRSNKIQGFCYGFVEFEDSTSVQSAIEASPVMIGGRQCYIEEKRTPGSRGQSIYKLILNLMQCLCQS

SEQ ID NO: 82714 - protein, 262 aa, Thermus thermophilus HB27
MDPLALLRKAGLEAEGPALPLHGGDISRVWRVGRFVVKTAQDPPPGLFRAEARGLQALAERGVRVPQVHWVGEEGLVLAYLEPGPEDWEGLARTLAALHRRREGSYLAEPGFLGTFPLPGREGGEWTAFFYERCVLPLLEATWDRLQGLGPKVEALYRRPLPAEGPAPLHGDLWHGNVYFAREGPALLDPSFFVGERGVDLAMMRLFGGFPRRFWEVYGELYPVPEEVERALPRYQVYYLLAHVHFFGQGYLGALWRAISAS

SEQ ID NO: 82715 - protein, 645 aa, Blumeria graminis f. sp. hordei
MFPTLLPNKRTSPKFAHRNFQFPTDVGEKFVEDCGYQTQILSLGEAESSSDDKMGPQLPSQLPHSKRRKLPHEKLHVSALPRSTRYSKSLMHREQLTFLTMTPFTDFLITSSSDGVVKFWKKVSEGIEFVKEFRAHSGEIMSVSVSADGRSFATAGADKSIKIFDVSTFDLLAAITTEYIPRAICWIHKRGASQPLLAISDEVNHTIQIYDGTGDKQAPIHTISRLHRGVVHLMAFNNAYDCVISADEDGMLEYWSPSNNYEKPDNVFEFKSSTNLYEFKKAKVMPASLTVSPTGAQVAISSFPDRKIRIFDFPTGKLYRTYDESLQTLEEMQQAGTALQKLEDVEFGRRIGAERELETPALRNKANIIFDETGHFIIYGSMLGTKVLNTYTNRVVKVYGMDENYRPLCVALYQGQPQKKDFTTVAMAASNNPLLQESEARDPILFATGIGKARFYMFTNDSNIIKSERDVHNEKPSTLNSNKAVEAKVTESGTGAIIHTTYGDIHIRLFPDAAPKSVENFVVHSKKGYYNNTIFHRVIRKFMIQCGDPLGDGTGGESIWGKEFEDEFSTLKHDKPYTVSMANAGPNTNGSQFFITTEKTPWLDNKHTIFGRAIQGLDVIHRIENARVYKEKPEEEIKILNIEIL

SEQ ID NO: 82716 - protein, 391 aa, Prochlorococcus marinus str. AS9601
MNTYSRFDISFKKGKGCWLWDKSGKKYLDAVAGIATCSLGHSDRVLRRRLSSQLKKIQHISNLYNIEEQEQLSRTLTNMSCAKSVFFCNSGAEANESAIKLIKKYGNTTNKGKESIILAAESSFHGRTLAALSATGQPKYQKGFEPMIQGFKFFKFNNFDSVKKLFEECENNDQKISGVLVEPIQGEGGVIPGSKIFFKGLRDICNRHNSLLILDEVQSGVGRTGKMWGYENLGIEPDGFTLAKGLGGGHAIGALLVKEKANIFTPGDHASTFGGNPFACKAALTVLEEINRRNLINNVYLRGEQLSAGFEELSKKFPNIISEKRGLGLIQGLVINDDYAEAKKITLKAFDKGLLVVPAGGNVVRIVPPLVISRREINILLNKLNSIFEEL

SEQ ID NO: 82717 - protein, 308 aa, Streptococcus mutans UA159
MAKIYNNITELIGNTPIVKLNNVVPEDAADVYVKLEAFNPGSSVKDRIALSMIEDAEKRGLIKPGDTIVEPTSGNTGIGLSWVGAAKGYNVIITMPETMSVERRKIIQAYGAKLVLTPGSAGTKGAIDKAHEIAKEVGGWVPLQFDNPANPKIHELTTGPEILEAFGSHGLDAVVAGIGTGGTITGISRALKKDNPDIKIYGLEADESAVLSGDKPGPHKIQGISTGFIPAALDTHSYDEVIRVKSDDALATGRYFGGKEGFLLGISASAAVWAALEVAKKLGKGKKVLAIAPDNGERYLSTALYEFN

SEQ ID NO: 82718 - protein, 368 aa, Thermus thermophilus HB27
MLAVGIVGLPNVGKSTLFNALTRAQALAANYPFATIDKNVGVVPLEDERLYALQRTFAKGERVPPAVPTHVEFVDIAGLVKGAHKGEGLGNQFLAHIREVAAIAHVLRCFPDPDVVHVMGRVDPLEDAEVVETELLLADLATLERRLERLRKEARADRERLPLLEAAEGLYAHLQEGKPARTLPASEALGRFLKETPLLTAKPVIYVANVAEEDLPDGRGNPQVEAVRRKALEEGAEVVVVSARLEAELAELSGEEARELLAAYGLQESGLQRLARAGYRALDLLTFFTAGEKEVRAWTVRRGTKAPKAAGEIHSDMERGFIRAEVIPWDKLVEAGGWARAKERGWVRLEGKDYEVQDGDVIYVLFNA

SEQ ID NO: 82719 - protein, 453 aa, Xanthobacter autotrophicus Py2
MALDDLVTEGAGVGADAIPNDLDAFWMPFTSNRSFKKRPRLVSRAKDMHYYTPEGRAILDGCAGLWCVNPGHNREPIVEAIRQAATEVDFAPTFQYGHPQAFRLASRIADLAPGDLDHVFFCNSGSEAVDTALKIALAYHQTTGAGTRTRLIGRERGYHGVGFGGISVGGIVSNRRTFGTMLTGVDHLRSTYDREHQAFTKGEPDYGAHFADELERIVALHDASTIASVIVEPMGGSTGVLPTPKGYLKRLREICDKYGILLIFDEVITGFGRLGHAFAAERYGVVPDMITFAKGITAGAVPMGGVLVRKGIHDAFMKGPEHVVELFHGYTYSAHPLACAAGLATLDLYAREHTFTHARALEPFFADAMMSLKDKPGVLDIRTVGITGAVDLAPKEGAPGLKGYEALERAFHEEGLMMRIAGDTLVVTPPLIISKDQVGELVEKLGRVIEKVA

SEQ ID NO: 82720 - protein, 623 aa, Zea mays
  misc_feature (559)..(559): Xaa can be any naturally occurring amino acid
MADGAEMDEEAMRAFFPLSFGKAAPRPSSATSSAHSNTLRKPQNPSNPKPSASTAADDDGAAMIGPPRPPPAPAGEEDDEDGGGIMIGPPRPPPPSARGEGDDGDGMIGPPRPPPADDEDVDDDEDDDEEEMEDDGEGGFNRIPLSNEIVLRGHNKVVSALAVDHTGSRVLSGSYDYTVRMYDFQGMNSKLQSFRQLEPFEGHQVRSLSWSPTSDRFLCVTGSAQAKIYDRDGLTLGEFVKGDMYIRDLKNTKGHISGLTGGEWNPKSKETILTSSEDGSMRLWDVSDFTSQKQVIKPKLVRPMRIPVTSCAWDHEGKRIVGGIGDGSIQVWTIKAGWGSRPDIHVEKTHTEDITGVKFSTDGQSLLSRSMDSTLKIWDLRRMKTPLKVFEDLPNHYAETNAAFSSDEQLIFTGTSIEKDGDNGGLLCFFDRKKLELVSRVGISAHYSVIRCLWHPRINQVFATVGDKKEGGTHILYDPSISQRGALVCVGRAPRKKSVDDFEVQPVIHNPHALPLFRDQPSRKRQREKILKDPLKSHKPEAPVNGPGFGGRVGTTKGXSLLTQYLLKEGGLIKETWMDEDPREAILKYADAAEKDPKFIAPAYSQTQPKPVFAESDSDNEEK

SEQ ID NO: 82721 - protein, 179 aa, Candidatus Blochmannia floridanus
MTIDQIPAGNNIPEDIYVIIEIPLHSHPIKYEIDKITGAIFVNRFIATPMFYPCNYGYINHTLSLDGDPIDVLVPTPYPLLIGSVIHCRPIGMLEMTDESGEDSKIIAVPDNSVSQEYSAIHDINHLSKLTRNQISHFFKYYKDLESKKWVEIKAWKHVEDSKIEILNSFKRAKNKHKL

SEQ ID NO: 82722 - protein, 311 aa, Clostridium thermocellum ATCC 27405
MAKIAKNLTELIGNTPLLELSNYNRANNLEAVLIAKLEYFNPASSVKDRIGYAMIKDAEEKGIINKDTVIIEPTSGNTGIALAFVAAARGYRVILTMPETMSIERRNLLKALGAELVLTPGADGMGGAIRKAEELAREIPNSFIPQQFSNPANPEIHRRTTAEEIWRDTDGQVDIFVAGVGTGGTISGVGEVLKQRKPDVKIVAVEPFDSPVLSGGTKGPHKIQGIGAGFVPDNFNRAVVDEIFKVKNEEAFETSRKLARTEGLLVGISSGAAAFAATQIAKRPENKGKNIVVLLPDTGERYLSTALFQDA

SEQ ID NO: 82723 - protein, 324 aa, Candidatus Blochmannia floridanus
MNINQINKLIKQDIININFEIHKRLKSNIILINKFIKYIINSGGKKIRSTMILLIAKSLTYNKTQHTILATLIEFIHTATLLHDDVIDHSTTRRGKTTANIIFGNPASILIGDFIYTRAFQMMTELQSLRILSLMADAVNIIAEGEILQLTYCNDPTITMNNYMQIIYKKTARLFEVASQSSAILAHANIQQEQALSNYGKYIGIAFQLIDDLLDYNASDIVSFGKNIGNDLNEGKLTLPLLHAIYHSTPKEASIIHQAITDKNNQNLLYTVLNIMQQYGSLDYTRKCAETKINKAINCLNILSPSPYKHALKHLAYFILTRCY

SEQ ID NO: 82724 - protein, 396 aa, Candida albicans SC5314
MAPKKKGVVEKPVLLGRPGNNLKSGIVGLANVGKSTFFQAITRCPLGNPANYPFATIDPEEARVIVPSPRFDKLCELYKPKSEVPAFLTVYDIAGLTKGAHAGEGLGNNFLANIRAVDSIFQMVRCFDDADIIHINDEVNPIADLDIIKDELRLKDIEFANTYLEGVEKIAKRGGQSLEVKQKKEEAEFVKKVIQMLEDGKRIANQTWTAKEVDIINQMFLLTAKPCIYLINLSEKDYIRKKNKYLLKIKEWVDTNSPGDLIVPLSVSLEEKLANMESDEEREAYCKEIGAQSALPKIIVAMRQKLDLISFFTGGPDEVREWTIRKWYTAPQAAGTIHTDLERTFILAQVIKYDDLIELGDENSVRAAGKLMQKGKDYFVEDGDIIYVKAADGKAR

SEQ ID NO: 82725 - protein, 1442 aa, Saccharomyces cerevisiae YJM789
MTASDLLTLPQLLAQYSSSAPQNKVFYTTSTKNSHSSFKGLESVATDATHLLNNQDPLNTIKDQLSKDILTTVFTDETTLVKSIHHLYSLPNKLPLVITVDLNLQDYSAIPALKDLSFPILISSDLQIAISNADSSYKIATSSLTPVFHFLNLEKIGTSTAIEQDIDIPTLEIANEETKVALSEATDSLTNFELVKGKESITTVIVNLSPYDAEFSSVLPSNVGLIKIRVYRPWNFSKFLEILPSSVTKIAVLQGVSKKSQSNEFQPFLLDFFGNFNELVSRNIEQVVLTNIGNVNDYGNVINTVISNINKKEPDNNLFLGESNEKAEEQAEVTQLISSVKKVVNLEDAYIKVLKQLFSSNLQILNQFSSETIEPSNPEFGFGRFLKQEAQREELISLAKTSLDPSLYLSEDANKIVQLLSKWLSFNGRDLDEAQLQEANATGLEIFQLLQSNQDSSTVLKFLKIAPTSDSFIFKSSWLIGSDAWSYDLGHSGIQQVLSSRKNINVLLIDSEPYDHRKQNQDRKKDVGLYAMNYYSAYVASVAVYASYTQLLTAIIEASKYNGPSIVLAYLPYNSENDTPLEVLKETKNAVESGYWPLYRFNPVYDDPSTDKEAFSLDSSVIRKQLQDFLDRENKLTLLTRKDPSLSRNLKQSAGDALTRKQEKRSKAAFDQLLEGLSGPPLHVYYASDGGNAANLAKRLAARASARGLKATVLSMDDIILEELPGEENVVFITSTAGQGEFPQDGKSFWEALKNDTDLDLASLNVAVFGLGDSEYWPRKEDKHYFNKPSQDLFKRLELLSAKALIPLGLGDDQDADGFQTAYSEWEPKLWEALGVSGAAVDDEPKPVTNEDIKRESNFLRGTISENLKDTSSGGVTHANEQLMKFHGIYTQDDRDIREIRKSQGLEPYYMFMARARLPGGKTTPQQWLALDHLSDTSGNGTLKLTTRATFQIHGVLKKNLKHTLRGMNAVLMDTLAAAGDVNRNVMVSALPTNAKVHQQIADMGKLISDHFLPKTTAYHEVWLEGPEEQDDDPSWPSIFENRKDGPRKKKTLVSGNALVDIEPIYGPTYLPRKFKFNIAVPPYNDVDVLSIDVGLVAIVNPETQIVEGYNVFVGGGMGTTHNNKKTYPRLGSCLGFVKTEDIIPPLEGIVIVQRDHGDRKDRKHARLKYTVDDMGVEGFKQKVEEYWGKKFEPERPFEFKSNIDYFGWIKDETGLNHFTAFIENGRVEDTPDLPQKTGIRKVAEYMLKTNSGHFRLTGNQHLVISNITDEHVAGIKSILKTYKLDNTDFSGLRLSSSSCVGLPTCGLAFAESERFLPDIITQLEDCLEEYGLRHDSIIMRMTGCPNGCSRPWLGELALVGKAPHTYNLMLGGGYLGQRLNKLYKANVKDEEIVDYIKPLFKRYALEREEGEHFGDFCIRVGIIKPTTEGKYFHEDVSEDAY

SEQ ID NO: 82726 - protein, 321 aa, Parasitella parasitica
MAVDYLTLDRTGDKMPLRGFGCWKIEKKDAENTIYQAIKIGYRLFDGACDYGNEVEVGRGINKAIKEGLVKREELFIVTKLWNTFHSKQHVRTAFDRQLKDWGLEYFDLYLIHFPIPLQYVDPAVSYPPEWYVPHADKLNFERSPIHECWAEMEKLVQAKLTRNIGVANFNCQAILDLLSYSKIKPAVLQIEIHPLLPQERLVKWVQEQGIQVTAYSSFGPTSYVDLCESGKTYSSLLANADVKSIANKHNVNTGQILLRYALDRNIAVIPKSVHEDRMKSNLDILNIQLDQDDRKILNSLKTNQRFNDPMIFGFGLPLFD

SEQ ID NO: 82727 - protein, 288 aa, Staphylococcus aureus subsp. aureus Mu50
MKKIKKAIIPAAGLGTRFLPATKAMPKEMLPILDKPTIQYIVEEAARAGIEDIIIVTGRHKRAIEDHFDSQKELEMVLKEKGKSELLEKVQYSTELANIFYVRQKEQKGLGHAISSARQFIGNEPFAVLLGDDIVESEVPAVKQLIDVYEETGHSVIGVQEVPEADTHRYGIIDPLTKNGRQYEVKKFVEKPAQGTAPSNLAIMGRYVLTPEIFDYLKTQKEGAGNEIQLTDAIERMNNDNQVYAYDFEGERYDVGEKLGFVKTTIEYALKDDSMREELTRFIKALGL

SEQ ID NO: 82728 - protein, 107 aa, Brassica rapa
MGGCDKQGFPMKQGVLTPGRVRLLLHRGTPCFRGHGRRTGERRRKSVRGCIVSQDLSVLNLVIVKKGEKDLPGLTDTEKPRMRGPKRASKIRKLFNLTKEDDVRKYV

SEQ ID NO: 82729 - protein, 1038 aa, Staphylococcus aureus subsp. aureus Mu50
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEVGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 82730 - protein, 261 aa, Cytophaga hutchinsonii ATCC 33406
MTNHNQTVLITGATSGIGLELAKLFAYDNYNMVLIARDEERLIEIATELQEMGAGRITIITKDLCLQNAAAEIHHITSQHSIHIDVLVNNAGMAEYGLFSETEVQKDLCVIQLNIASMVQLTKLYMKDMIEHDKEGRILNLASVSSYQPSPMLAVYAATKAFVLSFSDAIAAELRDTDIKVTSLIPGPTDTDFFRKAGMEHTRAAQDNPEDPEIVALVGYQALIKGEPHAYPPGIWQVTAMSSLLSNQNVARMVEKQMQPY

SEQ ID NO: 82731 - protein, 396 aa, Colwellia psychrerythraea 34H
MFGSLKALPADPILGLLAKYKKDNNPNKIDLGVGVFKNEAGHTAVLDCVKKAEQHRTNTEDSKVYIGPTGSPVFNDEMAKLIFGSEHKVLNENRARTISTPGGTGALRVAAEFIKSCKAGATIWVSNPTWANHTGLFAAAGLNVKTYPYYDYENKSLDFDGMLNALKEVSSDDVVLLHACCHNPSGMDLNNEQWQQVADVAKDVGFTPLIDMAYQGFGSGLDEDAYGLRLMAETVKEMIVCSSCSKNFGLYRERIGACTIIGESSISVDIANSVLLYVVRVIYSMPPAHGAAIVETILSSDELRNEWYVELKAMRDRINGNRQLIVDKLIENGVTRDFSFISRQSGMFSFLGLTPEQVQQLQDEYSIYLVGSSRMSIAGIANSNVDYLAKSIAKVL

SEQ ID NO: 82732 - protein, 575 aa, Physcomitrella patens subsp. patens
MAVREGVAYQAPSSFSSVSEYGYAILDTPGRLCDRALAVSTLTEEMTEVKAMSGAEMTRNLRWWDVIALGVGGMVGAGIFVSTGSAARLSGPAVVLAYLVAGISALLSALCYTEFAVEMPVAGGAFSYLRITFGEFPAFIVGANLLMEYVLSNAAVARSFTSYAASAYGVLQVDAWRLHVGGLAAGYNQIDLVAVSVVMFLTVFLCCSTKKSSVFNLVMTVLHMAFILFIIIAGFVKGDTKNLTHAGDPAANPSGFVPMGIRGILGGAAIVYFSYIGFDSVSTTAEEVKNPAKNMPIGVSGSVVVVTVLYSLIAVALCMLQPYDMIDIGAPFSTAFQHVVGWEWATNFIGVGASLGIITSLLVAMLGQARYMCVLGRAHIVPQWFAVVNSSTGTPINATVFLGGCTAAISLFTDLTVLLNLISIGTLFVFYMVANALIYRRHHVPEKTNPFRTIAFLTIFSVDAVTFVTIWQFDHHNRHTWALYLLGGLALAMTTLFWFKVPTAQKNKDWSVPCMPWVAAASIFLNVFLLGSVDRASYVRFVTWTIVAVVFYLLYGVHSTYDGIMPTTVVREMIK

SEQ ID NO: 82733 - protein, 213 aa, Pseudomonas aeruginosa PAO1
MSRNSFIPHVPDIQAAGGLVPMVVEQSARGERAYDIYSRLLKERIIFLVGQVEDYMANLVVAQLLFLEAENPEKDIHLYINSPGGSVTAGMSIYDTMQFIKPNVSTTCIGQACSMGALLLAGGAAGKRYCLPHSRMMIHQPLGGFQGQASDIEIHAKEILFIKERLNQILAHHTGQPLDVIARDTDRDRFMSGDEAVKYGLIDKVMTQRDLAV

SEQ ID NO: 82734 - protein, 149 aa, Brassica rapa
GTLLKPNMVTPGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGPYKGDAKLGDGAAESLSRQGLQVLENSLYMVSGL

SEQ ID NO: 82735 - protein, 485 aa, Oryza sativa Indica Group
MKKKVCVVGGGLVGLAAARELQREGHDVSVLEQRGGVGGQWLYDHTAAIDGADPLGVAGVQSSVYASLRLITPREVTGFSDFPFSPTTVAGGGDARRFPSHAEFLRYLRDFCDAFGLMDVVRLNTRVLRVAADRDGWAVRSRRGEVETEEVFDAVVVAVGSYTQPRLPSIDGMEAWPGRQLHSHSYRVPDSFRGEVVVVVGCGFSGKDIALELRRVAREVHLSVRSTEEAMASPAMSKMLARYGNLHLRPQIARLCEEEDGAVVAFADGSRVAADTVVYCTGYSYSYPFLDTGGKVTVDDDNRVGPLFEHVFPPELAPSLSFLGIPNMVTTRFFEAQARWVAQVLSGRRALPPAGDMLRAAEEHARAMDTAGVARRRAHDVPDLGEEFCERSCGFPRLEEWEKELIWTSITAMRDDLESFRDDFRVTDLVADGLRRHGWILAPAPEPEPLRQEDVVAGDGEGEGVQPVQANQAAVASPLGFINSA

SEQ ID NO: 82736 - protein, 401 aa, Staphylococcus aureus subsp. aureus COL
MVTRSVLKFGGSSVSDFTKLKRIAEMLKERVNQDEQLIVVVSAMGNTTDQLMTNVSTLTKAPKQQELALLLTTGEQQTVSYLSMVLNDIGMNAKAMTGYQAGIKTIGHHLKSKIAQINPQTFEQAFQENDILVVAGFQGINEHQELTTLGRGGSDTTAVALAVSNQIPCEIYTDVDGVYATDPRLLPKAKRLDIVSYEEMMEMSALGAGVLETRSVELAKNYNIPLYLGKTLSNVKGTWIMSNEEILEKKAVTGVALDKHMMHVTISYPLPDNQLLTQLFTELEEGAVNVDMISQIVNLDGLQLSFTIKDSDFHQISMILETLKNQYEALAYKINEHYVKISLIGSGMRDMSGVASKAFLTLIENNIPFYQTTTSEISISYVIDDFNGQQAVEKLYDAFNI

SEQ ID NO: 82737 - protein, 362 aa, Neisseria gonorrhoeae FA 1090
MSQTIDELLIPHRNAIDTIDAEILRLLNERAQHAHAIGELKGTGAVYRPEREVAVLRRIQDLNKGPLPDESVARLFREVMSECLAVERPLTIAYLGPQGTFTQQAAIKHFGHAAHTMACPTIDDCFKQVETRQADYLVAPVENSTEGSVGRTLDLLAVTALQACGEVVLRIHHNLLRKNNGSTEGIAKVFSHAQALAQCNDWLGRRLPNAERIAVSSNAEAARLVAESDDGTVAAIAGRTAAEIYGLDMVAECIEDEPNNTTRFLVMGHHETGASGSDKTSLAVSAPNRAGAVASLLQPLTESGISMTKFESRPSKSVLWEYLFFIDIEGHRRDAQIQTALERLGERASFVKAIGSYPTAVL

SEQ ID NO: 82738 - protein, 296 aa, Pseudomonas putida
MAGKSPLINLNNGVKMPALGLGVFAASAEETASAIASAISSGYRLIDTARSYNNEAQVGEGIRNSGVDRAEMFVTTKLFNCDYGYERALRAFDESLGRLGLDYVDLYLLHWPTKDWNATIQSWKAAEKILGDGRARAIGVCNFLEDQLDELIAASDVVPAVNQIELHPYFAQKPLLAKNRALGIVTEAWSPIGGAINDGDGDNHGGRKHPLTDPVITTIAEAHGRSAAQVILRWHFQNDVVAIPKSVNPERIAKNIDVFDFALSDAEMAQLDELDTGVRIGPDPRDVDTSSFAEFV

SEQ ID NO: 82739 - protein, 522 aa, Arabidopsis thaliana
MGQAPSSPAEPNVRDTSLCLWSPEFLDCESIGFEDGDYDFTANLPDDCLAHIFQFLSAGDRKRCSLVSKRWLLVDGQNRHRLSLDAKSEILPFLPCIFNRFDSVTKLALRCDRRSFSLSDEALFIVSIRCSNLIRVKLRGCREITDLGMESFARNCKSLRKLSCGSCTFGAKGINAMLEHCKVLEELSLKRIRGLHELAEPIKLSLSASLRSVFLKELVNGQVFGSLVATRTLKKVKIIRCLGNWDRVFEMNGNGNSSLTEIRLERLQVTDIGLFGISKCSNLETLHIVKTPDCSNLGLASVVERCKLLRKLHIDGWRVKRIGDQGLMSVAKHCLNLQELVLIGVDATYMSLSAIASNCKKLERLALCGSGTIGDAEIGCIAEKCVTLRKFCIKGCLISDVGVQALALGCPKLVKLKVKKCSLVTGEVREWLRERRMTLVVSMDDDETNGVGLVDGGDQRVLETVVEEEAPPVIDGDGGLGVAGGGRLGLAILKTKLGLLAGRNLVACTLRRWSQSEATSSI

SEQ ID NO: 82740 - protein, 213 aa, Streptomyces griseus
MSAATSPSERRVSARIGAISESATLAVDAKAKALKAAGRPVIGFGAGEPDFPTPDYIVDAAVEACRNPKYHRYTPQRAPELKAAIAEKTLRDSGYEVDAGQILVTNGGKQAIYEAFAAILDPGDEVIVPAPYWTTYPESIRLAGGVPVEVVADETTGYRVSVEQLEAARTEKTKVVLFVSPSNPTGAVYSEADAEAIGRWAVEHGLWVMTDEI

SEQ ID NO: 82741 - protein, 418 aa, Medicago sativa
MASQNITPSPTASSDSVFAHLVRAPEDPILGVTVAYNKDPSPIKLNLGVGAYRTEEGKPLVLDVVRRVERQLLNDMSRNKEYIPIVGLADFNKLSAKLIFGADSPAIQENRVTTVQGLSGTGSLRVGGEFLAKHYHQRIIYLPTPTWGNHTKVFNLAGLTVKTYRYYAPATRGLDFQGLLEDLGSAPSGSVVLLHACAHNPTGVDPTLEQWEQIRQLIRSKSLLPFFDSAYQGFASGSLDADAQPVRLFVADGGELLVAQSYAKNMGLYGERVGALSIVSKSADVSSRVESQLKLVIRPMYSSPPIHGASIVAAILKDRDLYNDWTIELKAMADRIINMRQQLFDALRARGTPGDWSHIIKQIGMFTFTGLNPEQVSILTKEYHIYLTSDGRISMAGLSSKTVPHLAHAIHAVVTRVA

SEQ ID NO: 82742 - protein, 382 aa, Gossypium raimondii
MSTAGQVIRCKAAVAWEAGKPLSIEEVEVAPPQKHEVRIKILFTALCHTDVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRSVECTGSVQAMISAFECVHDGWGVCVLVGVPKKDDAFKTHPMNLLSERTLKGAFYGNYKPRTDIPMVVDKYLNKELGLDMDKFITHSVPFADINKAFDYMLQGIGLRCMIHLDA

SEQ ID NO: 82743 - protein, 106 aa, Brassica napus
MAAPPDSKSDKSPEELLCAAAEAGNDDAIAELISTGADPTYFDASGMTPLMRAATGGHAAAARLLLDAGAPWNALSPEGLSAGDLTSDPATYDLLLDHALRSELIL

SEQ ID NO: 82744 - protein, 340 aa, Legionella pneumophila str. Paris
MKSLVKAKKEPGIWMQDIPVPEYGVNDVLIKIKRTAICGTDIHIYSWDEWAQATIPVPMTVGHEFYGEIVEVGKEVQGLKVGQRVSGEGHITCGFCRNCRAGKRHLCRNTLGVGVNRPGCFAEYLALPATNVIALPDNITEEQAAILDPFGNAAHCALAFDVVGEDVLITGAGPIGIMAAAIVRHIGARHVVITDVNDHRLELARQMGVSRAVNVKYQKLIDVANELGMLEGFDVGLEMSGNPMALNDMMKAMNHGGHVALLGIPPQETPIDWNQVIFKGLVIKGIYGREMFETWYKMIAMLQSGLNISPVITHNFPVDEYQHAFQIMASGQSGKVILNW

SEQ ID NO: 82745 - protein, 515 aa, Arabidopsis thaliana
MEKFSYNSYPDSTDSSPRSREIEFDNPPPPWDDQNQNQQQHSYKVKFMCSYGGKIQPRPHDNQLTYVNGETKILSVDRGIRFPVLASKLSTVCGGGDGGGGEVTFKYQLPGEDLDALISVTNDDDLEHMMHEYDRLLRLSSKPARMRLFLFPASSGFGSQSSTQSDRDRFVEALNTVPRLSESEKSVTAPPNNADFLFGSEKVAAPPPPPPAEVKLPVPVALEPPLFNDPRVIQPDHVVNPMEIQRQMQEFQRMHIRDQEQQQQQQQEAVYRRKSNEDGLIETGGGYFSPPYIQNPAPPPPQQTIPQTNPQAPPMTTFWQGNHNPGVVFPTTTHGLGLPEQPVYMIPSPSPSPVYHAPPPPQPQGVIRPILTGQVNQGGYYPQVQRVASDTYREPHQSPYNVAQPLQAPIGTKAAQQQQPPPPQPFTSGPPPPQYTAVPPPRQVVGLPDTSAYTQVTYTGGMGKQVYYTEAPPPQYHGVGLPVTGMSELRTGPDGKLVAMNMAPKVSSQSSDSAV

SEQ ID NO: 82746 - protein, 264 aa, Cytophaga hutchinsonii ATCC 33406
MTNENQTVLITGATSGIGLELARLFAADKYNMVLVSRDEQNLNRVAAELQTMGAQNITIVPKDLSLPNAAEDVFLITKQQGIHINVLINDAGVGEYGYFTDTNLAKELRIIQLNISAMVHLTKLYLREMIQYNGEGRILQLASVASYQPSPMLAVYAATKAFVLSFSDALAYELKDTNITITSLIPNATDTDFFRKAGMEHTKAAQDSPDNPTLVAQIGYEALLKGESHAYAPGVRQAAAMSSILSNQNVAKMVEKQMQPAEQK

SEQ ID NO: 82747 - protein, 765 aa, Sclerotinia sclerotiorum
MNRYDDGELEISLAPSANHRAQHRSSEASSNPRRDSQNGGNRRMESAPQKKTEQRVGAYSVVRTLGEGSFGKVKLAVHRVTQQQVALKIIARRKLISRDMAGRVEREIEYLQLLRHPHIIKLYTVIKTPHEIIMVSEYAGNELFDYIVQHGKMREDEARRFFQQIICAVEYCHRHKIVHRDLKPENLLLDENLNVKIADFGLSNIMTDGNFLKTSCGSPNYAAPEVINGKLYAGPEVDVWSCGVILYVLLVGRLPFDDEHIPSLFAKIARGQYNVPSYMGREAAALIKKMLAVNPVYRATIAEIRDDPWFTTNLPAYLQPPVEEFIDTGVDPAKAINPRAIAPHASPAIQEKLHVQVTEKISKTMGYGIKDVQEALAAEEPSAIKDAYLIVRENKLMQANPNLTDDKNQLLFQIPSPPTYDSTIPPSMPDSPSPLVKERPGNIPPTAPPFQPRPSPLLDAVSPRSSSSIGTDRSFVRPYVSKIGILPSSIPQYHKEFMETHKSGHQESTLSNSHSETIEPSPQTEAEKAETVRRLNPHSRSLAKLDEGKKPAGMTPVPVKKAKPTKWQFGIRSRNQPLEAIGCIYRALQKLGAEWLVGDEWTPGQSENNGNKRNDDNDDNDDPNGSGASLHRETSMNDNSKKNRFSGIDKKGNYKLPEDPWVLHVRWKKTDIRRHSIASLNSSTSSPAHPSSMPKDEGLDSIDGGVIMHLDIQLYEMEPGVYLVDFKCAGYETADGMMCEEKDVTSPFPFLDLASKLIIQLAEAD

SEQ ID NO: 82748 - protein, 767 aa, Schizosaccharomyces pombe
MTTLNTNDKDLPIVKKYDSLNGWDFLKTGVSQIFERLDEGMTITKYMELYTRAIHNYCADASKTITVDNFNDQAANVLGEALYNNLVLYLEEYLARLRKECISQTNHEEQLAAYAKYWTRFTTSARFINHLFGYLNRYWVKLKNRFTETLVYDIYTLCLVSWHHHVFSHIRDSLLQNLLYMFTKKRLYEPTDMKYVEVCVDSITSLSFDKTDMTKPNLSSYKTFFETNFIENTKNFYAKESSEYLASHSITDYLKKAEIRLAEEEELVRLYLHESTLKPLLEATEDVLIAQHEEVLHNDFARMLDQNCSEDIIRMYRLMSRTPNGLQPLRQTFEEFVKRSGFAAVAKIVPQVGGEADVDPKEYMEMLLSTYKASKELVNTAFHGDTDFTKSLDTAFRELVNRNVVCQRSSSRSPELLAKYADSILRKSNKNVDIDDVEDCLSSIIIIFRYVEDKDVFQNFYTKLLAKRLVNGTSNSQDAESSMLSKLKEVCGFEYTSKLQRMFQDISLSQEITEAFWQLPQSRAGNIDFSALVLGTSFWPLSPNNVNFHLPEELVPLYEGFQNYYYSCHNGRKLSWLFHLSKGEIKARINPQTNVTYVFQVSTYQMGVLLLYNHRDSYTYEELAKITGLSTDFLTGILNIFLKAKVLLLGDNDKLGDPNSTYKINENFRMKKIRVQLNLPIRSEQKQESLETHKTIEEDRKLLLQSAIVRIMKARRTLKHVVLVKETIDQIKSRFTPKVSDIKQCIDMLIEKEYLERQGRDEYIYLA

SEQ ID NO: 82749 - protein, 378 aa, Hyphomonas neptunium ATCC 15444
MGQDIAPFQAISISRRAHELKAAGQRILHMEFGQPSTGAPKAAIAAAHGVLDSEAMGYWESLPLKERICQHYQDSYGVSLSPRRLVITCGASPALVLALATAFSPGDRIAIARPGYVAYRNTLRALNMEPVEIACGAEVRFQLSAAALEALEPAPMGVIIASPANPTGTIIPKEELAAIAEVCARRGIQIISDEIYHGLTYGPKIHSMLEFAPSAYIVNSFSKYFSMAGWRLGWLVSPEAGVARTGAYIGNLFLTAPSLAQHAGLVAMDSREELEGHLDVYRRNRELLLGALPGLGLEKIAPPDGAFYIYADVSRFTDDSLGFCLKLLEETGVATAPGVDFDPVEGGRFMRFSFALSTPEIEEALARLEPWFKAQPRR

SEQ ID NO: 82750 - protein, 332 aa, Burkholderia sp. 383
MTQPVTAIRIGIDRYGDAGVLRRVDAPVAPPGAGEVRIRQTAIGVNFVDIYFRTGAHALPALPDALGVEAAGVIDAVGPGVTDLVPGQRVAYAGMPTGSYASLRTMPAERVLPIPDGLSDEAAAAGLLKGITVYMLLHHVRQVGAGDTVLVHAAAGGVGLLATQWARALGARVLGTVGSAAKAALARTHGAEAVVDYREEDFVAAARAFGGGAGVDFAIDGIGGDVLTRTLGAVRPFGMVASIGQVAAIGVRQTFDLDELGPVRSIALARPSVLGFIARDVVGYREAARATLERLAGGMHVEIGARLPLEEAADAHRLMESRATKGGVVLVP

SEQ ID NO: 82751 - protein, 319 aa, Streptococcus mutans UA159
MKRILVLHTGGTISMHADKAGRVVPDSDNPMNHASVKLDDIQINAIDFLNIPSPQITVEHMLLLTQKIRETAGLYDGVVITHGTDTLEETAYFLDTMILPQIPIVLTGAMRSSNELGSDGVYNYLSALRVASHDNAADKGVLVVMNDEIHAAKYVTKTHTTNVSTFQTPTHGPLGIIMKHDILFFKTAEPRVRFRLESLTGTVPIIKAYAGMGDWLLNILDKSSIDGLVVEALGAGNLPPEAAQSITKLIQEGIPVALVSRCFNGIAEPVYAYQGGGVKLQEAGVMFVRELNAPKARLKLLIALNAGLKGQELKEYIEG

SEQ ID NO: 82752 - protein, 263 aa, Colwellia psychrerythraea 34H
MELEINIIDAFTDVAFKGNSAAVIITTDWLSDELMQSIAIENNLSETAYVKKIDIHNYEIRWFSPITEIDFCGHATLASSFVIFAKNDNLLNINFYAEAVGDLSVTKMDSGYIQMEFPSRPPESISDIPVALLNGLSIKPMEVLLNNQAYFVVYEKEIDVTSVVPDNELLKQLAPHDVVVTSKSNDYDFVSRYFWPANGGDEDPVTGSIHTGLAPYWAEKLNKSKLIAYQASKRGGKIICNVADNKVYLLGKAVQYLKGTIEV

SEQ ID NO: 82753 - protein, 240 aa, Oryza sativa Japonica Group
MTSPPPPPSSLLRRLPTTRCCCFASASSGWSASASVRLGSLGGKQRRGHRGVAVMAAAAAGGGGFEARVARIASTIRVIPDFPKPGIMFQDITTMLLKPDAFRDTIELFVERYKDKGITVIAGVEARGFIFGPPIALALGAKFVPLRKPKKLPGEVISEEYSLEYGTDKIEMHVGAVEPNGRAVVVDDLIATGGTLSAAVKLIERAGAEVVECACVIELPELKGRDKLGNKPVFVLVKAD

SEQ ID NO: 82754 - protein, 311 aa, Moorella thermoacetica ATCC 39073
MTKIATREAYGKALVELGRQNSQVVVLDADLSKSTMTRYFAQEFPERFFNMGIAEQSLMATAAGLGLSGKIPFASTFAVFATGRAYDQVRNGIAYPKVNVKIAATHAGLTVGEDGASHQAVEDVTLMRAIPNMTVIVPADGEETRQAVFAAAAYQGPVYIRLGRPAVPVIYNEDYRFQIGRAHTLRRGKDAAIIACGVMVHEALRAAEELAAAGLEVMVVNMSTIKPLDREAVLAAAATGAVVTAEEHTVIGGLGSAVAEVLATERPVPLAMVGIRDTFGESGKPDELMAKYGLTARDIVAAVKRLKGKKD

SEQ ID NO: 82755 - protein, 498 aa, Hevea brasiliensis
MVASIAAGIQFGWALQLSLLTPYVQLLGIPHTWAAFIWLCGPISGMLVQPIVGYHSDRCTSRFGRRRPFIAGGALAVAVAVFLIGYAADLGQLSGDPVAKSPKPRAIAVFVVGFWILDVANNMLQGPCRALLADLSGANQKKTRIANALYSFFMAVGNVLGFAAGSYTHLYKIFPFTKTKACDVYCANLKSCFFISIVLLLTLTVLALIYVREKPWSPERGNTAAGDEEEEDEGASESSPMPFFSEIFASLKNLQKPMWILLLVTCLNWVAWFPFLLFDTDWMGREVYGGDSNGNPDQVRLYDRGVRAGALGLMLNSVVLGFTSLGVEVLARAVGGVKRLWGIVNFILSFCLFMTILITKMAESHRRFATVGGGATVPLPPPGDVKAGALALFAVMGVPQAITYSIPFALASIFCNTAGAGQGLSLGVLNLSIVIPQMVVSVASGPWDALFGGGNLPAFVVGGVAAAASGIFAFTLLPSPQPDAPSAKTSRAVTAAFH

SEQ ID NO: 82756 - protein, 280 aa, Neptuniibacter caesariensis
MQTKTIVIAGCGDVGSAIGQLLNKAGHKVIGLRRNINQLPQGIQGISADLTQLDALKQSLKQIEQYDILVYAASASTSTEEGYRSAYVDGLKNTLAALPMTPSHLFFTSSTGVYHQNDHSWVDEESPCEPQRFSGQVMLEAEQLLHAQGIPATVVRFSGIYGPGRGYLINKVREGNLAPESPLQYSNRIHRDDCAGVVAHLVNRVFEGHPVDKCYLASDDHPCSMHEITHWLAGELNASMQSKSVTRFSGSKRCSNKRLKESGYQFIYPDFKTGYKTLIN

SEQ ID NO: 82757 - protein, 225 aa, Vitis vinifera
MTRLRKRVAMHLKDSQNTFAMLKTFNEFDMTNLMKLRSDYKDAFFEKHGVKLRFMSGFVKAAVSGLQNQPIINAVIDGDDIIYRDYINISIAVGTPKGLVVPVICDAGRMNFAEIEKEINTLAKKANDGTISIDEMAGGSFTISNGGVYGSLLSTPIINPPQSAILGMYSIVKRPMVVGGNIIATSMMYIALTYDHWLIDGREAVLFLRHIKEVMEDPCCLLLDI

SEQ ID NO: 82758 - protein, 353 aa, Zea mays
MAAIGTTADLNQHLSSPFIARRCHGPGEAALEAPLSVRIKSRTPRRRAESTTTRILCRGAEAQPGSGGGRRREPLRRGAVSARLPVPDHIRRPPYVGTAAVPEVCPDRQVHDGESIMRMLDACELAARVLHHAGAMVKPSVTTDEIDRAVHQMIVDAGAYPSPLGYGGFPKSVCTSVNECTCHGIPDSRELQDGDIINIDVTVYLNGYHGDTSRTYLCGEVDDATKQLVKVTEECMMRGISACRHGASFKEIGQRISEHAEKYGYGIDPFVGHGVGRMFHCEPIIWHTYDYEPGFMVAGQTFTVEPTLSMGSTQCVVWDDGWTAVAADGSLSAQFEHTVLVTGDGAEVLTGFP

SEQ ID NO: 82759 - protein, 420 aa, Solibacter usitatus Ellin6076
MRQRRRTIGEFFGQLGPGLITGAADDDPSGIATYSVSGAGFGYSPLWTALFCFPLMVAVQMMCARLGMVSGRGLAAVVRRRYSRWVLWGACLLLTVANVINIGADLGGMADATEMVTGIPSWWLTPFYAALIIAVMMWSSYRAIARVFKWLTLVLFAYVITAFVVHPDWRAVLHATFVPQIVWSSEYLSVLVGILGTTISPYLFFWQAAQEVEEERAAGRTTVAQRRGATAKELRESRNDVMIGMFFSNFVMYFIILTTASTLHAHGVTHIATAKQAAEALRPLAGAGAYWLFTLGLIGTGMLGVPVLAGSSAYAIAEAMNWMGSLDRKPKLAVKFYSVLGVAMALGLALDYAGLDAVKMLFWSAVANGVLAPPLVVIVVLLTTDSSVMGEHVNSPLLKWLGWTTAVVMTAAAVAMMLAG

SEQ ID NO: 82760 - protein, 276 aa, Cryptococcus neoformans var. neoformans JEC21
MSRRHSQFRPCIDLHQGVVKQIVGGTLDLTSQSGAGPTENFVATHPPSYFADLYKTNDLVGGHIIKLGPGNDEAAKEAVSAWRNGMQVGGGITETNAQEWLNNGASKVIVTSYLFPNGKFDEDRLKRLANQAGKDKLVVDISCRKRENGWVVAMNGWKTLTDMAVTKESIQLVERYCSELLIHAADVEGLCQGIDEELVTRLGEWVSIPCTYAGGAKDISDLALVDRLSNGKVDLTFGSSLDIFGGKGVKFTDLVKADKEAKEHLKCTTCIDSDTC

SEQ ID NO: 82761 - protein, 609 aa, Streptococcus agalactiae NEM316
MEFSRETRRLALQRMQDRTLDLLIIGGGITGAGVALQAAASGLDTGLIEMQDFAEGTSSRSTKLVHGGLRYLKQFDVEVVSDTVSERAVVQQIAPHIPKPDPMLLPVYDEPGSTFSMFRLKVAMDLYDLLAGVTNTPAANKVLSAEDVLKREPDLQKEGLLGGGIYLDFRNNDARLVIENIKRANRDGAYIASHVKAEDFLFDDNNQIIGVRARDLLTDQVIDIKARLVINTTGPWSDTVRNFSNEGKQIHQLRPTKGVHLVVDRQKLNVSQPVYVDTGLNDGRMIFVLPREDKTYFGTTDTDYHGDLEHPTVTKEDVDYLLNIVNKRFPEAELTIDDIESSWAGLRPLLSGNSASDYNGGNSGKLSDESFEELIDSVKDYIAHKNHREDVEKAISHVESSTSEKELDPSAVSRGSSFERDDNGLLTLAGGKITDYRKMAEGAMETIINILDKEYNRKFKLINSKTYPVSGGEINPSNVDSEIEAYAQLGTLSGLSIEDARYIANLYGSNAPKLFALTRQITEAEGLSLVETLSLHYAMDYEMALSPTDFFLRRTNHMLFMRDNLDSLIQPVIDEMAKHYQWSDQDKTFYEEELHETLKDNDLAALKDN

SEQ ID NO: 82762 - protein, 301 aa, Thermus thermophilus HB27
MGGEALTLPKDLLDFSGYGPKELQALLDLAERLKRERYRGEDLKGKVLALLFEKPSLRTRTTLEVAMVHLGGHAVYLDQKQVGIGEREPVRDVAKNLERFVEGIAARVFRHETVEALARHAKVPVVNALSDRAHPLQALADLLTLKEVFGGLAGLEVAWVGDGNNVLNSLLEVAPLAGLKVRVATPKGYEPDPGLLKRANAFFTHDPKEAALGAHALYTDVWTSMGQEAERAKRLRDFQGFQVNGELLKLLRPEGVFLHCLPAHYGEETTEEAVHGPRSRVFDQAENRLHTAKAVLLTLLK

SEQ ID NO: 82763 - protein, 551 aa, Chenopodium glaucum
MWSQLSSLLSGKMDALATSDHASVVSMNMFVALLCGCIVIGHLLEENRWMNESITALLIGLATGVVILLISGGKSSHLLVFSEDLFFIYLLPPIIFNAGFQVKKKQFFRNFITIILFGAVGTLVSFTIISFGALSIFKKLDIGSLDLADYLAIGAIFAATDSVCTLQVLNQDETPLLYSLVFGEGVVNDATSVVLFNAIQSFDLTTIDHRIALQFMGNFLYLFIASTILGAFTGLLSAYIIKKLYFGRHSTDREVALMMLMAYLSYMLAELFYLSGILTVLFCGIVMSHYTWHNVTESSRVTTKHAFATLSFVAEVFLFLYVGMDALDIEKWRFVSDSPGTSVAVSSILLGLIMVGRAAFVFPLSWLMNFAKKSHSEKVSLNQQVVIWWAGLMRGAVSMALAYNQFTRSGHTQLRGNAIMITSTTTVVLFSTMVFGLLAKPLIMFLLPQPKHFTSCSTVSDLGSPKAYLPLLEGHQDYEVDVGNHDDGTEPTIARPSSLRMLLNAPTHTVHHYWRKFDDSFMRPVFGGRGFVPFVPGSPTEQSTHNLADRT

SEQ ID NO: 82764 - protein, 548 aa, Pseudomonas stutzeri
MSHILRAAVLAAMLLPLPSMADQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFDFVRGYAPERVNSWMTDSADNSFCVGELWKGPSEYPNWDWRNTASWQQIIKDWSDRAKCPVFDFALKERMQNGSIADWKHGLNGNPDPRWREVAVTFVDNHDTGYSPGQNGGQHHWALQDGLIRQAYAYILTSPGTPVVYWSHMYDWGYGDFIRQLIQVRRAAGVRADSAISFHSGYSGLVATVSGSQQTLVVALNSDLGNPGQVASGSFSEAVNASNGQVRVWRSGTGSGGGEPGALVSVSFRCDNGATQMGDSVYAVGNVSQLGNWSPAAALRLTDTSGYPTWKGSIALPAGQNEEWKCLIRNEANATQVRQWQGGANNSLTPSEGATTVGRL

SEQ ID NO: 82765 - protein, 391 aa, Ginkgo biloba
MAASAMTASYQSLHFCLQSKNMASPECILKSFSLPCSRFNGASTSLGASNGQYMGFRGHLRKGLLSSRGVMSSGSLNTVAQLVSEAETVKEKKDFEFDFKKYMYSKAISVNEALDKAVPTHYPEKIHESMRYSLLAGGKRVRPTLCIAACELVGGTEDLAMPAACAMEMIHTMTLIHDDLPCMDNDNLRRGKPTNHKAFGEDTAVLAGDALLSFAFEHIARSTSKTVESERVLRVICELGKSMGSEGLVAGQIVDIASEGDTSVDLKTLEYIHLHKTAVLLECSVVSGAIIGGASEEEIERTRRYARCVGLLFQVVDDILDVTKTSEELGKTAGKDLISDKATYPKLMGLEKAKEFAVELVNKAKEELSYFDPVKAAPLLGLADYIAFRQN

SEQ ID NO: 82766 - protein, 312 aa, Solibacter usitatus Ellin6076
MIDTDTASDDAVALIMALRNPSVFVRAITTVAGNVPVAQATRNALYVAQLCGSDVPVYQGAARPLWREHAHAEWFHGKDGLGDHGYPAPARAAEPGNAADAIIAAIEQHPGIVVVTLGPLTNMAVALAKAPDIAAKVGRCVVMGGNPCCEGNVTPAAEYNMWVDPEAARIVLRSGLPVELAGWHLCRGEAVLGAADIEHVLSLNTPLARFAVECNSRAMDAYRIQTGELGISLPDPVAMSIALDPVVCTQLSSHYVDVEVSSELTRGMTVVDRLNVSGDERNSPVWRGTLQAQVVWTIDNERWKQALYAALG

SEQ ID NO: 82767 - protein, 818 aa, Candidatus Blochmannia floridanus
MRVLKFGGTSLSNASQFIHVANILEKNAQKEQIAVVLSAPARVTNYLVEAINNTLRGNNILESVLNIENIFNTLLKDIAQFQSKFNYVVFHNTLKQEFNSLKQLLQGISLLNFCPDSVNAHIICLGEKWSVILMQGILIAKDLKIINLDPVKSILTQGDGYSTSVVNIEESTCRIHNVLLSHYADIILMAGFMAGNKKGELVTLGRNGSDYSAAILAACLQARRCEIWTDVDGIYTCDPRQVPDARLLHELSYQEAMELSYFGAKILHPRTIVPIAQFHIPCLIKNTSKPDFSGTLISAKNKDINIIAKGITYLKDMVMINVSGPGMKGMIGMAARVFAAMSRATCSVVLITQSSSEYSISFCVPYQEYAKACDALDEEFNLELKNGLLEPIGVICDLAIISVVGDGMRTQLGLSGKLFGALARASINIIAISQGSSERSISVVVKNNVTTIGVKAVHQTLFNTDQIIEVFIIGVGGVGSALIEQIKKQYSWLKNKHIDLRVCGIVNSQVMLTDSDGINLNNWKSLLIQSCKSSDLEKLIITIKQYHLLNPVIVDCTSSEKVANYYVNFLSGGCHVIAPNKKANTGPIGYYRKLRETMVIARRKFLYDTNVGAGLPVIENLQNLLNAGDELIKFSGILSGSLSYIFGKLDEGLSLSEATILAKKNGYTEPDPRDDLSGMDVARKLLILAREVGYVLEMKDIKIEPVIPDNFIKNDVISVDNFFEKLLSLDNMFTLKVKKARESGCVLRYIGNIQEGKCCVKMESVNDEHPLFQVKDGENALAFLTKYYQPLPLILRGYGAGNNVTAAGVFADLLRTVY

SEQ ID NO: 82768 - protein, 443 aa, Candidatus Blochmannia floridanus
MKLYNIKQREETVNFLHALIQGLGKNQGLFFPVDLPRFSISEIDNLLGMQFVERSAYILSKFIGSEFSQNCILNCVEKAFNFPVPLNFIKKNVAILELFHGPTLAFKDFGSRLMAQMLLITMETHRYEQEKPMVILTATSGDTGAAVAHAFYGLDNIHVIILYPRNKISILQEKLFCTLGENISTISVEGDFDICQDLVKKSFNDDLLKKMLYLNSANSINISRVLAQVCYYFEALAQIDYERRYHNNLIISVPSGNFGNLTAGLLAQSSGLPIKNFIAATNINDTVPRFLTSGLWNPLPTISTFSNAMDVSCPSNWSRIEELFRRENRSIFELQFGSVNDELIKKTVQEVANLGYICDPHTAVAYRLLDDQLCSDEFGICLGTAHPAKFKELVECFLEDKVSLLVPNALKKHMILPVLSHKISGSFAELRDLIYDITVKSDI

SEQ ID NO: 82769 - protein, 289 aa, Glycine max
YWHCCYTDNGLNGFYAGKPFVNVLKEAGVLPGIKVDKGTVELAGTNGETTTQGLDGLGQRCAKYYEAGARFAKWRAVLKIGPNEPSELSIHENAYGLARYAVICQENGLVPIVEPEILVDGPHDIHKCAAVTERVLAACYKALNDHHVLLEGTLLKPNMVTPGSQSAKVSPQVVAEHTVRALQRTVPAAVPAVVFLSGGQSEEEASVNLNAINQVNGKKPWSLSFSFGRALQQSTLKAWGGKEENVKKAQEALLVRAKANSEATLGTYKGNSQLADGASESLHVSNYSY

SEQ ID NO: 82770 - protein, 304 aa, Clostridium thermocellum ATCC 27405
METSMETVIKKAEILIEALPYIQKLYGKTVVIKYGGNAMINEELKTSVMEDITLLKYIGMNPVVVHGGGPDINKALDKFNIKSRFINGLRLTDKATMDVAQMVLVGKTNKEIVSILNQMGGKAVGICGIDGNVIECEQYKTTIDGQETDLGYVGKITNINSKLIELLAKDEYIPVIAPIGIGKDGQSYNINADTVAGEIAAALKAEKLMLLTDVPGVKKNKDSDEIIPALTSAEALELINKKIIDGGMIPKVLGCIEALEKGVGRTHIIDGRIPHCLLLEIFTNKGIGTMIMKEKILYYEGEKL

SEQ ID NO: 82771 - protein, 213 aa, Magnetospirillum magnetotacticum MS-1
SRSDAVTRAAGAIVFEVRRQFREHPGIMTFQERPEYGRVVDICTRDSLRELATPGLLAAFAPIAVGFGLGVGPLAGFLAGAIGAGVLMAVFLANSGGAWDNAKKIVEDGEYGGKGSEAHAATVIGDTVGDPFKDTAGPAINPLIKVMNLVSVLIAPAVVLMSVPEDANHVLRIAIAVVAAAIAFGAVIMSRLRAARVDREESAVERERVATGA

SEQ ID NO: 82772 - protein, 181 aa, Zea mays
  misc_feature (23)..(23): Xaa can be any naturally occurring amino acid
  misc_feature (41)..(41): Xaa can be any naturally occurring amino acid
  misc_feature (58)..(58): Xaa can be any naturally occurring amino acid
  misc_feature (123)..(123): Xaa can be any naturally occurring amino acid
  misc_feature (137)..(137): Xaa can be any naturally occurring amino acid
  misc_feature (144)..(144): Xaa can be any naturally occurring amino acid
  misc_feature (167)..(167): Xaa can be any naturally occurring amino acid
LYQNNGETCASIVGVDYCGAALXNRLSVRYSILTREHYYHXKLDDYCVLLSSGFGMIXNLHNDLAATELLYKQLHNTTMTCPAMAQLLSNTLYYGASSHIRSSMSSRGLESKVIGRAVTYDEXRSYDRTGYSVHATXTTLTMPXLCNSISSPRPLLLPEDDAVTTLXYCEAIDYNDDVFAS

SEQ ID NO: 82773 - protein, 336 aa, Escherichia coli CFT073
MKAAVVTKDHHVDVTDKTLRSLKHGEALLKMECCGVCHTDLHVKNGDFGDKTGVILGHEGIGVVAEVGPGVTSLKPGDRASVAWFYEGCGHCEYCNSGNETLCRSVKNAGYSVDGGMAEECIVVADYAVKVPDGLDSAAASSITCAGVTTYKAVKLSKIRPGQWIAIYGLGGLGNLALQYAKNVFNAKVIAIDVNDEQLKLATEMGADLAINSRTEDAARIVQEKAGGAHAAVVTAVAKAAFNSAVDAVRAGGRVVAVGLPPESMSLDIPRLVLDGIEVVGSLVGTRQDLTEAFQFAAEGKVVPKVALRPLADINTIFTEMEEGKIRGRMVIDFRR

SEQ ID NO: 82774 - protein, 729 aa, Bacteroides fragilis NCTC 9343
MQRAKKNYLIYAVMLLLFGALIYMAIEEGDRFSHHAVASSTVAEDTPFTMFCQFVTDNLHHPLSILLIQIIAVLLMVRLFGFLFKHIGQPGVIGEIVAGIVLGPSVLGYFFPDVFQALFPPESLTNLELLSQVGLVLFMFVIGMELDFSVLKNKINETLVISHAGILVPFFLGIVASYWIYEEYAAAQTAFLPFALFIGISMSITAFPVLARIIQERNMTKTSLGTLAIASAANDDVTAWCLLAVVIAIAKAGTFASALYAIGLTALYIIIMFMVVRPFLKKVGEVYANQEVINKTFVALILLILIISSTLTEIIGIHALFGAFMAGVVMPPSIGFRKVMMEKVEDIALVFFLPLFFAFTGLRTEIGLINSPALWGVCLLLITVAVAGKLGGCAVAARLVGESWKDSFTIGTLMNTRGLMELVALNIGYEMGVLPPSIFVILVIMALVTTFMTTPLLHLVERIFARREERLSAKLKLVFCFGRPESGRSLLSIFFLLFGKKMKAAQVVAAHFTVGTDLNPLNAEQYARDSFSLVDEKASELGLSVENRYRVTDKLVQDMIRLARKERPDMFLLGAGSKYRPDTAGSNGVLWLSLFRDKIDDVMEQVKCPVAVFVNRGYSGSSPVSFVLGGVIDAFLLTYLESMLEGGAQVHLFLFDTDDEAFRQSTDPILAKYSSQIRTQPFSGAANLTSAAKDGLLVMSHLSYTKLSEEEEVFRDLPSLLVIRRPKKG

SEQ ID NO: 82775 - protein, 383 aa, Deinococcus radiodurans R1
MAAGYFVATGARDEPAGEMGASHFLEHLMFKGSERLSAAALNEQLDNLGGQANAFTAEEATVYHAAALPECTGELLATLTELLRPALRPADIDPERGVILEEIAMYAEQPGVRVAEALRRDYWGEHPLAHQILGTPETLRRLDRPALQRHFAERYGAERVTLVLSGAFDPAEVRAWAERELAGWPSGTPRLPDAAPAPHWPGQVRWVTDPELTRTQVALALPGLPVSHPLREAAGLLAELIGGENGALYWALLDTGLADSADLGHIEYRDAGVFEGGFSCDPDRAQEALDRFRAVLDSAESLITDLSVRRAARKAAVSLLLRSETPQGRLFLLGMEHLATGELRTPAQLAERYAAITPEQVREVLRLCPLRDPSVVVLGPPTP

SEQ ID NO: 82776 - protein, 325 aa, Hyphomonas neptunium ATCC 15444
MTEQNAYAIRIQKTGGPEVLAAEAIAPRAPGAGEALVRQTAVGLNFIDTYHRSGLYPMKLPATLGSEAAGVVEAVGEGVTHLKAGDRVAYLAGGTYATHYTGAAASMVSLPDFVSDEEGAALMLKGLTAWMLLFEIRPVKAGDTVLIWAPVGGVGTILTPWAAHLGARVIGVTSSEEKAAKAKALGAAEVVVGYDGVAEKVRALNGGKGVDIAFDSVGKISAEGSLGSLKPRGWFITYGNASGPVDPIPPARLAQGGSLIMTRPGVFTFLQPPGALARGAGLVFEALKAGVFKADIGQRFALKDVAEAHKALESGKTTGATILTP

SEQ ID NO: 82777 - protein, 289 aa, Gossypium hirsutum
MEGKEEDVRLGANKFTERQPIGTAAQSQDDGKDYTEPPPAPFFEPGELTSWSFYRAGIAEFVATFLFLYITILTVMGVVKEKTKCPTVGIQGIAWAFGGMIFALVYCTAGISGGHINPAVTFGLFLARKLSLTRAIFYMVMQCLGAICGAGVVKGFMGKTQYGMLGGGANSVAHGYTKGDGLGAEIVGTFVLVYTVFSATDAKRSARDSHVPILAPLPIGFAVFLVHLATIPITGTGINPARSLGAAIIFNKDKGWDDHWIFWVGPFIGAALAALYHVVVIRAIPFKSK

SEQ ID NO: 82778 - protein, 578 aa, Solibacter usitatus Ellin6076
MNPTAQIIVLDAGGQYCHLIARKVRDLGVYAEVRASETPAAELAAAKGIIISGGPSSVYDPESPTVDPDIFSLGIPVLGICYGQQLMAHLLGGEVRPGQKGEYGLATLDLAETGDPLFGGLGGTQQVWMSHRDVVGRAPEGFAVTGRTGTCEIAAIADPKRRFYAVQFHLEVVHTPRGKEYLANFTFRVCGCVPDWDPRNRVPMLEQEIRECVGERSVFFFVSGGVDSSVAFALCTRALSADRVRGVYVDTGLMREGETDFVRRIGNLTVEHAEDQFLTALSGVTDPETKRHIIGEEFVRVQERIIESRHLMNENWILGQGTIYPDTIESGGTAKAALIKTHHNRVAGIQKLIACGRIVEPLKSFYKDEVREVGRELGLSSELLDRHPFPGPGLAIRCLCSEFDAPVRATAEGLIVPVHSVGVQGDSRTYAPVLAIDALDHSRATELINAIAGVNRVIAPVETAAPASEMQVRACSLTEERLKRLRRADSIVRRLSHASGYDHQVWQFPVILIPLGTQGAPDSVVLRPVDSVDGMTAQSVLMDAELSHAICAEVLQIGGIAGVFYDLTHKPPGTIEWE

SEQ ID NO: 82779 - protein, 170 aa, Thermus thermophilus HB27
MRHVISVLVQDHPRVLNRITGLFARRGFNLESLAVGTTHQPGLSRICLVVSGDDRTLEQVEKQLNRLIEVLKVTDHTEPHVERELCLVKVHVAGLEERLAVKDIQEAFRARVVDVAQKSLILELTGDTQKVNSFIEALRPYGILEVMRTGAVAMSRGDRVLKVREKKEAV

SEQ ID NO: 82780 - protein, 140 aa, Xanthobacter autotrophicus Py2
MAIERTFSIIKPDATRRNLTGAVNAVIETAGLRIVAQKRILMTKAQAETFYAVHSARPFFGDLVSFMTSGPVVVQVLEAENAVAKYREVMGATNPANAAEGTIRKLLAESIEANSAHGSDSVENAAVEIAQFFSGNEIVG

SEQ ID NO: 82781 - protein, 483 aa, Rhodococcus sp. RHA1
MGDPSGFLKHTSRELPVRRPVPLRLLDWNEVYEEFSPDTLKTQASRCMDCGIPFCHNGCPLGNLIPEWNDLVYRDRWHDGIERLHATNNFPEFTGRLCPAPCEASCVLGINQDPVTIKQVEVELIDRAFDEGWVKPVHPTRSTGKKVAVVGSGPAGLAAAQQLTRAGHMVTVFERADRIGGLLRYGIPEFKMEKRHIDRRLDQMNSEGTVFKTGVNVGVDITADALREQFDAVVLAGGATEARDLPIPGRELDGIHQAMEFLPIANRVQLGDLEKPTITAEGKKVVIIGGGDTGADCLGTSHRQGAESVHQFEIMPRPPETRAEHTPWPTYPLMYRVASAHEEGGERLFSVNTERFVGVDGKVTALKAHEVEMKSGRFEKVEGSDFELEADLVLLAMGFVGPEKPGLLTDLGVDLNERGNVARSAKWATNVDGVFVAGDMGRGQSLIVWAIAEGRSAAAAVDAYLEGESALPSPIETTTAPQR

SEQ ID NO: 82782 - protein, 454 aa, Salmonella enterica subsp. enterica serovar Paratyphi B str.
MSFDSLGLNPDILRAIAEQGYREPTPIQQQAIPAVLEGRDLMASAQTGTGKTAGFTLPLLQHLITHQPHAKGRRPVRALILTPTRELAAQIGENVRDYSKYLNIRSLVVFGGVSINPQMMKLRGGVDVLVATPGRLLDLEHQNAVKLDQIEILVLDEADRMLDMGFIHDIRRVLAKLPAKRQNLLFSATFSDDIKALAEKLLRNPLEIEVARRNTASEQVTQHVHFVDKKRKRELLSQMIGQGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRITTPGYEPDPSIKAEPIQNGRQQRGGGGGRGRGQNQGGAGRSQQPRRQDSGAAKAKPKPRTGEGKPAGDKARPPRRPRRITPAQ

SEQ ID NO: 82783 - protein, 263 aa, Triticum aestivum
MVAWRESYLDLILIPLGLLLPALYHAWLWRAVRRRPLSTAFGVYSAARRLWAAGMMRDNDDKKGVLVVQSFRNVIMGSTLMATTSVLFCTGIAAVLSSTYSVKKPLSDAVFGAHGEYMMALKYVALLLVFLFAFLCHTLTICFLNQASFLINTSCLPLPDAGKDDDGARLVGVQLPAGAVSYYVGEILERSFTLNFVGNRLFYAGVPLLLWIFGPLLAFLSSLVMIPILYNLDMVNVAADRGAKEHSSGCINGKANGNGFMQV

SEQ ID NO: 82784 - protein, 182 aa, Medicago sativa
VQQRPAHEHAPRRVKSTLLLDKLDDISHQWIDSDILIFNTGHWWVPSKLFHTGCYFQVGRSLKLGMSIPAAYKIALKTWTSWIERKIDKNRTRVFFRTFEPSHWSDDTRRTCNVTQFPTFETNATEQNSFSDTVLEVVKNVNFPINVLHVTSMSAPRSDAHVGNWNDNPLSQDCSHWCLPGS

SEQ ID NO: 82785 - protein, 488 aa, Burkholderia sp. 383
MIWEGRNDRLYIGGEWVKPDSTHFVDLVSPLTEETMASVISASKVDADAAVAAARRAFDHGPWPRMSLHQRMEVMARLRELLIEHESLIAHLVTEEMGCPISISRWMQAGGPISMLGMFLEVAPHYPFSQIRRTVTGNGLVLREPLGVVAAVVPWNAPLQIAVLKLAPALLAGNTAILKPAPETPLDACLLAELAEKAGLPKGVLNVLPADREVSEYLCLHPAVDKVSFTGSSAAGQRLGALCGNDIKRITLELGGKSPAIVLDDADIGKAVESLRMGSLRNSGQVCSNKTRLLVSKHRKDELIDAFVEMVRSMPVGDPFDPLTQIGPLVSARQRDRVEGYIAKGKQEARLVLGGGRPKGLTRGWFVEPTIFADVDPDAVIAQEEIFGPVISILSFDTDDDAVAIANNSAYGLHGAVFSADTERAVNVARRVRTGAIDINGASAGYHSPLGGRKKSGIGREAGIEGFDGYVEIKSIGIPVSYAEQLSS

SEQ ID NO: 82786 - protein, 400 aa, Clostridium thermocellum ATCC 27405
MQLEEIINLDKKYFMNTFGNRTPVCFSHGKGINLWDINGKKYYDFLAGIAVNALEHSHPKLVNAIKQQAEKLIHCSNLYYIESQAKLAEKLVSISCADKVFFANSGAEANEGAIKLARIYFKKKGMPEKYEIITLEKSFHGRTLATIAATGQDKYQKPYCPLTPKFLKVPINDLEALEKAINSSTCAVMIEPIQGESGVNLTSVEYMKGVRKLCDEKGILLIFDEVQCGLGRTGKLFAYEHFGVEPDIFTLAKALGGGFPIGALCAKEHVASAFEPGDHGSTFGGNPLACTAALAALDVIIEEGLVENSAKMGTYFMSKLSELAEKYSIIQEVRGKGLMIGVQLSIDAAVEIKNKCFEKGYLIGSIGNNILRMLPPLIVTEQDIDGMIDTLDSVFQEYQI

SEQ ID NO: 82787 - protein, 330 aa, Salmonella enterica subsp. enterica serovar Paratyphi B str.
MSQSKPRLKTSAMIASIADEGQATIPAPFGVALSKLAAQRPEIVGMTADLSKYTDLHIFAQAFPDRFFQMGMAEQLLMGAAGGMAKEGFIPFATTYAAFATRRAYDFIHQVIAEEHLNVKICAALPGLTTGYGPSHQATEDLAIMRGIPGMVIVDPCDALEIEQAVPAIADHNGPVYMRLLRGKVPLVLDKYDYQFELGKAKLLEDGNDVLIISSGLMTMRALEAVEKLRADNISVAVLHVPTIKPLDEKAIIEQASKPGRLVMTAENHTSVGGLGEAVAALLMRKGVRCELDTVGLPDEFLLAGALPTLHDRYGISTAMMVEKIKHRLR

SEQ ID NO: 82788 - protein, 354 aa, Clostridium thermocellum ATCC 27405
MKSVLVLEDGTYFTGEAFGKTGEVVGEIVFNTCMTGYQEILTNPSYNGQIVAMTYPLIGNYGFNRYDNESDRIHVQGFIVKELSDTPTNWRCEITPEEYFVTNGIVGIKGIDTRNLTKHIRSKGSMHGIISTESGNIDLLLEKLMKKKTEKKNAVMEVSTKSPIHKPGRGKRVVVMDFGVKHSIIKALEKLDCDIYILPASSPANEIMSYNPDGILLSNGPGDPSELPFVKSTVQELIGKKPMLGIGLGHQLLGLALGGKVKKLPFGHHGANQPVRDYIKGKCYVTSQCHNYALENDFSDDIFITHININDNTVEGFKHKHHPVLGVQYHPKAILGQDDSSYIFDEFIKMMDNL

SEQ ID NO: 82789 - protein, 382 aa, Candidatus Blochmannia floridanus
MKTALLVLEDGSQFYGKSIGANGESVGEIVFNTSMTGYQEIITDPSYAHQIVVLTYPHIGNIGTNDFDNESDHIQVSGIVIRNLTIISSNFRYNRSLSNFLRCQNIVGISDVDTRRLTRLIREKGTQRACIMANSELDAKLALCKACTFLGSNKLKLAYSVSTSQQYIWNQGTDRYDGKYSSDEIIPKKFFYRVVVYDFGIKYNIMRILVDYGCLLIVVPANTVAQEVVNLKPDGILLSNGPGDPNEYQDVIHVIRFFLSKTNIPMLGICLGHQLLALASGAKIIKMKFGHHGSNHPVKNVETNKVMITSQNHNFVVDIETLPNTMKVTHISLFDGTLQGIRYLDRSVISFQGHPEASPGPHDSVSIFNDFIQLIKKYRNKK

SEQ ID NO: 82790 - protein, 307 aa, Clostridium thermocellum ATCC 27405
MEHLISLHDLTVEDFESIFKLAEKLKRQQKEGIPHHLLKGKTLGMIFTKSSTRTRVSFEVGMYQLGGYPLFLSANDIQLGRGETIYDTAQVLSRYVDGIMIRTFAQSDVEDLARYGNVPVINGLTDLMHPCQILADLFTIYEHKGTLKGLKLAYVGDGNNVANSLLHGCAKVGMDIAVASPKGYECDSRIVEEAKEDAKASGANILLTEDPEEAIKDADVVYTDTWVSMGQESEKEERIKVFMPYQVNNTLFSKAHEDAIFLHCLPAYRGYEVTEDVIDGSQSVIFDEAENRLHVQKAIMALLMGNK

SEQ ID NO: 82791 - protein, 249 aa, Salmonella enterica subsp. enterica serovar Paratyphi B str.
MLLKDKVAIITGAASARGLGFATAKLFAENGAKVVIIDLNGEASEAAAAALGEGHLGLAANVADEVQVQAAIEQIMAKYGRVDVLVNNAGITQPLKLMDIKRANYDAVLDVSLRGTLLMSQAVIPVMRAQKSGSIVCISSISAQRGGGIFGGPHYSAAKAGVLGLARAMARELGPDNVRVNCITPGLIQTDITAGKLTDEMTANILAGIPMNRLGDAVDIARAALFLGSDLASYSTGITLDVNGGMLIH

SEQ ID NO: 82792 - protein, 466 aa, Xanthobacter autotrophicus Py2
MQAQVPGRRPDPAAALGVTDEAADYVTAFGVPEVVEVLLPDTSAVLRGKWIPGHSLGKIWKDGVAIPLSIFGLDVWGCEVDATEIHMETGDKDGLCWPVPGTLKPVPWASRHTAQVLITMHEPDGSARGRPWKLDPRQQLAAVVERFAARGLTPCVAFELEFYLLKPSDVPGAPPEPVFQATGQARQNMYAMSDLDAYAEVLHDMRAACVTQGLPADTVIAEAAPGQFEVNLYHKVDALGAADDAVLLRRLIDGVARRHGLKATFMAKPLADFAGNGMHVHASLMEHGGGNLFAREDGVGDTALRHAAGGMLASMADATLIFVPSFNGYRRLVPGSYAPTSASWGFDNRLVAVRVPNGPRHARRLEHRIAGAEAHPHLVLAAILAGMLDGLERGIEPPPPLEGNAYEQIGEPLSPDMEVAVDRFAASDFIARTFGEDYRRIYEAMKREELAAFRRVILPLEYETYL

SEQ ID NO: 82793 - protein, 557 aa, Ustilago maydis 521
MSILLPTVHSSFEHLTPTHVAIASVLILGLLCLIAPDRYIFVSHRKGIKEVPGALPLIGNLLFLLDIAAKRRRFLDEFLRMQKSIGAGGMPWAATFPYLGGRVTSINRPEYIRWVQKTNFENYIKGSFFQKSMGDVMSLHGIFVADGEIWRKQRKMASHIFSVGNFRTHVQNTIHRDLAILNKLFRDASSKNTELNLPDLFFRFTLSSFSLMAFSADIKCLPSNVGDLSKVVEFAANFDYAQRVMDERFVDPLARFTELFSPQGRKMRRTIKELHSFCYEIIDLRLAARARGEAQAASGKGDKDLLALFMEQNLTRDELLPVVLNFLIAGRDTTAQALGWLFYELSKHPECIEKARQEIHEKLGSGSSFQSMAYDDLSSLVYVQACFLEALRLHPSVPKNIKLAVKDDVIRPYAQPCSDADVAPNAVPTTQKLPDLVIKKGETVTWQDHTMARMPELWGEDCEQFKPERFIEERKDGSIGIKTYSQYLFHAFNAGPRLCLGQTLATYEGCAVVAEILGNFDVVYDHKALKEDEPTYDDSLTLPIKNPYTIHVRARDD

SEQ ID NO: 82794 - protein, 840 aa, Saccharomyces cerevisiae YJM789
MKLQQKPKPAPLTSENNVPLKSVKSKSSMRSGTSSLIASTDDVSIVTSSSDITSFDEHTSGSGRRYPQTPSYYYDRVSNTNPTEELNYWNIKEVLSHEENAPKMVFKTSPKLELNLPDKGSKLNIPTPITENESKSSFQVLRKDEGTEIDFNHRRESPYTKPELAPKREAPKPPANTSPQRTLSTSKQNKPIRLVRASTKISRSKRSKPLPPQLLSSPIEASSSSPDSLTSSYTPASTHVLIPQPYKGANDAMRRLKTDQDSTSTSPSLKMKQKVNRSNSTVSTSNSIFYSPSPLLKRGNSKRVVSSTSAADIFEENDITFADAPPMSDSDDSDDNSSSSDDIIWSKKKTAPETNNESKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRSFLDACFEINPEKRPTANELLSHPFSEVDETFNFKSTRLAKFIKSNDKLNSSKLRITSQENKTE

SEQ ID NO: 82795 - protein, 398 aa, Bradyrhizobium sp. ORS278
MNIHEYQAKALLHEFGVPISKGVPVLRPEDADAAAKTLGGPVWVVKSQIHAGGRGKGKFKEASAGDKGGVRLAKSIDEVNTFARQMLGATLVTVQTGPDGKQVNRLYIEDGSDIDKEFYLSLLVDRETSKVAFVVSTEGGVNIEDVAHETPEKIVTFSVDPATGVMGHHGRAVAKALKLSGDLAKQAEKLTTQLYNAFVAKDMAMLEINPLVVTKQGQLRVLDAKVSFDSNALFKHPEVVALRDETEEDAKEIEASKYDLNYVALDGTIGCMVNGAGLAMATMDIIKLYGMEPANFLDVGGGASKEKVAAAFKIITADPNVKGILVNIFGGIMKCDVIAEGVVAAVKEVGLKVPLVVRLEGTNVDLGKKIISESGLNVLPADNLDDAAQKIVKAVKGG

SEQ ID NO: 82796 - protein, 286 aa, Gossypium hirsutum
MAKDIEVGGEFQAKDYHDPPPAPLVDAQELAKWSFYRAVIAEFIATLLFLYITVLTVIGYKTQTDPAKGGEDCGGVGILGIAWAFGGMIFILVYCTAGISGGHINPAVTFGLFLARKVSLVRAIFYMGAQCLGAICGCGLVKAFQNSYYNQYGGGANSLAEGYSTGTGLAAEIIGTFVLVYTVFSATDPKRNARDSHIPVVLAPLPIGFAVFMVHLATIPITGTGINPARSLGAAVIFNQDKIWDDHWIFWVGPFIGAAIAAIYHQFILRASGAKALGSFRSSFAM

SEQ ID NO: 82797 - protein, 480 aa, Deinococcus radiodurans R1
MPLWRGGTLRSDMDTFDVLVIGGGPAGYVAAIRAAQLGFKTACVDAFERGGKPSLGGTCLNVGCIPSKALLDSSERFEMISHDTAEHGIQVAQPQIDVSKMLARKDGVVDKLTGGVAFLFRKNKVTSFHGYGKLVRQDGQEWVVDAAGTEVKAKNVIVATGSNPRALPGVPFGGHIVENSGALQIDQVPGKLGVIGAGVIGLELGSVWRRLGAQVTILEAMPGFLMAADDAIAKEALKQFQKQGLDFHFGVKIGEIKQDDSGVTVTYEENGSQVTAQFDKLIVSIGRVPNTGGLNADGVGLALDERGFVKVDQHYRTNLPGVYAIGDVIGGAMLAHKAEEEGVALAEMIAGQAGHVNYDVIPWIIYTSPEIAWAGLTEKQAKERGLNVKTGQFPFSANGRALGHGDPRGFVKVVADAQTDKLLGVHMIGGGVSELIGEIVAIMEFGGSAEDLARTIHAHPTLSEVVKEAALAVDKRAIHM

SEQ ID NO: 82798 - protein, 413 aa, Bradyrhizobium sp. ORS278
MTDIRVPTLGESVTEATIGRWFKKAGDAVAVDEPLVELETDKVTIEVPAPSAGTLGEIIAKDGETVAVGALLGQINDGAAAAKPAAAAPAPAPAKPAAAAPAPAPAPAKALPADTPQAPSVRKLSAESGVDATTVPGSGKDGRVTKGDMLAAIERAASAPTPVNQPAASVQVRAPSPADDAAREERVKMTRLRQTIARRLKDVQNTAAMLTTFNEVDMTHVMALRSQYKDVFEKKHGSKLGFMGFFTKAVVQALKDIPAVNAEIDGSDLIYKNYYHIGVAVGTDKGLVVPVVRDCDHKSIADIEKGIADFGRRARDGQLKIDEMQGGTFTITNGGIYGSLMSTPILNAPQSGILGMHKIQERPMVVGGKIEVRPMMYLALSYDHRVIDGKEAVTFLVRVKESLEDPARLVLDL

SEQ ID NO: 82799 - protein, 467 aa, Bradyrhizobium sp. ORS278
MATYDLVVIGTGPGGYVCAIRAAQLGMKVAVVEKNATLGGTCLNVGCMPSKALLHASELFEEAGHSFAKMGIKVSAPEVDLPSMMNFKQQGIDGNVKGVEFLMKKNKIDVLQGKGKILGTGKVQVTGNDGAAQTVETKNIVIATGSDIARLKGIEIDEKRIVSSTGALALDKVPSSLLVVGAGVIGLELGSVWRRLGAKVTVVEFLDRILPGMDLEIAKQFQRILEKQGFAFKLGAKVTGVDTSGAKLSATIEPAAGGAAEKIDADVVLVAIGRVPYTDGLGLQEAGVALDNRGRVQIDHHFATSVPGVYAIGDVVAGPMLAHKAEDEGVACAEILAGQAGHVNYDVIPGVVYTTPEVASVGKTEDELKQAGIVYTVGKFPFTANGRSKVNQTTDGFVKILADAKTDRVLGAHIIGREAGEMIHEAAVLMEFGGSAEDLARTCHAHPTRSEAVKEAALAVGKRAIHM

SEQ ID NO: 82800 - protein, 111 aa, Zea mays
  misc_feature (51)..(51): Xaa can be any naturally occurring amino acid
ARRGRVAEKNYPDLTSTTFFHSRWNYIISGPAKAMGRKAKRAVTTGRKIIXGTNPLASEPGTIRGDFDVHIGRNVIHGSDSLERATEEIALWIPEGPADWQSSQHPWIYEK

SEQ ID NO: 82801 - protein, 613 aa, Bacillus sp. TS-23
MNNVKKVWLYYSIIATLVISFFTPFSTAQANTAPINETMMQYFEWDLPNDGTLWTKVKNEAANLSSLGITALWLPPAYKGTSQSDVGYGVYDLYDLGEFNQKGTIRTKYGTKTQYIQAIQAAKAAGMQVYADVVFNHKAGADGTEFVDAVEVDPSNRNQETSGTYQIQAWTKFDFPGRGNTYSSFKWRWYHFDGTDWDESRKLNRIYKFRSTGKAWDWEVDTENGNYDYLMFADLDMDHPEVVTELKNWGTWYVNTTNIDGFRLDAVKHIKYSFFPDWLTYVRNQTGKNLFAVGEFWSYDVNKLHNYITKTNGSMSLFDAPLHNNFYTASKSSGYFDMRYLLNNTLMKDQPSLAVTLVDNHDTQPGQSLQSWVEPWFKPLAYAFILTRQEGYPCVFYGDYYGIPKYNIPGLKSKIDPLLIARRDYAYGTQRDYIDHQDIIGWTREGIDTKPNSGLAALITDGPGGSKWMYVGKKHAGKVFYDLTGNRSDTVTINADGWGEFKVNGGSVSIWVAKTSNVTFTVNNATTTSGQNVYVVANIPELGNWNTANAIKMNPSSYPTWKATIALPQGKAIEFKFIKKDQAGNVIWESTSNRTYTVPFSSTGSYTASWNVP

SEQ ID NO: 82802 - protein, 1267 aa, Oryza sativa
MHQTSSQLVLASFLLLLCHHAHADCEPATCGNLTINPPFWLDEPGRPPCGPPTFQLQCRGSEAFVAHSFFQTYQVVRIFTGNSSVVVVDRSLPLESGCPVPWFNISIGFVMGPFLISRANKELVFVHNCTTTKRRPPQGFRRMPCSPDESFVFLGDGRPRLLLPGCSMSVVPVLGLQDGDYVASMRRGLLLEWMLVPGDCQKCSASGGQCEYSSDGMGFSCKCPSGVHNPTSCVAGGCISPIPDSKSNGRKKTLIAPKRYKYSEVAKITSFLSNKLGEGGYGVVFKGKLQDGRLVAVKFLHDSKGNGEEFVNEVMSIGRTSHVNIVSLFGFCLEGSKRALIYDYMPNSSLDNYIYSEKPKETLGWEKLYDIAIGIARGLEYLHHGCNTRIVHFDIKPQNILLDQDFCPKIADFGLAKLCCTKESKLSMTGARGTIGFIAPEVLYRSFGVVSIKSDVYSYGMMLLEMIGGRKNVKSMVQNSSEKYFPDWIYDHFYQGDGLQACEVTSEVEEIAKKMTLIGLWCVQVLPMHRPTITQVLDMFEKALDELDMPPKQSFCESLEHPVHKLNAESTSSATDKAYASPAHRCRNSPSADLTAVITEPDRVGTILCSATPFVAKAAKSAFTPATELWPVTAMAAARRALRHLHGFRVVVLFGCGGRYAWAVKAIGPKVRRTAAAHPRRKTEAGACWGRERRPVLFATASSSSSLSLLTGGGARGRRLRPTHAGREGTAPCDLRRGIVVVVVADPAAARARRKTEAGTQTEGGRRWSSPACGGRAAASRARRKEEAGARGVVTARRRSSPARGREAPPPPDLRLIYPAATGSTACTPPWPELHHHRCSSSSSSSPSPPRQLGATAPTARRCRSHKSAPPRAPSDRRRRLLSSPPPPPQIVAAAPSDRRRLGPPQIAAAAALHHNEWALAGQCLTPPPPPPQLAAAAPLASRRHTRRSSPPLHARSQWPPSSPSLSPHHSSEPVAAVVPVALAPPLVGAGGHRRGGGGDDEELGDGCGEQEGERERWRGGRCRRRGSRCWLRTPAAEEDDDGAASARVVLKLASLAAPLWLPALVGLLIGCPASPTTGFAAASSTLRLADHRIRAPPPSPAPRGCLLLSLFLLQAPGYQVPGTKHQGTRYQVSRVSGTRYQSGEEETAGFFCFCGGGGGATCAHRQGGGGSSGQGRRRPWRGARGRRGEAPAPAATRALVEEAAPQRVEAAPQRAEDDVVEVRRDHPRRRPYLTDAVTSSSMAAGDDDDPFLLSSFISALSFSSPV

SEQ ID NO: 82803 - protein, 589 aa, Flaveria pringlei
MESILKQMKEGESVVDPSSAVGGGVDDVYGEDRASEDQLITPWTVSVASGYTLLRDPHHNKGLAFTERERDSHYLRGLLPPAVATQELQEKKLMQNIRSYEVPLHRYVAMMELEERNERLFYKLLIDNVEELLPVVYTPTVGEACQKYGSIFKRPQGLYISLKEKGKILEVLRNWPERNIQVIVVTDGERILGLGDLGCQGMGIPVGKLALYTALGGVRPSACLPITIDVGTNNQKLLDDEFYIGLRQKRATGKEYYDLLEEFMSAVKQNYGEKVLVQFEDFANHNAFELLAKYRTSHLVFNDDIQGTASVVLAGLVASLKLLGGSLADHTFLFLGAGEAGTGIAELIALEISTKANIPIDEARKKIWLVDSKGLIVSSRKETLQHFKKPWAHEHEPLSTLLDAVKAIKPSVLIGTSGVGQTFTQNVVEAMAAFNERPLIMALSNPTSQAECTAEQAYTWTQGRAIFSSGSPFDPYEYNGNLFIPGQANNAYIFPGLGFGLVISGAIRVHDEMLLAASEALANQVTQEHYDKGMIYPPLTNIRKISAHIAANVAAKAYDLGLATRLPRPTDLVKYAESCMYTPNYRSYR

SEQ ID NO: 82804 - protein, 258 aa, Zea mays
  misc_feature (68)..(68): Xaa can be any naturally occurring amino acid
  misc_feature (163)..(163): Xaa can be any naturally occurring amino acid
MQLLIANFTEFQLATVITFLLHETVFFLSGLPSLLFERFGLFAKYKIQILLSFPLELELGYSLRKHNXTQKRSNTSAYQNRCVLRLILYHVSVNLPVMILSYPAFKFMGLRSSLPLPHWTVVVSQVLFYFVLEDFIFYWGHRALHTKWLYKHVHSVHHEYATXPFGLTSEYAHPAEILFLGFATVVGPALTGPHLFTLWLWMVLRVLKTVEAHTGYHFPWSPSNFLPLYGGSDFHDYHHRVLYTKSGNYASTFVYMDW

SEQ ID NO: 82805 - protein, 589 aa, Flaveria pringlei
MASTLKQMKEGESVVDHSSAVGGGVDDVYGEDRASEDQLITPWTVSVASGYTLLRDPHHNKGLAFTQRERDSHYLRGLLPPAVATQELQEKKLMQNIRSYEVPLHRYVAMMELEERNERLFYKLLIDNVEELLPVVYTPTVGEACQKYGSIFKRPQGLYISLKEKGKILEVLRNWPERNIQVIVVTDGERILGLGDLGCQGMGIPVGKLALYTALGGVRPSACLPITIDVGTNNQKLLDDEFYIGLRQKRATGKEYYDLLEEFMSAVKQNYGEKVLVQFEDFANHNAFELLAKYRTSHLVFNDDIQGTASVVLAGLVASLKLLGGSLADHTFLFLGAGEAGTGIAELIALEISTKTYIPIDEARKKIWLVDSKGLIVSSRKETLQHFKKPWAHEHEPLSTLLDAVKAIKPSVLIGTSGVGQTFTQDVVEAMAAFNERPLIMALSNPTSQAECTAEQAYTWTQGRAIFSSGSPFDPYEYKGNLFIPGQANNAYIFPGLGFGLVISGAIRVHDEMLLAASEALANQVTQEHYDKGMIYPPLTNIRKISAHIAANVAAKAYDLGLATRLPRPADLVKYAESCMYTPNYRSYR

SEQ ID NO: 82806 - protein, 336 aa, Xylella fastidiosa 9a5c
MALKHFLNTQDWSCSELNALLTQARAFKHNKLGNGLKGKSIALVFFNASMRTRSSFELGAFQLGGHAIVLQPGKDAWPIEFDTGTVMEAETEEHICEVARVLGHYVDLIGVRAFPKFLDWTYDRQDIVLNGFAKYSPVPVINMETITHPCQELAHIMALQEHFGTTDLRGKKYVLTWTYHPKPLNTAVANSALTIATRLGMDVTLLCPTPDYVLDERYIDWAQQNIADTGSTFQVSHDIDNAYRGADVIYAKSWGALPFFGNWAMEKPIRDQYRHFIVDEAKMALTNNAVFSHCLPLRRNVKATDAVMDGPNCIAIHEAGNRLHVQKAIMAALASQ

SEQ ID NO: 82807 - protein, 455 aa, Mycobacterium smegmatis str. MC2 155
MVETASPPLTELPLAPRNTLPCREQIRCLRSFIDGMQRLRDVGGPVTRIVLGPRWLVPPALLVTSPQGAHDVLSLPDAVADRGGSRNMRQLQRLMGGNLLDLPHDRWLPRRRTLQPLFTKKHVPRFAGHMAAAAQSVAVSWADGATVDLDRACRALTLRALGRSVFGVDLDQRAEDVGPALRTSLSWVADRASRPVNLPQWVPTRGQRKARAGNATLHRLAAEILADVRADPDRDAPLVRALLEARDPETGRGLTDDQICDELVLFMLAGHDTTSTTLCYSLWALGHHPDIQERVYAEVAALGDRELTTDDVPQLTYTMRVLHEALRLCPPGSGTMRMLNEEMTVDGYRVEAGTVAIVNFYAMHRSPTLWDAPERFDPDRFSPERSAGRNRWQYLPFGGGPRSCIGDHFAMLEATLALATVIRAVSVESQNTDLPVETPFTVIAAAPVPARVTRR

SEQ ID NO: 82808 - protein, 438 aa, Xylella fastidiosa 9a5c
MHANLQTRQIIIRLLSSMASTKEISQYLKRFSQLDAKRFAVVKVGGAVLRDDVDALTSSLSFLQEVGLTPIVLHGAGPQLDEELTAAGIQKKTVNGFRVTLPETMAIVRKVFHTSNLQLIEALQRNGARATSITGGVFEAHYLDQETYGLVGEISAVNLAPIEASLRAASIPVIASLGETPSGQILNINADVAANELVHVLQPYKIIFLTGTGGLLDADGKIINSINLSTEYEQLIQQPWVYGGMKLKIEQIKHLLDRLPLESSVSITRPADLAKELFTHKGSGTLVRRGERVIRATTWKDLDLPRLQHLIQSSFRRTLIPHYFETTPLLRAYVSENYRAAVILTKLGNVPYLDKFAVLDDAQGEGLGRAVWSIMREETPQLFWRSRHNNQANAFYYAESDGYYKQDHWKIFWNGLHHFQQIQQCVAHCAQHPPTLID

SEQ ID NO: 82809 - protein, 484 aa, Ustilago maydis 521
MPDNTDPNTKDGQPAPSILTSKFAKLNPFSKTGASDPEGGGDNLGEEVDFDSIAGGGHAARRTKITKSELRISHALRHFLVQENLISPADALLDQPRASSSDALKAFVDQSHINVPEYVRDRSRPLSEYFVSSSHNTYLLAHQLYGSSSAVAYEHVLIAGARCVEIDAWDNEDDPQEPKVTHGYTLASHVPFRAVCETMKQAIQKEQDEAQRDHSFKVAPILLSLENHCGHAGQKRLVEIMHEVWGDLLISGPVDKNEPASEHTALDHLGAKIAVMVEFYPSEQPPVAEEQDSDDQEEKKNKAKRNEAKKAGIIPELCSLGVYAQSVKPVNDSWYAATLTNGPHDHLINISETGLLDLLPKHSTAIKKHNAQHLMRVYPKGTRISSKNLNPVPFWGVGAQVCALNWQTFDHSMQLNEALFSGSDGYVLKPPGLRIGGDGQTSLGRHKLILYIAGATDLPLPAGRDADEIRPCALERTARVGIRT

SEQ ID NO: 82810 - protein, 117 aa, Medicago sativa
MAAEEGQVIGVHTVEAWKEHLEKGNGSKKLIVVDFTASWCGPCRFIAPILAEIAKKLPNVTFLKVDVDELKTVAEEWAVDAMPTFLFLKEGKLVDKVVGAQKEQLQAAITKHATTDA

SEQ ID NO: 82811 - protein, 213 aa, Xanthobacter autotrophicus Py2
MAEAATRSPTSSAPERGGRGHALSLPNILTYSRCVAVPLVAACLFWSDILEGGAVLRWVALALYIAAAITDFFDGYLARAWSQQSAIGRMLDPIADKLLVSTCLLMLASDGTIRGWSLWAAIVILCREILVSGLREFLAELRVSVPVSRLAKWKTTLQLVAVGVLITGPAGESVLPGVNLIGLTLLWVSAVLTLYTGYDYFRAGARHLVEDER

SEQ ID NO: 82812 - protein, 515 aa, Aspergillus nidulans FGSC A4
MASWIQRQNNSHQVQLAATAVLSGAAVAGAILGFQKYRRREAVKRLKASIPTIDEKHRAESLNEFGAAVPGPYWSKEDERGAALARRAQEGDYDEELILEQLARNRVFLKDEGLAKLRDAFIIVVGCGGVGSHAVASLARSGVSKIRLIDFDQVTLSSLNRHALATLADVGTPKVHCIRRRLQQIVPWVKFDCRNELFGASAADDLLAPWTLDDADKGQKPVYVLDCIDNIQSKVELLHYCHSHSIPVISSMGAGCKSDPTRVMITDMSVSSDDRLSRSTRRRLKLLGVTTGIPVVFSTEKPGPGKATLLPLAEEEFAKGEVGELSVLPDFRSRILPVLGTMPAVFGYTLANHVICEISEYPTDYSMGGKGKDKLYDTVHAQLLVTLERLARAESESGTQPIGLRLPMSRDDVIYLVDEIWRGKSVVTGLPSRLALTLWNRPSNGFKPDPQWEKEGQILIPFKPEDLVLMTKEEATRHEKEVLMGGKKVEDLYSEEIIQKVNQRQKEMAYYEQFR

SEQ ID NO: 82813 - protein, 338 aa, Saccharomyces cerevisiae YJM789
MSTTASTPSSLRHLISIKDLSDEEFRILVQRAQHFKNVFKANKTNDFQSNHLKLLGRTIALIFTKRSTRTRISTEGAATFFGAQPMFLGKEDIQLGVNESFYDTTKVVSSMVSCIFARVNKHEDILAFCKDSSVPIINSLCDKFHPLQAICDLLTIIENFNISLDEVNKGINSKLKMAWIGDANNVINDMCIACLKFGISVSISTPPGIEMDSDIVDEANKVAERNGATFELTHDSLKASTNANILVTDTFVSMGEEFAKQAKLKQFKGFQINQELVSVADPNYKFMHCLPRHQEEVSDDVFYGEHSIVFEEAENRLYAAMSAIDIFVNNKGNFKDLK

SEQ ID NO: 82814 - protein, 456 aa, Mycobacterium smegmatis str. MC2 155
MARTFDAIVIGAGQAGPPLAGRLTDAGQTVAVIERKYVGGTCVNTGCIPTKTLVASAHAAHLARRGSEYGVGTGDVTVDMARVKARKDKIMLGDRHGVESWIEGMNGATLIRGHARFVDPHTVDVDGERLTAERIFLNVGGRAVVPEFPGLDGIDYMTNTGILEIDSVPEHLVIIGGSYIALEFAQMYRRFGAAVTVVEKGPRLTAREDEDVSAAIKDILEAEGITVVLDATGIRFTKRDNGFDVVPRDDAQPIAGTHLLLAVGRQPNTDDLDLQKAGVEVDERGFIVVDDQLRTNVEHIWAMGDCNGKGAFTHTSYNDFEIVAANLLDDDPRRVSDRVPTYALYIDPPLGRAGLTEAQVRASGRKALVGKRPMTRVGRAVEKGETQGFMKVVVDAETQEILGAAILGVGGDEVVHAILDIMAAKEPYTAISRTMHIHPTVSELVPTMLQELKPLV

SEQ ID NO: 82815 - protein, 505 aa, Burkholderia thailandensis E264
MKHDSNVTSTLGHLIDGKRVDGGERVQPVFDPATGASTKRVRLADGPTVEAAIAAAQAAYPAWRNTPPLKRARVMSRFKTLLEEHADELCALVTAEHGKVLADAMGELQRGIENVEYASYAPELLKGEHSKNVGPAIDSWSEFQALGVVAGITPFNFPVMVPLWMWPMAVACGNTFVLKPSERTPSSTLRMAELALEAGLPPGVLNVVNGDKEAVDTILTDSRVKAVSFVGSTPIAEYIYTTGCAHGKRVQALGGAKNFAIVMPDADIGNAVNALMGAAYGSCGERCMAIPLVVAIGDDAADQVVEGLKAEIAKMKVGPGTGERVDMGPLVTRQHFDKVTGFVEAGVAAGATLVVDGRGVKVDGHDGGYYLGPCLFDHVKPGMPIYQHEIFGPVLGVVRVASLAEAMALVDAHEYGNGTCLFTRDGEAARYFSDNIQVGMVGINVPLPVPVAYHSFGGWKRSLFGDLHAYGPDAVRFYTKRKTITQRWPSAGVREGTVFSFPSSR

SEQ ID NO: 82816 - protein, 500 aa, Oryza sativa Japonica Group
MVLTHVEAVEEGSEAAAAVFASRYVQDPVPRYELGERSISKDAAYQIVHDELLLDSSPRLNLASFVTTWMEPECDRLILEAINKNYADMDEYPVTTELQNRCVNIIARLFNAPVGDGEKAVGVGTVGSSEAIMLAGLAFKRRWQNRRKAAGKPHDKPNIVTGANVQVCWEKFARYFEVELKEVKLTEGCYVMDPVKAVDMVDENTICVAAILGSTLTGEFEDVRRLNDLLAAKNKRTGWDTPIHVDAASGGFIAPFIYPELEWDFRLPLVKSINVSGHKYGLVYAGVGWVIWRNKEDLPEELIFHINYLGADQPTFTLNFSKGSSQIIAQYYQFLRLGFEGYKSVMKNCMESARTLREGLEKTGRFTIISKEEGVPLVAFTFKDGAGAQAFRLSSGLRRYGWIVPAYTMPAALEHMTVLRVVVREDFGRPLAERFLSHVRMALDEMDLAARAPVPRVQLTIELGPARTAGEEASIRVVKSEAVPVRKSVPLVAGKTKGVC

SEQ ID NO: 82817 - protein, 686 aa, Gibberella zeae PH-1
MQQRLRSMKRPLLLAAAATTTLAVGGGYYATRNRTHVVDKALVPLKRDQTGRIVPPTFSATKARAEALAELRRSGQPNKDTEYDLLVIGGGATGTGIAIDAITRGLKVALVERDDFSSGTSSKSTKLVHGGVRYLEKAVWNLDYGQLQLVMEALRERKTFLNIAPHLSSSLPILLPLQKWWEAPYFWAGTKAYDLLAGSQGLESSYYMSKNKAMEAFPKLRKENMVGALVYYDGQHNDSRMNVALAMTAAQYGATVLNHVEVTGLEKDANGKINGAQVRDVLASKNGDSANAEPFKVRAKGVVNATGPFTDAIHQMDDPSRKPIVAPASGVHVMLPKDICPNGIGLLDAATSDGRVIFVLPWQGFTLAGTTDNPCEVERAPVAQQNDVDFILREVSKLLTPESALSRKDVQAAWSGIRPLVKNPNAKNTESLVRSHLITTSPSGLLTCAGGKWTTYREMAEDTVNEAVKMFELKPQAVSLPDISGANASGFTTSGLCCTRNIPLIGAHGYSTSLASQLMEMYPIDADVADHLAHNYGDRAWTVLSTNPSLNTRLVSGLPYLEAEVAHGIRNEAACTVADIIARRTRLSFLDSSKALQALPRVIDIAATELQWSKARKAQEKADSIAFLASMGLEQMTDAPVQASQQERMPSRQIEHSQQRPTRVGGLEVDLNGLGSTSSYSKSRDD

SEQ ID NO: 82818 - protein, 122 aa, Zea mays
DVKRSVDDGEKRFNQLSIEERGKFDEETLVNVNSIKRNKGGSQRSSGFSNEYIVITILVAAEGVHKLPVINSSNDLKTALQKMGAIPSSKILAVEVLWTPQNENDTLSERELLEDYPLLRPL

SEQ ID NO: 82819 - protein, 539 aa, Ustilago maydis 521
MTDIQQTRRQEFSPDGEKDAHPSSSLSSHEAPVQPAAKKSRLGAVGLIFACGAALFSDGYVNASSGPVLTVLSYAYPDYPGFTAFKSQFSSLVFAGTVFGMLLFGFLVDRFGRRYGMWFASIWLTLWSVLIAGAWGAGGSVGGLFAALSAYRFILGIAIGAEYPSGSVAASENTEGEGVNKNRQQMYFIIATNTMIDLGFVVAAFVAYILLLIFGMNHLAWVWRLTLGIGAIPPLLVFFFRTGMQEPEHFRKNAIKKNVPYWLIFKRYWVRLLAVCIAWFCYDYVSYPSGIYSSLLIKQLNPTEGASDYTVLKRSLAYSTALNCFYLPGTIIGALIADRLGPKNTMILGLLCQAVLAFAMGGAFGQIRDRIGPLVVVYGLFLSFGELGPGNQLGLLASKACGPAAVRGLYYSVAAAIGKVGAFSGSYAYPQIQADLGSPDSNIYYAGTFYIAGGLAIFSAIITFFFIPAIGQDSMKKDDEAFRQYLADNGYDISQMGLLDADQLATSEEGVRTRSITDQGSEDKKEKSGQAVVSSAPII

SEQ ID NO: 82820 - protein, 134 aa, Synechocystis sp. PCC 6803
MSFLKNQLSRLLALILVVAIGLTACDSGTGLTGNYSQDTLTVIATLREAIDLPQDAPNRQEVQDTARGQINDYISRYRRKGDAGGLKSFTTMQTALNSLAGYYTSYGARPIPEKLKKRLQLEFTQAERSIERGV

SEQ ID NO: 82821 - protein, 335 aa, Moorella thermoacetica ATCC 39073
MAIKVGINGFGRIGRLVFRASLEKPELEVVAINDITDVKTNAHLLKYDSVHGRLNATVEAREGAMVVNGREIKVLAERDPAKLPWKDLGVDIVIESTGVFTDATKAAAHRQAGAKKVIITAPAKNEDITIVMGVNNDKYNPAQHHIVSNASCTTNCLAPIAKVLHDNFTIKRGLMTTAHSYTNDQRILDLTHKDLRRARAGALSIIPTTTGAAKAIGLVLPELKGKLNGMAMRVPTPNVSVVDLVAELEKPATVESINAAMKAAAEGPMKGILGYCEEPLVSRDFNGDPRSSIVDALSTMVIDGTLAKVVSWYDNEWAYSKRVVDLAAFMAAKGL

SEQ ID NO: 82822 - protein, 393 aa, Moorella thermoacetica ATCC 39073
MAKLTLKDLELNNKRVLVRVDFNVPLEAGRVTDNTRIRAALPTIEYLLDHGARVILMSHLGRPKGKVKEELRLDPVARELESLLGRQVHKVNDCVGPEVEAAAAALKPGEVLLLENLRFHPEEEKNDPGFARQLASLADVYVNDAFGAAHRAHASTEGVAHYLPAAAGFLLQKEIETLGKALADPERPFVAIIGGAKVSDKISVIRNLLTKVDTLIIGGGMANTFLKAQGYAMGKSLVEEDQVPLAQELIQLAAQKGVKMLLPRDLVVAQEFKADAPHQVVAVNAVPDGWMALDIGPETARAYAGALEGARTVVWNGPMGVFEMEAFAHGTEAVARAVAAVDGMTIVGGGDSVAAVEKMGVAGKIGHISTGGGASLEFLEGKALPGVVALTEK

SEQ ID NO: 82823 - protein, 249 aa, Moorella thermoacetica ATCC 39073
MRRPIIAGNWKMHNTTEEARDLVTLLRPLVGTARAEVVVCPPFTAIAATVNAASGSNISVGAQDLFWEDKGAYTGEVSGPMLRDLGCRYVIIGHSERRQYFGETDATVNKKLLAAYRNELLPIVCVGETLAEREAGHTLEVVGRQVREGLKGLETGQARDLVVAYEPVWAIGTGKTATAADAQEVIAFIRKTLGEMYGETAAAIRIQYGGSVKPENIAELMAQPDIDGALVGGASLDAVSFAAIVNYDQ

SEQ ID NO: 82824 - protein, 513 aa, Moorella thermoacetica ATCC 39073
MAIAVNRPLMLMILDGFGLGPEGEGNAISQGRLPNYRRLLAGYPHTRLRASGEAVGLPAGQMGNSEVGHLNIGAGRIVYQELTRISKAIRDGSFFSNAALVGAVRAAREHGGALHLMGLVSDGGVHSHLDHLYALLDLAKREGLERVYIHAFLDGRDVPPASAAGYLEQVEDECRQKGIGAIATIMGRYYAMDRDRRWERTARAYRALVAGEGHQASSPSEAIRASYERDITDEFVEPAVITRDGRPLATVREGDSVVFFNFRADRARQLTRAFVDRDFDAFERPGGRLDIQFVCLTQYDVTIPAPVAFPPQVLQNVLGEVIAGAGLKQLRIAETEKYAHVTFFFNGGVEEPFPGEDRLLIPSPKVATYDQKPSMSAREVTDAVLERLDKYDFIVLNFANPDMVGHTGDLAAAIAAVETVDECIGRIVQAMAERRAPLLLTADHGNAEEMREPDGEPHTAHTSNLVPFILVDDRYRGASLREGALEDVAPTVLDILHIQQPAEMTGKSLIVKG

SEQ ID NO: 82825 - protein, 480 aa, Bradyrhizobium sp. ORS278
MATAANQIGRVTQVIGAVVDVQFEGHLPAILNSLETKNGGNRLVLEVAQHLGESTVRAIAMDTTEGLVRGQEVTDTGAPIRVPVGEGTLGRIINVIGEPIDEAGPVKADNVRAIHQEAPTYTDQSTEAEILVTGIKVVDLLAPYAKGGKIGLFGGAGVGKTVLIQELINNVAKAHGGYSVFAGVGERTREGNDLYHEFIESKVNADPHNPDPSVKSKCALVFGQMNEPPGARARVALTGLTIAEDFRDKGQDVLFFVDNIFRFTQAGSEVSALLGRIPSAVGYQPTLATDMGALQERITTTTKGSITSVQAIYVPADDLTDPAPATSFAHLDATTTLSRSIAEKGIYPAVDPLDSTSRMLSPLVVGEEHYAVARQVQQVLQRYKALQDIIAILGMDELSEEDKLTVARARKVERFMSQPFHVAEIFTGSPGKFVELADTIKGFKGLVEGKYDHLPEAAFYMVGTIEEAVEKGKKLAAEAA

SEQ ID NO: 82826 - protein, 241 aa, Picea sitchensis
MEKLLGFAPQNLNSNSAASDAGDLNELKEEDVWGIWPDAGSNPAQYETKKEENFQFRHKTDSANGGGGIGGAVEPGRSLQSGSSRRWKENGGLSIAFEECNRSRLSPLTRSSAVFSVTPANRISVRMIPSADQNGNTSGSSSNMMMMHHQSAPVNVPDWSKILGVGMDRLKENNPNLFFSAAADEDEDGGDMLPPHEYLAREQARSQMTTTSVFEGVGRTLKGRDMSRVRNAVWRQTGFLG

SEQ ID NO: 82827 - protein, 428 aa, Moorella thermoacetica ATCC 39073
MTTISDIYAREILDSRGNPTVEVEVFLESGGWGRAAVPSGASTGAYEAVELRDKDPKRYGGKGVLDAVNNINAIIAPELVGSDALDQREIDRQLIEMDGTPNKGKLGANAILGVSLAVAKAAADALGLPLYRYLGGVNAHTLPVPMMNILNGGKHADNNVDIQEFMVMPAGASDFASALRMGAEVFHSLKAVLQSKGLNTAVGDEGGFAPNLRSNVEAIEVLLEAIAKAGYEPGKDCFIALDPASTELYKDGKYVFAGEGVTRTSDEMVEFWASLVDKYPIISIEDGLAEDDWEGWQNLTKRLGHKVQLVGDDLFVTNTERLSRGIEMGAANAILIKVNQIGTLTETLEAIEMAKKAGYTAVVSHRSGETEDTTIADIVVAVNAGQIKTGAPSRTERVAKYNQLLRIEEELDAAALYPGLKAFYNLKK

SEQ ID NO: 82828 - protein, 559 aa, Magnaporthe grisea 70-15
MPQASSLPAWAELQAHRDSVGKSFVLKEAFASDPERFSKFTRTFKLPESVGSTEILFDFSKNFLTEETLDLLTKLAEQAGVETKRESMFKGEKINFTEGRAVYHAALRNVGSEPWPMSVEGVDVMGAKGGVNDVLEHMKEFSEQVRSGEWKGYTGKKLTNIVNIGIGGSDLGPVMVTEALKHYGAKDMTLHFVSNIDGTHMAEALAASDPETTLFLVASKTFTTAETTTNANTAKSWFLEKTGNKGDIAKHFVALSTNEGEVTKFGIDAKNMFGFESWVGGRYSVWSAIGLSVALYIGYDNFHKFLVGAHAMDKHFREAPLRENIPAIAGLLSVWYSDFYNAQTHLVAPFDQYLHRFPAYLQQLSMESNGKSITSDGTPAKYTTGPILFGEPCTNAQHSFFQLVHQGTKLIPTDFILAAKSHNPISDNLHQKMLASNYLAQAEALMVGKTAEQVRADDSSVPDNLVPHKVFLGNRPTTSILVGGHIGPAELGALIVYYEHLTFTEGAVWDINSFDQWGVELGKVLAKKILQELNEAGNGQGHDSSTGGLIGAFKKYSSL

SEQ ID NO: 82829 - protein, 506 aa, Neptuniibacter caesariensis
MSEQLQENIAKAEGYLARFKENTLGHYINGEWTLGQGETFDNTTPFDQSFLGKVAAATEADVNAACEAAEAAAAEWAATPGAERRKILHRLGDELEKRAEEIAMVESMDCGQAIRFMRQAAVRGAANFRFFADQAPEARNGLSLHQQEHTNYTVRNPIGPVAVITPWNTPFMLSTWKIAPALAAGCTVVHKPAELSPLTASILAECAEAAGLPKGVWNMVNGFGAVAGKTLTEHPAIKAVALVGDSATGKLIQAQTAQTLKRLHLELGGKNPVIVFDDADFDRALDAVVFMIYSLNGQRCTSSSRLLVQSGIKDKFLAALKERVANIKVGHPLDPATEVGPLVHTGHYDKVTSYFEIAKEDGATVAVGGKSLRDEMGPGNFVTPTLFVEAKNSMRIAQEEIFGPVLTAIEFETEEEAVKLANETIYGLAGYIWTSNTGRAMRMADKVEAGMLWVNSENNRNLPSPFGGVKMSGIGRDGGDWSFDFYMETKNVCIAHDTHRVPVLGR

SEQ ID NO: 82830 - protein, 345 aa, Thermus thermophilus HB27 [sequence omitted]

SEQ ID NO: 82831 - protein, 461 aa, Mycobacterium smegmatis str. MC2 155
MTTADITQTAPTDLGAKANRHLWGHFARHGDGITPPIITRGEGVKIFDDSGKSYIDGLSGLFVVQVGHGRKELAEAAAKQAEKLSFFPLWSYATPPAIELAERVASFAPGDLNRVFFTTGGGEAVESAWKLAKQYFKLTGKPGKHKVVSRSIAYHGTPQGALAITGIPAFKAPFEPLTPGGFRAPNTNFYRAPAEYAHDEKAFGRYCADRIAEAIEFEGPDTVAAVFLEPVQNAGGCFPPPPGYFERVREICDEYDVLLVSDEVICAYGRIGSMFACNDFGYVPDIITSAKGLTSGYSPLGAMVASDRLFEPFNDGKTVFGHGYTFGGHPVSAAVAMANLDIFEREGINDHVKTMAPAFRATLEKLYDLPIVGDVRGEGFFYGIELVKDKTTKETFNDEESERLLRGFLTPALWEAGLYCRADDRGDPVVQLAPPLISGQAEFDAIYDILHNVLTEAGNRL

SEQ ID NO: 82832 - protein, 268 aa, Nocardia farcinica IFM 10152
MTSSAQLMDVAREAVSKGSKLLLNAPAGKVSAKSDRDYVTELDVEIQMVVQEFLARHTPEIGFLGEEANPAPDFSEQSRWWTLDPIDGTSNFVHGLPLCAVSLALVEHGRSVLGVVNAPFLDLEYHATLDAGASVNDAPMTASTVTRLSDAVISLGDYAVGAGAARKNRERLAITAALAERVERVRMFGSAALDLVWVAEGRTDGCVMLSNNPWDTAAGALIAAESGALVTDTDGSPHTVGSKHTVAAAPGLSAELLRLVADARAGHH

SEQ ID NO: 82833 - protein, 144 aa, Legionella pneumophila str. Paris
MAHLIHSVLPVPPRKIAYIHPDDSVKECIKQMVEKDIGALVVFDNDAHLIGIVSERDILRCYFHKSLSLETAKVSDVVYTNVTILSPHDSVEKAMQVITETKRRHVLIQEEGELLAILSIGDLLYHVLEDKLRVIEHLENYIHS

SEQ ID NO: 82834 - protein, 222 aa, Echinochloa crus-galli
EHMKESKGLKNDTDLTASDLKELVEQYKDVYVEAKGEPFPSDPKKQLELSVLAVFNSWDSPRAKKYRSINQITGLRGTAVNVQCMVFGNMGNTSGTGVLFTRNPSTGEKKLYGEFLVNAQGEDVVAGIRTPEDLDAMKDCMPQAYEELVENCNILEGHYKDMMDIEFTVQENRLWMLQCRSGKRTGKGAVKIAVDVVNEGLVDRHAAIKMVEPGHLDQLLHP

SEQ ID NO: 82835 - protein, 472 aa, Xylella fastidiosa 9a5c
MSCGIANAIRWDVSLLIHRSMSSSMSSVQPTSPVSDSPSLGEMHASVAVSRRGHWGFRLLAFLGPGYMVSVGYMDPGNWATGLAGGSRFGYMLLSVILLSNVMAIVLQALAARLGIASDMDLAQACRARYSRGTTLALWVVCELAIIACDLAEVIGTAIALNLLLGVPIIWGVVITAVDVVLVLLLMHRGFRALEAFVIALLLVIFGCFVVQIVLAAPPLQEVLGGFVPRWQVVADPQALYLAIGIVGATVMPHNLYLHSSIVQTRAYPRTPVGRRSALRWAVADSTLALMLALFINASILILAAAVFHAQHHFDVEEIEQAYQLLAPVLGVGVAATLFATALLASGINSTVTATLAGQIVMEGFLRLRLRPWLRRVLTRGLAIVPVIVVVALYGEQGTGRLLLLSQVILSMQLPFAVIPLLRCVADRKVMGALVAPRWLMVVAWLIAGVIVVLNVKLLGDYAVHLMVGVSD

SEQ ID NO: 82836 - protein, 748 aa, Arabidopsis thaliana
MKTETHNRQCIPLAISVLSLFINGVSSARQPPDRCNRVCGEISIPFPFGIGGKDCYLNPWYEVVCNSTNSVPFLSRINRELVNISLNGVVHIKAPVTSSGCSTGTSQPLTPPPLNVAGQGSPYFLTDKNLLVAVGCKFKAVMAGITSQITSCESSCNERNSSSQEGRNKICNGYKCCQTRIPEGQPQVISVDIEIPQGNNTTGEGGCRVAFLTSDKYSSLNVTEPEKFHGHGYAAVELGWFFDTSDSRDTQPISCKNASDTTPYTSDTRCSCSYGYFSGFSYRDCYCNSPGYKGNPFLPGGCVDVDECKLDIGRNQCKDQSCVNLPGWFDCQPKKPEQLKRVIQGVLIGSALLLFAFGIFGLYKFVQKRRKLIRMRKFFRRNGGMLLKQQLARKEGNVEMSRIFSSHELEKATDNFNKNRVLGQGGQGTVYKGMLVDGRIVAVKRSKAVDEDRVEEFINEVVVLAQINHRNIVKLLGCCLETEVPVLVYEFVPNGDLCKRLHDESDDYTMTWEVRLHIAIEIAGALSYLHSAASFPIYHRDIKTTNILLDERNRAKVSDFGTSRSVTIDQTHLTTQVAGTFGYVDPEYFQSSKFTEKSDVYSFGVVLVELLTGEKPSSRVRSEENRGLAAHFVEAVKENRVLDIVDDRIKDECNMDQVMSVANLARRCLNRKGKKRPNMREVSIELEMIRSSHYDSGIHIEDDDEEDDQAMELNFNDTWEVGATAPASMFNNASPTSDAEPLVPLRTW

SEQ ID NO: 82837 - protein, 296 aa, Triticum aestivum
  misc_feature (43)..(43): Xaa can be any naturally occurring amino acid
MEDLSVEELASNLSTYKDQLREVRKFIKEKKDDAGISEYVDMXKGASRFFFKLLATANPSESAQNDVGLSPPNYSAGVHSEALDDLSQSHEKFAVGTKVQAVYSEDGEWYNATIEGLTPIGYFVSYEGWGNKEEVDPANVRALDVEAADALGLAEKEAEATKMALKRKVEQAATSDYQIRSLPTKLKIDPNDPEDVKAAKRKKIHAFKSKARFEQLDFAQNKRQNAWQQFQTTKGKAKKVGFFSGRKKESIFKSPEDHRGKVGVTGSGKGLTDFQRREKHLHLKDGSSGDTLDYEE

SEQ ID NO: 82838 - protein, 170 aa, Medicago sativa
YCFLPALSLFSGQFIVQSLSVTFLVFLLGITVTLCLLALLEIKWSGITLHDWWRNEQFWLIGGTSAHPAAVLQGLLKVIAGVDISFTLTSKSATPEDGEDEFADLYLVKWSFLMVPPITIMMVNTIAIAVGVARTLYSPFPQWSRLVGGLFFSFWVLCHLYPFAKGLLGR

SEQ ID NO: 82839 - protein, 162 aa, Bradyrhizobium sp. ORS278
MHMRLVVIAIGRLKQGPERQLAERYRERFDDIGRKLGFRGLDIHEIPESRARDAATRMAEEAAAIAAAIPDNSMLVCLDERGHNIDSATFAGHIGRWRDEGVAATAFVIGGADGLSPELRRKAKLGVAFGAATWPHQIVRVLLLEQIYRTATILAGHPYHRA

SEQ ID NO: 82840 - protein, 350 aa, Deinococcus radiodurans R1
MPQPAPLDFVVVGLNHQTAPVEVRERVAVRPEEEGALLGHLARHADEVLLLATCNRTEVYLAGVHGDPLAAFEGAWGHALLDHLYVYRGEAAVRHLYRVTAGLDSLVIGETQIQGQVKRAWQSARERGLSGTLMNKVVQGALAAGKRVRSHTGLSDKVVSVSSAAVELAQAALGELSQRRALILGAGETAELTLTHLRAAGVQDVLVVNRTAERARALAEKLGGRACPAEELSAALPEVDVVIASSAAPHYVVTAQNVREALAGRPGRAMFLIDISVPRILDPEIASVPGAHLYNLDDLTAVVQRNMQSRRAALPQAEAIIRELGSDLSRWYLTRETQLARQAELALACD

SEQ ID NO: 82841 - protein, 300 aa, Salmonella enterica subsp. arizonae serovar 62:z4,z23:--
MTMVRIACVGITVMDRIYYVEGLPTEGGKYVAKRYTEVGGGPAATAAVAAAKLGAQVDFIGRVGDDDTGNSLLAELESLGVNTRYTRRYTQAMSSQSAIMVDAKGERIIVNYPSPDLLPDADWLNDIDFSQWDVVLADVRWHDGAKQAFTLARQAGVMTVLDGDITPQDISELVALSDHAAFSEPGLARLTGMSEAIDALKKAQMLTNGHVYVTRGSDGCNWLEKAAVRHQPGFTVEVVDTTGAGDVFHGALAFGLASGYAIEEAVRFASGVAALKCTRPGGRAGIPDCEQTRSFLSLFV

SEQ ID NO: 82842 - protein, 343 aa, Deinococcus radiodurans R1
MTDASFPALPPPLVSLGDLAWDVLAKPDTLLLPGGDTTGRLELSGGGSAANLAVWAARLGAPTTFVGKIGQDRFGELATAELRAEGVRAEVLASAAHPTGVILALIDRRGQRAMLTGQGADWELLPEELPRDVLSSAGHLHLTAWSLFRDPPRAAALEAARIAKAGGATLSLDPGSFQMIQQLGREAFLNIVDALPFDVMFPNDDEARAMSGERDNEAALTWLRARYPRALIALKMDEDGALIEGPQTARVQVPATRDPLVDATGAGDAFGGAFLSQWLRHHDAERAARVAVQVGGWVVSRFGARPPADPDLTRRLASVGADLLTPDPAAAPDPSQDSPEVNA

SEQ ID NO: 82843 - protein, 249 aa, Solibacter usitatus Ellin6076
MRKPVMAGNWKMYKTPAETIAFFEKFRPLVEKSSHCEIVICPPFTNLAAAVDAVRGTSIRVGAQNVGWAKEGAFTGEVSGPMLNAMGVSHVIIGHSERRQYFNETDETVLKRTQAALEFGLTPIVCVGELLADREGGRTEAVLAGQFQKGIAGLTEQQFAKIVIAYEPVWAIGTGKTATPEIAADTHRAIRGQVREKFGKEAADAVRILYGGSVKPDNAKVLMGQPEIDGVLVGGAALDPVSFASIVNF

SEQ ID NO: 82844 - protein, 540 aa, Rhodococcus sp. RHA1
MTVTDSAVTPDIHTTAGKLADLRNRQAEAQHPSGEAAVEKVHAKGKLTARERITALLDEGSFVELDALARHRSVNFGLADNRPVGDGVVTGYGTVDGRDVCVFSQDATVFGGSLGEIYGEKIVKVMDLALKTGRPLIGINEGAGARIQEGVVSLGLYGEIFHRNVQASGVIPQISLIMGPAAGGHVYSPALTDFVVMVDQTSQMFVTGPDVIKTVTGEDVTMEDLGGAHTHMVKSGVAHYVASGEQDALDYVKDLLSYLPSNNQAAAPRMLPTDPITGSIDDSLTAEDLELDTLIPDSANQPYDMHEVIRRILDDDEFLEVQAERAGNIVVGFGRVDGRSVGIVANQPTVFAGCLDIDASEKAARFVRTCDAFNVPIITLVDVPGFLPGTDQEYNGIIRRGAKLLYAYGEATVGKITVITRKAYGGAYDVMGSKHMGADVNLAWPTAQIAVMGASGAVGFVYRKRLLEAARNGDDVDALRLQLQQEYEDTLVNPYVAAERGYVDAVIPPSHTRGQIVAALRLLERKMVTLPPKKHGNIPL

SEQ ID NO: 82845 - protein, 618 aa, Arabidopsis thaliana
MIGDGVMAGGIVSPASLLDLIADIVEIPLNTGMFKKDCADLTRRVCLLTHLLEEIRDSTPIDSAASSSSENDWWSDLVVGLQAAKRLLSTARFQARDSSDGAAKRISFQFQCVTWKLEKALSNLPYDLYDISDEVGEQVELARSQLRRAMQRYGSLNSNKFSSALSEPMERDGFSNVIKIKAEEKLESVSETLHFGEEEEKQSSPPLRRSSSISLAYYLSKDADTDRLDKMVNKNTDESKKSDKLTIPVDFLCPVSLELMKDPVIVATGQTYERAYIQRWIDCGNLTCPKTQQKLENFTLTPNYVLRSLISRWCAEHNIEQPAGYINGRTKNSGDMSVIRALVQRLSSRSTEDRRNAVSEIRSLSKRSTDNRILIAEAGAIPVLVNLLTSEDVATQENAITCVLNLSIYENNKELIMFAGAVTSIVQVLRAGTMEARENAAATLFSLSLADENKIIIGGSGAIPALVDLLENGTPRGKKDAATALFNLCIYHGNKGRAVRAGIVTALVKMLSDSTRHRMVDEALTILSVLANNQDAKSAIVKANTLPALIGILQTDQTRNRENAAAILLSLCKRDTEKLITIGRLGAVVPLMDLSKNGTERGKRKAISLLELLRKACQ

SEQ ID NO: 82846 - protein, 309 aa, Prochlorococcus marinus str. AS9601
MTATISRPKISNWETSNIPNLTGKTALITGANSGLGYYTAKALAEKNAHIVIACRSFEKANQTIKKLKGLNPEGIFTPLELDLSDLKNIVEVQSKIFDNFENLDLLINNAGIMHPPKTLSAQGYEIQFAVNHLAHMLLTLKLLPIIEKKEESRIVTVTSGAQFFGKVGWKNLKAENYYNKWESYSNSKLANVMFALELNENLKHKNILSLAAHPGIAKTNLFTAQKPNPSPLETFSLELFSPIFQTAEMGALPQLFAATSPDARGGDHYGPRFNFRGHPKLSPTSPFAMNKKERKNLWEKSLEILKNFL

SEQ ID NO: 82847 - protein, 299 aa, Oryza sativa Japonica Group
RRWRGPPQDPCQGVPLLALRRRGGGGHVPHRRRQDAPRAPPRYRGQRRGRRGRHARRWRARTRRGNLPGPLPRRTPAPLLHPAPHRGVRAPPVHLRQRWTRRGPPREGACWGCLRRCRTVQVVASPADLIKVRMQADSRLLSQGIQPRYTGIFDAFTKIVRAEGFRGLWKGVVPNAQRAFLVNMGELTCYDQAKHFIIRKQICGDNLYAHTLASVASGLSATTLSCPADVIKTRMMNQGKDAKVLYRNSYDCLVKTVKHEGLTALWKGFLPTWARLGPWQFVFWVSYEKLRQASGISSF

SEQ ID NO: 82848 - protein, 161 aa, Zea mays
  misc_feature (14)..(14): Xaa can be any naturally occurring amino acid
  misc_feature (23)..(23): Xaa can be any naturally occurring amino acid
  misc_feature (58)..(58): Xaa can be any naturally occurring amino acid
  misc_feature (90)..(90): Xaa can be any naturally occurring amino acid
LAIGANFVLLRKRXKLPAKVIAXEYFLEYETARIEMHVGSEQRTDRAIVIDGLIATGXTLCAVVKLIKSVGAKVVKWACVIALQELKGRXKVGVRPVFVPCASTWRERKLELFTKFGPVKAPLCGEVHSLTCLPCWVCSVSRVKKFGLANCDPLNVLSMYT

SEQ ID NO: 82849 - protein, 271 aa, Burkholderia sp. 383
MQIEIGFEQRHVFVFGGTTGINFGIAQAFARCGAAVSVASRKRENVDAAVKTLRTTHASVYGACADVRDFDAVGAALGDAVREFGPIDVLISGAAGNFLCDANAMSANGFRTVIDIDLIGSFNVMRQAYPHLRKPGASIISITAPQATVPMRHQAHASAAKAGIDQLTRVLALEWGADGVRVNAISPGPIDGTEGFRKLIARTDDELALAESAVPLRRFGSIDDIANLALFLASPYASYVSGAVIPCDGGGAIDSVKPAIERAGANASAGT

SEQ ID NO: 82850 - protein, 411 aa, Coxiella burnetii RSA 493
MSFEVLGLSAELLRAIREQGYVEPTPVQRQAIPVILQARDVMVTAQTGTGKTAGFTLPLLQRLFVSRPPLQRSAKPVIRALILTPTRELAVQVFECVRAYGKYLPLKATVVHGGVSIKPQINHLRRGVDILVATPGRLLDLVNQGVLNLSRVEFFVLDEADRMLDMGFLPDIRRILKLLPESRQNLLFSATFSKEIKELTDKLLHSPALIEVARRNTAAARITHVVHPVDRQRKRELLSFMIGSKNWRQVLVFTRTKHGANRLSQQLESDGLSSAAIHGNKSQAARMRALTQFKQGKIRVLVATDVAARGLDIDKLPHVINFELPDAAKDYVHRVGRTGRASNDGVAISLVSGDEVRLLRDIEKLLQSKMPQEVIPGYEPSPFTKAAPVQAVRRARSNQRGKNNGKRARWG

SEQ ID NO: 82851 - protein, 477 aa, Coxiella burnetii RSA 493
MEECIVPVLLAGGVGSRLWPVSRESYPKQFCKLFDEFSLLQKTAERAKYISKDADLIVVTNYSYYFLCKDQLEAIGIYNVHYILEPCSRNTAPAIALAAQYACEYIHPDSVLLVLPSDHQLNDHAYFKSTVRAAMNFVERNKLVVFGIEPQSPKTGYGYIEKGDAVDEGFEVKRFIEKPPLPLAKEFLLQGNFFWNSGLFLFKAKDYLNKLEKLANDIYVQSTKAFQATEPNLEFFRVNKIFDSCRAGSIDYEVMEKTNSAVMLPLRTNWSDLGCWLSVGEVVEGDEAGNVCYGDVMVDKCQNCLISSEGRRVVAIGVKDQVIVSTPDALLVIDKAYSQEVKRAVEQMKLQHDIAATEHPRMYRPWGFYEKLAVGADYQVKYLMVNPGSSLSLQLHRYRSEHWIVVSGEAEVVKGESVFRLHSNQSTFIEKGMKHRLSNPGDEPLLIIEVQSGKYLGEDDIVRFDDAYGRVVESTSL

SEQ ID NO: 82852 - protein, 332 aa, Zea mays
MTCDLLMLLVTQYLCCVITICYSAVNQKLIAWGVLATIPVTGDAFPTLMACILIGNLGASVTEVEPKIMFTAFSVLLGFQLALSLSTKETLPSSRGNSRNRLVKSSLAANFRKQFSNLMTAIREERILYPLAWIMTSFAVVPVLSGTMFCFQTQYLNLDPSVIGLSKVVGQVMVLSLTVLYNRYLKRIPLRCLTTGLQILYALAVLSDLILVKQVNLVLGIPNEIHVLCFSALAEALAQFKVLPFSVLLSSLCPPGCEGSLFAFFTSGLVLSAILSGVFGVGLSTLIGVSSVDYSSLPLGILLQSLAALLPLGWISFVPEKWTADDTVVIKR

SEQ ID NO: 82853 - protein, 242 aa, Erythrobacter sp. NAP1
MHGTRAMLSEARAIDRAAQRHMKVEVALAPPYTLIHPIHREAEQIAVGAQDCHHEEGGAHTGDISAAMVADAGAKFVILGHSERRQNHGEKDAVVRAKAESALAAGLRIILCCGESEETRDAGKAVAFVSKQLKASLPKTIEDVAEKLTVAYEPIWAIGTGKTATVEDIAEMHAEIRALLVKMYGEEAGAEVRILYGGSVKPENAGEILSTAEVGGALVGGASLAADSFMGIALAAGEADEG

SEQ ID NO: 82854 - protein, 381 aa, Yarrowia lipolytica CLIB122
MSTEGKTITCKAAVAWEAGKPLTLEDVEVAPPQAHEVRVKVTYTGVCHTDAYTLSGSDPEGIFPSVLGHEGAGIVESIGEGVTSVKPGDSVILLYTAECKECKFCKSGKTNLCQKVRATQGKGVLPDGTTRFKCKGKDLYSYMGCSSFSQYTVVADVSLVAVDPSAPQDRTCLLGCGVTTGYGAATVTANVQKGDNVAVFGAGCVGLAVVMGAKERGAAKIIVIDINGNKEAWAYKFGATDFVNPTKLPEGTTIVDKLVEMTDGGCDFTFDCTGNVTVMRQALEACHKGWGESIIIGVAAAGQEIATRPFQLVTGRVWKGSAFGGVKGRTQLPEIVKRYKDGSFEIDNFITHSKPLKDINSAFTDLHKGDCIRTVVDMWQV

SEQ ID NO: 82855 - protein, 307 aa, Escherichia coli
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTAIRHAGGFVSFDPNIREDLWQDEHLLRLCLRQALQLADVVKLSEEEWRLISGKTQNDRDICALAKEYEIAMLLVTKGAEGVVVCYRGQVHHFAGMSVNCVDSTGAGDAFVAGLLTGLSSTGLSTDEREMRRIIDLAQRCGALAVTAKGAMTALPCRQELESEK

SEQ ID NO: 82856 - protein, 444 aa, Saccharomyces cerevisiae YJM789
MKQRFIRQFTNLMSTSRPKVVANKYFTSNTAKDVWSLTNEAAAKAANNSKNQGRELINLGQGFFSYSPPQFAIKEAQKALDIPMVNQYSPTRGRPSLINSLIKLYSPIYNTELKAENVTVTTGANEGILSCLMGLLNAGDEVIVFEPFFDQYIPNIELCGGKVVYVPINPPKELDQRNTRGEEWTIDFEQFEKAITFKTKAVIINTPHNPIGKVFTREELTTLGNICVKHNVVIISDEVYEHLYFTDSFTRIATLSPEIGQLTLTVGSAGKSFAATGWRIGWVLSLNAELLSYAAKAHTRICFASPSPLQEACANSINDALKIGYFEKMRQEYINKFKIFTSIFDELGLPYTAPEGTYFVLVDFSKVKIPEDYPYPEEILNKGKDFRISHWLINELGVVAIPPTEFYIKEHEKAAENLLRFAVCKDDAYLENAVERLKLLKDYL

SEQ ID NO: 82857 - protein, 2159 aa, Chlamydomonas reinhardtii
MILKDQEELARKTKIICTAGPACWSEEGLGKLLDAGCNVLRFNFSHGDHDGHYSVLERFRKVCTAKGSYAACLLDTKGPEIRTAMLKDGKDIELEAGQSIVVEAVGAEYTKWEGYKDAANGETHIGLSYDKLCSSVKPGSKILLADGSISIRVDEITSARTLRGTVMNSKKLGQRKNCNLPGVKVDIPVLTEKDIDDLQQFAAKHKMDFVAASFVQSAADVQFIRRTLDAAPGGEHVKIISKIENLEGLKNYDEILRESDGIMVARGDLGMEIPSEKVPVAQKMMITKANIAGKFVICATQMLESMISNPRPTRAEMTDVANAVYDGVDCVMLSGESANGDFPDIAVSTMAAIVANAEVGVDYYSQYSFIRYWATKGNEIAMTPDECMMSSVASMAVGFTEDTTPEAFRRVARNNTLTIIVVLTADGRAANLVSKYRPPCLVVVASTNEQVLRQAAVSFGQVPLALASLELDSQDLAEKAVEKVRSLGLVAQHTPDCRLIVARGRNSGSADVEPVVTVVKTGGSGLKRRGWSTGNTLYTPSGVPIQRPGVRSLRTTLTNLPLITAPIKNGRCTKVICTMGPSCWSEETMGKLLDAGMDIIRLNFSHGDHKGHFEVLERFRKVCKTKQEEFSAKGAPSAPHWGCLLDTKGPEIRTAMLKDGKDIELVAGQTIFIEAVGADYVKWEGYKDEATGETRIGLSYGKLCSSVQQGNKILLADGSISIVVEEVCSANLLRGTVLNSKKLGQRKNCNLPGVKVDIPVLTEKDIDDLQNFCAKHEMDYVAASFVQSAADVQFIRRVLDEAGGHRVKIISKIENAEGLVNYDEILRESDGIMVARGDLGMEIPAEKVPLAQKMMITKANIAGKFIITATQMLESMISNPRPTRAEMTDVANAVLDGTDCVMLSGETANGSFPEAAVSTMAAICLNAEQMVEVNKRFRFLRNHTPKPMRGAEAVASGAVMTAIDTDAKLMVCITTSGRGVALVSKYRPPMPVVVVTPDAQLVRHCRSVFGQVGVLVPDIESVELNKLVELAAAAARSFGLADVTDGDQIVVLQRRKASPETMIYDDQRLVARAMVYGKAPINEVAHTRYPGDKVVFHRSTKVGLDTILDEEKWKFIVRKTKIICTAGPACWSEEGLGKLLDAGCNIVRLNFSHGDHEGHFSVLQRWRKVCAEKDSHAACLLDTKGPEIRTAMLKDGKDIELVANQKVTIHAVGDEYVKWEGYKDAATGETHIGLSYGKLCSSVKAGNRILLADGSISIVVDEIVDGTTLIGTVLNTKKLGQRKNCNLPGVKVDIPVLTKKDIDDLQNFCVKHKMDFVAASFVQSQQDVLYIRSILDDAGGKDVKIISKIENAEGLKNFDEILEVTDGVMVARGDLGMEIPVEKVPLAQKMLITKANIAGKFVICATQMMESMITNPVPTRAEMTDVANAVWDGVDAVMLSGESANGAYFGQAVETMARIARSAEIGVNFYQSFDYTHKFTPKPVSAVEAMCSSLAKNAVDIRPGMIVVFSEGGKVARLVAKYRPCAPVLVVTSNAGLARYCSSLFGCYPRLLPEPIKDVAAMPKAVSEAMAYGVERGLCVAGKEVIVLVSNMVAKGVGADASEALPERQIFVTIAPGALNIDALGSLAFSTSALDPKFVAKTISLRSTTIDLPMLVSSSSPVRKTKLGFTMGPSCNSEDVLRQLVRGGANIARFNFAHGEMAAHQAMLNKLRTVCAAEGRTVAVMLDLDGNVLRTSDLIDYDTKQPIKKIELQAGDKVELYGTDDTSPNHFVGYKVADKVRIGVSLADLAECVKPGGLIRVHDGLITFEVVSVRPGGPVQAVVLNHAFLYARKPVHLVGVTIHSSFPAPADLEALMAFALPNAIEFVAVGVNSRNDVNAIRSFLDDNGGESIKLIAKIESEGGLRNLDEIIDAADGVILARGKLGMVVTPEKVALAQSVVVTKANVAGKPVIISRQMLESMVSNPRPTRAEMTDVANAVLDGASCLMLCSETSSGAFPADSFTTAVNIVRNAEHATSYASMHSFIRDFSAKPFNTIEAAAVALAQACMDSKLALCLVVSDTGEAANIVTKYRPPVPVMVVSSQPPVVAQRELCFGQFGYLASDGIVSAPAGDVRDLAADVVADARARGLCGPEPQRVAVMTGSSAMDVVHNAIVQIVEV

SEQ ID NO: 82858 - protein, 77 aa, Listonella anguillarum
MSNIEERVKKIIVEQLGVDEAEVKNEASFVEDLGADSLDTVELVMALEEEFDTEIPDEEAEKITTVQAAIDYVNSAQ

SEQ ID NO: 82859 - protein, 573 aa, Marinobacter sp. ELB17
MSRSHLFSLRPGHAIREACVQEPYSPRRFAKDVMAGITVGIIAIPLAMALAIASGVAPQYGLYTAIIAGVVIALTGGSRYSISGPTAAFVVILYPIAQEYGLGGLLLATVMSGVLLLIMAVMRLGRFIEYIPEPVTLGFTGGIAVVIATLQVKDLFGLPIAAMPEHYWGKLAALVQAAPSLDAMSTLVAGVTLAIMLLWPRLKTPVPPHLPAVIVGSVLALWLNSQGASIDTIGSRFSYLLPDGTSGSGIPPFLPEFILPWQRAGADGSPLAVSWNLIQALIPAAFAIAMLGAIESLLCAVVLDGMTGKRHSANSELLGQGLANIIAPFFGGITATAALARSAANYRAGAESPVSAIVHSLVVVLALVALAGVLSYMPMPAMAALLLIVAWNMSEAPKAVHLLKTAPRGDLVVFLTCFSLTVALDMVIAITTGVLLAAVLFMREMAQMTRVTDISSNQRVTQANLPAGWQVFKINGPLFFAAAERIFGELAALSKNARGFILYMDGVTLLDAGGLSALNKLLAACKRDGTRIIIADLQYQPLRALARAGVAPVNGVSQFTPTLADALVQAGEH

SEQ ID NO: 82860 - protein, 449 aa, Pseudomonas syringae pv. tagetis
MNAALSQWKATHAARLSQYSAVRVSGRVSAVRGILLECKIPAAKVGDLCEVSKADGGMLLAEIVGFTQECTLLSALGAPDGIQVGAPIRPLGIAHRIGVDDSLLGCVLDGFGRPLLGDCLGAFAGPEDRRETLPVIADALPPTQRPRITNALPTGVRAIDSAILLGEGQRVGLFAGAGCGKTTLMAELARNMGCDVIVFGLIGERGRELREFLDHELDETLRARSVLVCATSDRSSMERARAAFTATAIAEAFRARGQKVLLLLDSLTRFARAQREIGIASGEPLGRGGLPPSVYTLLPRLVERAGMSENGSITALYTVLIEQDSMNDPVADEVRSLLDGHIVLSRKLAERGHYPAIDVSASISRILSNVTGREHQRANNRLRQLLAAYKQVEMLLRLGEYQAGADPVTDCAVQLNDAINAFLRQDLREPVPLQETLDGLLRLTAQLPE

SEQ ID NO: 82861 - protein, 320 aa, Magnetospirillum magnetotacticum MS-1
TSYDSASPASSQPDGASDYYFLNPAPSARKKSAAQPRVEPSRHAGPAPRVTSHGSVPAGAPFDVEHVRKDFPALHQSVNGHPLVWLDNAATTHKPQSVIDATSEFYGRHNSNIHRAAHTLAARSTDLFEGGREKTRRFLNAPSKDDIVFLRGTTEAINLVANSYGRAHIGPGDEIIVSTIEHHANIVPWQLLAQSTGATIRVIPVNDRGEIIFEQYAALLSGRTKIVSVTHVANALGTVNPIREIIALAHAYGVPVLVDAAQSKPHIPIDVQSLDADFLVFSGHKVFGPTGIGALYGEKHLLQAIRRVKRRHMIRTSLLE

SEQ ID NO: 82862 - protein, 429 aa, Escherichia coli CFT073
MTTDDLTFDQRHIWHPYTSMTSPLPVYPVASAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKMCDREGILLIADEIATGFGRTGKLFACEHAEIAPDILCLGKALTGGTMTLSATLTTREVAETISNGEAGCFMHGPTFMGNPLACAAANASLAILESGDWQHQVAAIEAQLREQLAPACDAEMVADVRVLGAIGVVETTRPVNMAALQKFFVEQGVWIRPFGKLIYLMPPYIILPQQLQRLTAAVNRAVQDETFFCQ

SEQ ID NO: 82863 - protein, 432 aa, Chlamydomonas reinhardtii
MILKDQEELARKTKIICTAGPACWSEEGLGKLLDAGCNVLRFNFSHGDHDGHYSVLERFRKGAPSAPHWGCLLDTKGPEIRTAMLKDGKDIELVAGQTIFIEAVGADYVKWEGYKDEATGETRIGLSYGKLCSSVQQGNKILLADGSISIVVEEVCSANLLRGTVLNSKKLGQRKNCNLPGVKVDIPVLTEKDIDDLQNFCAKHEMDYVAASFVQSAADVQFIRRVLDEAGGHRVKIISKIENAEGLVNYDEILRESDGIMVARGDLGMEIPAEKVPLAQKMMITKANIAGKFIITATQMLESMISNPRPTRAEMTDVANAVLDGTDCVMLSGETANGSFPEAAVSTMAAICLNAEQMVEVNKRFRFLRNHTPKPMRGAEAVASGAVMTAIDTDAKLMVCITTSGRGVALVSKYRPPMPVVVVTPDAQLVRH

SEQ ID NO: 82864 - protein, 469 aa, Salmonella enterica subsp. arizonae serovar 62:z4,z23:--
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGTSISGSHVAIDDIEGAWNSSTQYEGGNKGHRPAVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLSRNGVNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPPEEAKEIPQVAGSLEEALNALDLDREFLKAGGVFTDEAIDAYIALRREEDDRVRMTPHPVEFELYYSV

SEQ ID NO: 82865 - protein, 497 aa, Neptuniibacter caesariensis
MTTTIGHLIDGAMIDDASRAQDVYNPSTGEVSKQVSLACAGTVERAIASAQAAFPAWRDTPPAKRAQIMFRFKALLEANADKICEMIGEEHGKIHHDAMGELIRGIENVEYACGVPELLKGEHSRNVGPGIDSWSEFQPLGVVAGITPFNFPAMVPLWMYPMAIACGNTFILKPSERDPTSTLFIAELLHEAGLPKGVLNVVNGDKEAVDILLTDERIKAVSFVGSTPIAEYIYSTANAHGKRCQALGGAKNHAIVMPDADMDNAVNQLLGAAFGSSGERCMALSVAVAVGDEAADTLVSKLTEAMKPLKVGAFSEKTNDFGPVITRAHQEKVVGYINSAEADGAQVVVDGRAPAVAGYENGFFVGATLIDRVTSEMVSYQEEIFGPVLQVVRANSMEEAMKLINDHEYGNGTCIFTRDGEAARYFSDHIQVGMVGINVPLPVPVSYHSFGGWKRSLFGDLHAYGPDAVRFYTKRKTITQRWPSSGVREGVSFAFPS

SEQ ID NO: 82866 - protein, 337 aa, Acrosiphonia duriuscula
MPRNRDDSPDGAYLIHGRYEKIEKLGEGTYGKVYKARDSKTDQVVALKKCRLQLDAEGVPPTTIREVSLLQVLSRSNHVVKLLGVEQIEEDGKVVLYLIFEYLQHDLKKFMDFKKKEKHNPLQPELVKPYLFQLIRGMAFMHQHGVMHRDLKPQNLLVDPKTNVLKIADLGLGRVFALPCKAYTHEIVTLWYRAPEVLLGTKIYSLPVDVWSIGCIFAEMVKGIPFFPADCEIAQLFMIFQVLGTPNEEVWPGVTSLRDWHMYPQWQPMDLHTHLEGLLDHQGCDLLKKMLVYNPNKRIPAKQAMKHPYFDDLDMEVMDALENPEVLNAGMEYQENA

SEQ ID NO: 82867 - protein, 448 aa, Neptuniibacter caesariensis
MNNKNEILNQAGLSSEQLDAHWMPFTGNREFKKNPRIITAAEGNYYTSSDGRKIFDGLSGLWTCGAGHSRPEIAEAVSKQVRELDYSPAFQFGHPKSFELAHRITEMMPEGLNRVFFTGSGSESVETALKIARAYWRKKGQSSKTRLIGRAKGYHGVNFGGISVGGIAPNRAIYGQGIDAIHLPHTQIPENRFVQGLPEHGASQADELENLIATHDASNIAAVIVEPLAGSAGVIPPPKGYLQKLRDICNKHDILLIFDEVITAFGRMGAKTGSEAFGVTPDLMTTAKQLTNGVIPMGAVIAKQEIYDTFMETGGPDYMLELPHGYTYSAHPVACAAGLAALDILEQDKLIERVNSIAPQFQEMLHSLKGTQYISDIRNFGLAGALTIEAAPGEPALRPFQIAMKCWEKGFYVRYGGDTIQLGLPFTTEIDEIDSLINALGDSISELD

SEQ ID NO: 82868 - protein, 520 aa, Enterococcus faecalis V583
MTNVADLTSVEKIIVLDFGSQFNQLITRRIREFGVFSELLSHRTTAEEIRKIAPKGIIFSGGPNSVYDKDAFSIDPEIYELGIPILGICYGMQLMTHNLGGKVEPAANREYGKAELEILGDATLFQGTPAKQTVWMSHGDLVTEIAPGFEKVGTSNDCPIASIEDANRKFYGVQFHPEVRHSEYGNDLLRHFAFDVCGCTGDWSMENFIDMEVAKIREQVGDKKVLLGLSGGVDSSVVGVLLQKAIGDQLTCIFVDHGLLRKGEAEQVMESLGGKFGLNIIKVDAKERFLSKLAGVSDPEQKRKIIGNEFVYVFDDEATKLAGEEGVSFLAQGTLYTDVIESGTETAQTIKSHHNVGGLPEDMQFELIEPLNTLFKDEVRALGTELGMPDAIVWRQPFPGPGLGIRVLGEITEDKLQIVRDSDAILREEIAAAGLDRDIWQYFTVLPGIRSVGVMGDGRTYDYTVGIRAVTSIDGMTADFARIPWDVLQKISVRIVNEVAHVNRIVYDITSKPPATVEWE

SEQ ID NO: 82869 - protein, 466 aa, Streptococcus agalactiae NEM316
MDAKTKYKAKKIKAVFFDIDDTLRVKDTGYMPPSILKVFKALKDKGIVVGIASGRARYGVPKEVQDLNADYCVKLNGAYVKDKDKNIIFHRPIPAEYVEQYKKWADTVGIKYGLAGRHEAVLSDRDDLVNDAIDIVYSDLEVNPDFNKEHDIYQMWTFEDKGDSLHLPEPLDEHLRLIRWHDHSSDVVLKGTSKALGVSKVVEHLGLKPENILVFGDELNDLELFDYAGLAVAMGVSHPEAQKKADFITKKVEEDGILYALEELGLIEKELTFPQVDIENTEGPVAVIKTNHGDMTVKLFPDHAPKTVANFIGLAKQGYYDGIIFHRIIPDFMIQGGDPTGTGMGGESIYGESFEDEFSEELYNVRGALSMANAGPNTNGSQFFIVQNTKIPYAKKELERGGWPTPIAELYAGQGGTPHLDRRHSVFGQLVNQSSFEVLDEIAAVETGSQDKPLEDVVILTIEVKE

SEQ ID NO: 82870 - protein, 198 aa, Salmonella enterica subsp. arizonae serovar 62:z4,z23:--
MSAPDIRHLPSDSGIEVAFAGRSNAGKSSALNTLTNQKSLARTSKTPGRTQLINLFEVVDGKRLVDLPGYGYAEVPEEMKRKWQRALGEYLEKRQSLQGLVVLMDIRHPLKDLDQQMIQWAVESNIQVLVLLTKADKLASGARKAQLNIVREAVLAFNGDVQVEAFSSLKKQGVDKLRQKLDSWFSELAPVEETQGTE

SEQ ID NO: 82871 - protein, 138 aa, Rhodobacter blasticus
HDDMPCMDNDDLRRGLPTVHVKWDEATAVLAGDALQTLAFELLCDPVAGPAEVRIGLVQALAQASGAEGMVLGQALDIAAETAGRPLTLDEITALQAGKTGALIRFSAEAGAILAQADRAPLRTYATALGLAFQIADD

SEQ ID NO: 82872 - protein, 88 aa, Brassica napus
MASQQEKKQLDERAKKGETVVQGGTGGKSFEAQQHLAEGRSRGGTTRKEQLGTEGYQQMGRKGGARTGKADDEDEGEEMDGPTSRTRT

SEQ ID NO: 82873 - protein, 335 aa, Arabidopsis thaliana
MIVKTLWTGETPKAESVKETMESYFKALLGFLLCCHGSTLGAGPTLSSIVHGSVKQIVDSSFRLFQGSVSLYDGSYEKGEKPSISQLSGAVLEACSSFKKVPTTNLIAIGSAISQVSVIMKDVLNEMKKVKPACPSSEGEASGDDFSPEQIEVAKMVADIVYEAMTVIIVIRVITRMMEKENSNENSVFVESLEKLLKLCQRSGVVIEELGTCVYHPPLKIDKITQTVKILEGNLDEVEAQVEYMKRSSNAFPGVCRKLRDAIKLMEVGLEKRKDLNQILISRQNTLYNALQISEQPSKQDTIGSMFGFLCIYMRNRHVSYKLKTASPFPKFIFR

SEQ ID NO: 82874 - protein, 657 aa, Cryptococcus neoformans var. neoformans JEC21
MSEGAGSSSNLGKRPRDGENTSPAPENVNNNGLEVPEMPPADMEDSSDDEIGPMPGGDIVISKGRKKKRTVLPHEKLYLASLPDTDRYYKSFMHREPLNSITMTRTNFVITTSIDGHLKLWKKQEQGIEFVKHYRASLKAIVGVSASDDGKLFATVSEGGEGRVFDVVNFDMINILKFPYTPKACCWVHEPGAGQPLLAVSDVASPTIRIYDGRGDGKPLYELTKLHRAPVHLMVYTAKYDCVVSADEDGFMEYWQPSEPWGLPSVPGLWQYKSSTDLFHFKKSKTIPTCVTFSPNSSHFVTLALPSRAVHIFNFLTGKLTRTYDESLTAVMEMQQADTAVFKLDDMDFGRRLAAERELDRSESGPGGLLRTANAVWDESGNFVLYPTMLGIKVVNTVTNKVARVLGKDETLRFLNIALYQGAPAKKGVTTVQMAASANPLLQDKASRDPHLFATAYQKQRFYLFARSDKEESKGERDVFNERPTREEQTVAVPAEEKKRPSAKRCTIHTTKGDISVQLFPDEAPKTVENFITHARNGYYNGTIFHRIIKKFMIQGGDPFGDGTGGESIWGGTFEDEISPRLRHDRPYTLSMANAGPGTNGSQFFITTVPCQWLDGKHTVFGRAVGGLDSVDAIEDAKTDKNDRPFEDISISSITVE

SEQ ID NO: 82875 - protein, 419 aa, Sulfolobus solfataricus P2 [sequence omitted]

SEQ ID NO: 82876 - protein, 260 aa, Shewanella sp. MR-7
MNNQVKIKSAEEIALMRRAGQLLAQVFQMLDTYVRPGISTMDINDTVEAFIVNELKSRPASKGQYGYQYVLNSSINEVVCHGVPSANEVIKSTDIINLDITLEKDGYIADSSKMYVMPQAPTPAQKLADVTYLAMWQGIKQVKPGATLGDIGHAIQQYAQSFGYSIVRDYCGHGIGQEMHEEPQVLHYGKPNQGLKLKAGMVFTIEPMVNQGTEKIKLKKDGWTVVTRDKKLSAQSEHTILVTPTGYEVLTLRHDEQSPR

SEQ ID NO: 82877 - protein, 460 aa, Bdellovibrio bacteriovorus HD100
MAKLVVSKFGGTSMGDADCMLRSAEVSFRQGSGLVVVSATSGTTNDLIALGKTAESQAWSESEKILSKIQDKHNKIAQDLKLPADAKAKLETLFEEMSSLAKGMHLLKDCSVKAMDTLMSLGERMSSVLFTEAMSQVLKKHGSAKSAELLDVRTVLRTDDQFGKAKPLTNDVANLCQKNLSFLREGKKVMCTQGYIGMTEEGITTTLGRGGSDYSAAILAEGVSADVLEIWTDVAGIATTDPRLCPKAQPISEISFKEASELATFGAKVLHPATLLPAIRKNIPVFVGSSFDVEARGTWVRMDVEDHPLIRAMALRKKQVLVTLSTPEMLYAHGFLFQIFKIFNDHKVSIDAITTSEISVSVTLDDSTLLNKNLIKDLSQIADVQVEENLALISLIGNNINHTPGLGKRIFETIPDINVRMICLGASKHNFCFLVADEQGPEVIKRLHACFIEAGIEEMA

SEQ ID NO: 82878 - protein, 571 aa, Rhodococcus sp. RHA1
MSWTGSLAQLPGIATARAYRREWLRPDITAGLVLTALLIPAGMGYAEAAGLPAYAGLYATIIPLLAYALVGPSKILVLGPDSSLAPLIAAAVLPLAVAGDPESALALAGVLGVLVGLILLVGGFLHLGFVTELLSKPIRLGYLNAIALIVVVGQLPKLLGFSVDASGLIGEIGEIGQSVIQGNIDPVAAAMGIGSLAVIVGFRIWLPRIPGVLVAVVGAIILSAALGLTDDIGMVGALPAGLPLPSFGGVDWGDVGNLVGPAAGIALIAFADTGVLSRTFAARHGEDVNGSTEMKAVGVANIAGGLFGGFPVSASGSRTPVAEQSGARTQLACVVGALAVLVFVLVAPGVTTYLPDATLGAVVIVAATALVDVGGMVRMWRMSTVEFGLAVAAFLGVALVGVLQGILVAIGLSFVAVVAQAWQPYRTELVRTPDRPGFHDVQRHPGGLRIPGLVLVRFDAPLFFANGEIFDEYVRSVVAAAPTPVEWVVVASEPITGLDTTAVDELVDLDTYLEGKEIRLVFAEMKGPIKDRLIRFGVGDRFDSSHFYPTIESAVTAFHSRADHTGDPSGG

SEQ ID NO: 82879 - protein, 499 aa, Legionella pneumophila str. Paris
MIRNSMKSHTELLSWNLLQKEADRVRLNSDSLTCVVPDSNNYESSKQINCIEYDYSRQRVNRTIIDLLIDLANEVKLQEKIDNLINGKKINISENRPALHTALRDLGNKSIMIDGLDIMSAVINTREKIKVISNQIREKKWLGHSGLPITDIVNIGIGGSDLGPRVCINALSNYISKEFNYHFISDVDPASFNDVIAKINPQTTLFIVSSKSFTTKETLLNARKAFALYEDTASIDQHFIAVTAHPERAYQMGIKTVLPIWDWVGGRFSFCSAVNLITAIAIGYEQFVELLAGAHDVDTHVQFTDFKNNIPVLMALIGIWNNNFLNIHNLLILTYSKKLEYFVPYVQQLDMESNGKSIDVNGSMVDYATGPIVWGGLGNQAQHSYFQLLCQGTHRCVGDFITLKTNDEHEINSMCHYKMKVLSEGIQTIENPYGYIPGNMPMNHLILSDCSPYTLGALVALYEHKIFVQSVIWNINPFDQPGIESAKSAHREITLSSES

SEQ ID NO: 82880 - protein, 496 aa, Pseudomonas aeruginosa UCBPP-PA14
MFELSDWQRRAATQRFIDQALIGGRQRPAASGATFDAIDPASNRLLARVAACDAADVDAAVAAARRAFDEGPWARLAPVERKRVLLRLAELMLAHREELALLDSLNMGKPVMDAWNIDVPGAAHVFAWYAESLDKLYDQVAPTAQQALATITRVPLGVIGAVVPWNFPLDMAAWKLAPALAAGNSVVLKPAEQSPFSALRLAELALEAGVPEGVLNVVPGLGEQAGKALGLHPEVDALVFTGSTEVGKYFMQYSAQSNLKQVWLECGGKSPNLVFADCRDLDLAAEKAAFGIFFNQGEVCSANSRLLVERSIHDEFVERLLAKARDWQPGDPLDPASRAGAIVDRRQTAGILAAIERAQGEGATLLGGGRQLTINGSDNFIEPTLFGDVRPDMQLAREEIFGPVLAISAFDSEDEAIRLANDSRYGLAASLWSDDLHRAHRVARRLNAGTVSVNTVDALDVAVPFGGGKQSGFGRDLSLHSFDKYTQLKTTWFQLR

SEQ ID NO: 82881 - protein, 186 aa, Halobacterium sp. GN101
MSTLTDTIHIENVVASSTLGAELALEQLAADLPGADYNPEEFPGVIYRLDDPPSTTLIFDSGKAVCTGAQTVDDVHEALSIVVEDLRELGIDIAADPPVDVQNIVCSADLDQPLNLNAIAIGLGLEAIEYEPEQFPGLVYRLDDPDVVVLLFGSGKLVITGGSDPDDATVALEDVHDRLTDLGLLE

SEQ ID NO: 82882 - protein, 429 aa, Salmonella enterica subsp. enterica serovar Paratyphi B str.
MTTDDLAFDKRHIWHPYTSMTSPLPVYPVERAEGCELVLASGERLIEGMSSWWAAIHGYNHPQLNAAMKAQIDAMSHVMFGGITHQPAVNLCRKLVAITPEPLECVFLADSGSVSVEVAMKMALQYWQARGESRQRFLTFRHGYHGDTFGAMSVCDPDNSMHSLWKGYLPENLFAPAPQSRMDGEWDESDIAPFARLMAAHRHEIAAVILEPIVQGAGGMRIYHPQWLRRIRNMCDREGILLIADEIATGFGRTGKLFACEHAGIAPDILCLGKALTGGTMTLSATLTTRQVAETISNGEAGCFMHGPTFMGNPLACAVACASLTLLESGEWRQQVASIESQLRAELAPAQSSPWVADVRVLGAIGVVETTHTVNMAALQRFFVGQGVWIRPFGKLIYLMPPYIIRPDQLRRLTQAVNDAVHNETFFSH

SEQ ID NO: 82883 - protein, 309 aa, Burkholderia sp. 383
MPMPLDPQIAAILKTLEAAPPMESLSVDALRNSLAYPPLERRTVVGEVVDFDMPLEGRVLAARLYRPKLAQSDGVTVFFHGGGFVIGNLDTHDHVCRDLCAESGAAVIAVDYRLAPEHPFPAAVDDCFDAVRWIAEHADTLSFDPSRIVVAGDSAGGNLAAVTALKIRDEGGPTLRAQVLVYPVTDYHTPPTRSYIENQSGYSLTRAAMIRFWNDYVANEREALHPHACPLRAKSLAGLPRALVITAGFDPLRDEGEAYANRLFDAGVPVTFRRHDDMIHGFFRMGPACAAAQEGLLRAAAWIRDVMAR

SEQ ID NO: 82884 - protein, 119 aa, Streptococcus pyogenes
MDKIVLEGCRFYGYHGAYKEEQTLGQIFLVDLELSVDLQAASLSDQLTDTVHYGMVFDSVRQLVEGEKFILIERLAGAICEQLFNEFPPIEAIKVAIKKENPPIAGHYKAVGIELERQR

SEQ ID NO: 82885 - protein, 436 aa, Coxiella burnetii RSA 493
MHGTVVVGFYGMTHLGLVSAVAAASKGYQVIGYDPNEMLIAELKQKKYPIEEPQFPELMVDNADRLRFTAELDQLLAAELIYVAIDVPTDAENHSDLQPIRYALEQLQRRLRREQIVVVLSQVQPGFIRAAEFPAEQLFYQVETLIFGRAIERATKPERFIVGCPDPTKNLPSCYHTFLKSFHCPILTMRYESAELAKISINMYLVAAVMTSNLLAELASAVGADWQEVVPTLRLDKRIGQYAYLEPGLGISGGNLERDMVTIKQLAQQYSTHAELVKTWLADSPYYKNWVWRCLQTEILSKTEAPIVAILGLAYKTNTHSIKNSPSMALINLLKTTKSQIQVHDPAVKKEDREDTATHCDSALKALQSADVLVIMTPWLDYSKLTANDFLAHMRGRVIIDPYRVLNYEALIQAGFYVHTLGVNSNALKKKEAAYA

SEQ ID NO: 82886 - protein, 502 aa, Arabidopsis thaliana
MTVLWFVSLILLISILLVAVKHSKRRWVRQPPSPPGLPIIGNLHQLGELPHQSLCKLSKKYGPVMLLKLGRVPTVIVSTPGTAKQVLKDYDLHCCSRPSLEGTRKLSYNYLDIAFSRFDDYWKELRKLCVEELFCNKRINSIQPIKEAEMEKLIDSIAESASQKTLVNLSDTFLSLNVNVICKAVFGVNFQGTVLNNDKFQDLVHEALEMLGSFSASDFFPYVGWIVDWFTGLHARRERSVRDLDAFYEQMIDLHLQKNREESEDDFVDLLLRLEKEEAVLGYGKLTRNHIKAILMNILLGGINTSAITMTWAMAELIRNPRVMKKVQSEIRAQIGKNNKTRIISLDEINHLSYLNMVIKETCRLHPVAPLLVPREVISEFKINGYTIQPKTRLHVNVWAIGRDPEIWKDPEEFLPERFMDCDIDVKGQDYELLPFGSGRRICPAVYMGITTVEFGLANLLYHFDWKLPEGVAVEDIYMDEASGLTSHKKHDLLLVPVKSLV

SEQ ID NO: 82887 - protein, 195 aa, Alexandrium catenella
MPVEPAPSARADAVFVPGLMKGKVLFVTSGGSGIGLGICLAFARLGAKVAICGRTESKLIEAAESIRRAGAEDVLYAKADVRESDQCHAAVDMVGSKWGKIDVFVNNAAGNFMSLAEDISPNAFKTVVDIDLRGTFHMSKAALPWLREAARVWFRRNHAVHIRHLVLHCDALSRPCGSSQGWYRLPDEDTRCRMV

SEQ ID NO: 82888 - protein, 312 aa, Burkholderia sp. 383
MSLDAATRAFMDKLAATPSKPRHLMSPDEARTAFARISTILSPGADVRSTIALDIPVDGGTLRARLFVPDGRPQALLVYFHGGGWVVGGIDAFTPLCREIAAGAGVAVALVEYRKAPEHPFPGPVHDAWQAAQWLASQRVALLGAELPVFVGGDSAGANLAIAVTLLTRREGSMSFAGQLLVYPVTDCVFDRPSYVAAENQLLTTRDAMMGYWNHYAPSDAARHSSLASPLREADLSGLPEAIVVTAEHDVLRDEGEAYAQRLEQAGVPVHHRRALGQMHGFLMMIGVLPGSRDGLEFVCERLRDLVARSSR

SEQ ID NO: 82889 - protein, 421 aa, Chlamydomonas reinhardtii
MSQVGLDTILDEEKWKFIVRKTKIICTAGPACWSEEGLGKLLDAGCNIVRLNFSHGDHEGHFSVLQRWRKVCAEKDSHAACLLDTKGPEIRTAMLKDGKDIELVANQKVTIHAGYKDAATGETHIGLSYGKLCSSVKAGNRILLADGSISIVIVDGTTLIGTVLNTKKLGQRKNCNLPGVKVDIPVLTKKDIDDLQNFCVKHKMDFVAASFVQSQQDVLYIRSILDDAGGKDVKIISKIENAEGLKNFDEILEVTDGVMVARGDLGMEIPVEKVPLAQKMLITKANIAGKFVICATQMMESMITNPVPTRAEMTDVANAVWDGVDAVMLSGESANGAYFGQAVETMARIARSAEIGVNFYQSFDYTHKFTPKPVSAVEAMCSSLAKNAVDIRPGMIVVFSEGGKVARLVAKYRPCAPVLVV

SEQ ID NO: 82890 - protein, 511 aa, Solanum tuberosum
MAASWCIEKRGSIRNDSFRDNDNIPETGCLSIIVLGASGDLAKKKTFPALFNLYRQGFLQSNEVHIFGYARTKISDDDLRSRIRGYLSQGKENEGEVSEFLQLIKYVSGSYDSGEGFTLLDKAISEHEFSKNSTEGSSRRLFYFALPPSVYPSVCRMIKSYCMNKSDLGGWTRIVVEKPFGKDLASSEQLSSQIGELFDEPQIYRIDHYLGKELVQNLLVLRFANRFFLPLWNRDNIDNIQIVFREDFGTEGRGGYFDEYGIIRDIIQNHLLQVLCLVAMEKPVSQKPEHIRDEKVKVLQSMLPIEDEEVVLGQYEGYKDDPTVPNNSNTPTFATMVLRIHNERWEGVPFIMKAGKALNSRKAEIRVQFKDVPGDIFRCQKQGRNEFVIRLQPSEAMYMKLTVKKPGLEMSTVQSELDLSYGQRYQGVVIPEAYERLILDTIRGDQQHFVRRDELKAAWEIFTPLLHRIDNGEVKPIPYKPGSRGPAEADELLQNAGYVQTHGYIWIPPTL

SEQ ID NO: 82891 - protein, 410 aa, Brassica rapa
MGFVKKVQSKVFLYVNYLFGVCIGASPKYMSSEANDTQSMGSKCSSVSVRTSPRTEGEILQSPNLKCFSFAELKAATRNFRLDSVLGEGGFGCVFKGWIDEESLTASKPGTGMVIAVKRLNIEGWQGHQEWLAEVNYLGRLSHPNLVKLIGYCLEDEHHLLVYEFMPCGSLENHLFRRGSYFEPLSWNIRLKIALGCAKGLAFLHSAETQVIYRDFKTSNILLDSNYNAKLSDFGLAKDGPTGDNSHVSTRVIGTYGYVDPGYLLNGHLTTKSDVYSYGVVLLEMLSGRKVVDNNRPPREQKLVDWAKPLLANKKKVSRVIDNRIRDQISVKEAHKVATQVFRCLDVDKNQRPNMNEIVFHLENIQASREEGGNKTEKRMRRRRDSFAQQTGVGGIATAYPRPSASPLFV

SEQ ID NO: 82892 - protein, 411 aa, Campylobacter lari RM2100
MNLKEEALEYHLGGKVDIIAKKPMDSAHDLSLAYSPGVAEPCLEIAKDETLAYKYTNKANLVAIVSDGSAVLGLGNIGASASKPVMEGKACLFKKFANVNAYDIEINAHSVDEIVAFCKAVAPTFGGINLEDISAPKCFEIEAALQDLGIPVMHDDQHGTAIISTAGLMNAMEISGKKFEDIKVVVSGAGAAGIASARMYRNLGVKNIVLVDSKGVINTQRSDLNKYKLEFVSDTKDNTLREALKGADVFLGLSAPKILDDEMILSMAKDPVIFALANPVPEVMPEDVKRVRSDAIVGTGRSDYPNQINNVLGFPFIFRGALDVKATKITENMKVAAAKALADLAKLEVTDEVKQAYGIEELSFGRDYVIPKPFDSRVKAVVSAAVAKAAVEDGVALVKEFDYQKYLASLQ

SEQ ID NO: 82893 - protein, 455 aa, Campylobacter lari RM2100
MSMAKQYINETLEKIQTISPRQPIFFQAATEVLNSLEPLLESNKTYQDHAILERIVMPEKTTIFRVVYINDAGKAQTHFGYRVQFNSSLGPYKGGLRFHPSVNLDVLKFLGFEQIFKNSLTGLMIGGAKGGANFDPKGKSEAEIMRFCQAFMAELSKIIGANTDVPAGDIGVGAREIGYMFGAYKKISSNFDGTLTGKKIPWGGSLARTEATGYGCVYFTQEMLAKYNNALEGKECAVSGSGNVAIYTIEKLHQLGAKAITISDSDGFVYDKDGIDLDLLKEIKEVKRARVSDYAALKKGAIFTPKSAYKQGCNGVWSIPCDLAFPSATQNELNLEDIKTLYHNGCRMVAEGANMPSTLEAIDFMLNQKDFLFAPAKAANAGGVATSQLEMQQNASMCQWSFEEVDAKLHKIMKNIFENSYECAKAYNHEGNLVVGSNIAGFKKVADAMIDHGYI

SEQ ID NO: 82894 - protein, 857 aa, Candida albicans
MIRQVNKKAISNSLFKRLSLSGSAFANITANKKSSTHQLNQKTQLANVRFYSTKSTVIQLLNNIGSKREVEQYLKYFTSVSQQQFAVIKVGGAIITQQLNELASCLAFLYHVGLYPIVLHGTGPQINELLENEGVEPEYIDGIRITNPKTMEVVRKCFLEQNLRLVTALEKIGVHARPITAGVFEAEYLDKDKYQLVGKITSVNKSPVEAAINSGYLPILTSLAETSSGQLLNVNADVAAGELAREFEPLKIVYLNEKGGIINGNTGEKVSAINLDEEYEDLLKESWVKYGTKLKIKEIHDLLQHLPRSSSVAIIDVNDLQKELFTDSGAGTLIRRGYRLINRNSLRDFGNPDLLRNALLRDPEIKTGKVSVASYLKFLDSVQFKSYGDEPLEVLAIVVEQNDKIPKLDEFLSSKTGWLNNVTDNIFNAIKKDYSQLCWVVNENDANLPWYFSKSDGSFAKNGQILFWYGLNIDEASKLIKEFDSSSIGSSLSSSKESGVFTSAQQKRGFHHSTVRRNTNPNPPLSEGKQTERKKVALIGARGYTGQNLIKLIDNHPYLDISYVSSRELEGQKLQGYNKDNIVYSNLQIEDIKRLEENNEVDVWVMALPNGVCKPFVDTIDLVQNPNSKIVDLSADYRFDTTGEWTYGLPELNDRKTIAQAKKISNPGCYATAAQVAIAPLKEYISGTPSIFGVSGYSGAGTKPSPKNDVNLLSNNLIPYSLTDHVHEKEISSQLGLQVAFTPHVAQWFQGITHTINIPIKKGSLTSREIRNIYQDRYQGEKLITISGEAPLVKDISGKHGVVVGGFAVNSNEDRVVIVATIDNLLKGAATQCLQNINLSQEFGEYDGIPTESLIRG

SEQ ID NO: 82895 - protein, 376 aa, Nocardia farcinica IFM 10152
MKTKGAILWGIDQPWSVEEIEIGDPVAGEVQIRMETAGMCHSDHHIVTGATPMPGYPVMGGHEGAGVITKLGPNVPADLQVGDHVILSFIPACGRCPACVAGHMALCDLGAGLLMGQAISDGTYRIQARGENVIPMCLLGTFAPYMTVHHTSVVKIDPSIPFEVACLVGCGVPTGFGSATHVANVMPGETVVIAGIGGVGMSALQGAVLSGASKVVAIDPVPWKREQAQKFGATHTYASMAEAIMPLMEITEGRMAEKVILTMGEMHGDYVEEGLILTSKAGTLVVTSMGRMDEGTVKMNSFLLSMLQKTVKGCIFGGGNARQDAPRLLALYKAGQLNLDDMVTRSYSLEEINQGYQDMLDGKNLRGIIRYTEADW

SEQ ID NO: 82896 - protein, 329 aa, Setosphaeria turcica
MGAFGLVCSAKDQLTNQAVAVKKIMKPFSTPVLSKRTYRELKLLKHLRHENIISLSDIFISPLEDIYFVTELLGTDLHRLLTSRPLEKQFIQYFLYQILRGLKYIHSAGVVHRDLKPSNILVNENCDLKICDFGLARIQDPQVTGYVSTRYYRAPEIMLTWQKYDVEVDIWSAGCIFAEMLEGKPLFPGKDHVNQFSIITELLGTPPDDVIQTICSENTLRFVQPLPKRERQPLANKFKNAEPEAVDLLENMLVFDPRKRVRAEQALAHPYLAPYHDPTDEPIAEEKFDWSFNDADLPVDTWKIMMYSEILDYHNVDAAAQDAPESNGS

SEQ ID NO: 82897 - protein, 515 aa, Oryza sativa Japonica Group
MGEDGGVNSSSNSPAAAVGLVLVVAICTYLAVVATRKQKRRRRRRPPVVGTAFHQLYHVRRVHDYHTALSREHMTFRLLVPAGREQIYTCDPAVVEHILRTNFANYGKGSFNHGNMSDLFGDGIFAVDGDKWKQQRKIASYDFTTRALRDFSGDVFKRNAAKLAGVVSSHAASNQSMDFQGFLMRATMDSIFTIAFGQDLNTLDGSGEGRRFAAAFDDASEFTMLRYLNPFWKLSRLLNVGAEAMLKERIKVVDGFVYKLIRDRSDELSNTKAHDTDSRQDILTRFIQATTSDSGTVDYKYLRDIILNIVIAGKDTTAGSLAWFLYMMCKHPEVQEKICHEAMEATNAGEAASIDEFSQSLTDEALNKMHYLHAALTETLRLYPAVPLDNKQCFSDDVLPNGFNVSKGDIVFYIPYAMGRMESLWGKDAESFRPERWLDENGVFQQESPFKFTAFQAGPRICLGKDFAYRQMKIFAAVLLRFFVLKLRDEKEIISYRTMITLSVDQGLHLTAMAR

SEQ ID NO: 82898 - protein, 317 aa, Oleomonas sagaranensis
MTLDAQAKAILDQIARSPMPKLHQVPASVARQMFEISCKLTEIKNLPIGRVEDRVIPGPDDTELPIRIYTPVAAPPGPLPVLVFFHGGGFVIGSLDSHDAPCRLIANEARCLVVSVDYRLAPENRFPAAVDDCLAAVTWVARNAAEINADPTRIAVGGDSAGGNLSAVVSQQLRDAGGPKIVFQLLIYPATDALHEGLSRTSNAEGYMLDKDLMSWFFAQYLGDGGGVDLADPRFSPLRHANLGNLGTIHVVVAGFDPLRDEGIAYAEALKAAGNKVTLSEFKGQIHGFCSMAGVIEAGRTALVEGAALLKEAFAQA

SEQ ID NO: 82899 - protein, 417 aa, Rhodococcus sp. RHA1
MTWALPAIAGVLLVFAAISGRIEGTPITAPIVFTGSGLLLGGISVGLIDIESTAEIIKLLAEVTLALVLFSDASHVDLPALRAEISLPARLLGIGLPLTIAVGFGAAVVMLGDFAWPEALLLAVILAPTDAALGQAVVTLPLLPSRVRQGLNVESGLNDGICVPLFLIVLAIAQAESGAIGHGAAVRLVAEQIGYGIVAGLAAGVIAAAILITAQRRGTIDPLWAQIVPVAAAVLAYTVAVPLGGSGFIAAFVGGLTYGTIRRRKAAGSDGAGLLDESGDLFNAVTFIVFGAILLGPALGHLSWAVLGYAVVSLTVVRMIPVALSMIGMHARAPTVGFIGWFGPRGLATIVFAILILEEPGELPHEELLLTTAIITIGLSVLAHGLSAAPLANRYATWFRNNPRGEEQPAQEATPST

SEQ ID NO: 82900 - protein, 449 aa, Mycobacterium bovis AF2122/97
MTVSIAPPSRPSQAETRRAIWNTIRGSSGNLVEWYDVYVYTVFATYFEDQFFDRADRNSTVYVYAIFAVTFVTRPVGSWFFGRFADRRGRRAALTFSVSLMAACSLIVALVPSRSSIGVAAPILLILCRLVQGFATGGEYGTSVTYMSEAATRERRGYFSSFQYVTLVGGHVLAQFTLLVILAVFTREQVHEFGWRIGFAVGGGAAIVVFWLRRTMDESLSQERLTAIKAGRDHDSGSLRELATHYWKPLLLCFLVTLGGTVAFYTYSVNAPAIVKSVYGSQAMTATWINLVGLILLMMLQPIGGMISDKIGRKPLLLWFGVGGLIYTYVLVTYLPETRSPTMSFLLVAVGYVILTGYCSINALVKSELFPAHVRALGVGVGYALANSVFGGTAPLIYQALKERDQVPMFIAYVTACIAVSLIVYVFFIKNKADTYLDREQGFAFYGHA

SEQ ID NO: 82901 - protein, 195 aa, Triticum aestivum
AYLGDSIEQVCTKKQAGTGPEFPGYRRPTRPKKYVILFFYPLDFTFVCPTEITAFSDRHEEFEKINTEILGVSVDSVFSHLAWVQTERKSGGLGDLKYPLVSDVTKSISKSFGVLIPDQGIALRGLFIIDKEGVIQHSTINNLGIGRSVDETLRTLQALQYVQENPDEVCPAGWKPGEKSMKPDPKGSKEYFAAI

SEQ ID NO: 82902 - protein, 263 aa, Pseudomonas aeruginosa UCBPP-PA14
MPTVRLADGDLNYSLEGPAGAPVLLLSNSLGTDLGMWDTQIPALTAHFRVLRYDTRGHGASLVTPGPYAIGQLGADVLALLDALDLPRVHFCGLSMGGLIGQWLGIHAGERLGRLVLCNTAAKIASDEVWNTRIDTVLKGGEQAMRDLRDASVARWFTAGFAEREPAQVERIVAMLAATSPQGYAANCAAVRDADFREQLGLVQAPTLIVAGSHDAVTTPDNARFMQARIADAQLVEFAAAHLSNVEAGDAFSRRLVDFLLSA

SEQ ID NO: 82903 - protein, 339 aa, Brassica napus
  misc_feature (252)..(252): Xaa can be any naturally occurring amino acid
MAGGKIKIGINGFGRIGRLVARVVLQRDDVELVAVNDPFITTEYMTYMFKYDSVHGQWKHNELKVKDEKTLLFGEKPVTVFGIRNPEDIPWGEAGADFVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVXRLEKAATYDQIKKAIKEESEGKLKGILGYTEDDVVSTDFIGDSRSSIFDAKAGIALSDNFVKLVSWYDNEWGYSTRVVDLIVHMSKA

SEQ ID NO: 82904 - protein, 343 aa, Burkholderia sp. 383
MFRFLTKTKTVKAVINDRAITVEPAETLLQAALRHGIDFPHSCRVGGCATCKCKLVDGRVKELTQTGYILSDDDLDQGFILACQSIPQSDVTIAVDTSRQAARRKIDGRVIGQDRMTHDIVRLRVQLDESLPYKAGQYAQLSIASLPGEARHYSFATSVRPNAQVNFLVRKVPGGVFSGHVHAHDLVGRTVSVEGPLGDFWMRPADAPLILIAGGSGLAPILAMLEDGVAARTTRAVTLLFGARAQHDLYALDTIHDLAARWPGRFDFQPILSDEPADSSWRGSRGMVTDAIAADLPAQTHAYLCGPPRMIDAATDVLVARGLSRSRIHADRFTTQHDTQAIA

SEQ ID NO: 82905 - protein, 448 aa, Pseudomonas aeruginosa UCBPP-PA14
MNSPSLPAVERLDVQAFINAQPLSPYQWRIVLLCFLIVFLDGLDTAAMGFIAPALTQDWGIDRASLGPVMSAALIGMVFGALGSGPLADRYGRKLVLVAAVFLFGLFSLASAYSTNVEQLLALRFLTGLGLGAAMPNATTLLSEYTPERLKSLLVTSMFCGFNLGMACGGFVSAKLIPLFGWHSLLLLGGLLPLVLAVVLLFRLPESARYLVVRNRGSERVRQVLAPIAPAQVALARSFHVPEQQTVQARNVFAVIFSGTYSAGTLLLWLTYFMGLVIVYLLTSWLPTLMRDSGASLEHAAFIGALFQFGGVLSAVAVGWAMDRFNPHKVIGLFYLLAGVFAWCVGQSLGQVTLLATLVLLAGMCINGAQSAMPSLAARFYPTQGRATGVSWMLGIGRFGAILGAWIGATLLGLGWNFEQVLTALVLPAALATAAVLLKGLVSHADAG

SEQ ID NO: 82906 - protein, 356 aa, Streptomyces coelicolor A3(2)
MKGYVFHGPGRSAWEDIPDPELKEPTDAIVRVDAVTICGTDLHILKGDVPEVRPGTVLGHEAVGEIVEVGTDVRTVRPGDRVLVSCITACGRCRYCREGVYGQCLGGGGWILGHLINGTQAEYVRVPYADLSVHSLPGAVTDEDAVLLADIFPTAYEVGVLNGRVSPGDTVVVVGAGPIGLAAVATARLFAPERIVVVDLATARLEAARKLGAEAVADAREDPEQLVADLTGGLGADVVIEAVGVPETFEMCTRVVRPGGHVANVGVHGRPATLHLEDLWSKNVTVTTGLVDTRSTPTLLRMAASGRLPTGQLVTHTFPLERMEEAYEVFSAAADTGALKVVLGGPKREVVAANAV

SEQ ID NO: 82907 - protein, 889 aa, Parvularcula bermudensis HTCC2503
MTQYIYNFGGGSADGRTDMRNLLGGKGANLAEMASLGLPVPPGFTITTEVCTAFYDNNRQYPEGLKDAVDKALERVESIVERKFGDAEKPLLVSVRSGARASMPGMMDTVLNLGLNKETVKGLAALAGDERFAYDSYRRFIQMYSNVVLQMDHHSFEEILDTYKDDRDYVLDTDLTAADWQAVIVKYEAAVQAELGKPFPQDVHEQLWGAIDAVFGSWMNDRSKTYRRLNAIPEDWGTAVNVQAMVFGNMGDTSATGVAFTRDPSTGENHYYGEFLVNAQGEDVVAGIRTPQNLTIAGRQRQGNEDPSLEEVMPETFKELTAIFQTLENHYRDMQDIEFTIQEGKLWMLQTRNGKRTAKAALKIAVDLAEEGKISEEEAVLRVNPAALDQLLHPSLDPKATRDLLTKGLPASPGAASGKVVFTADEAERLANDGQKVILVRTETSPEDIHGMHAAVGIVTARGGMTSHAAVVARGMGRPCVCGAAEVRIDKAGTAFTVSGRTVSAGDQITLDGATGEVFFGAVKTIEPELSGDFAKLMVWADKARRMKVRANAETPLDAKTARGFGAEGIGLCRTEHMFFDAERITVVRQMILARDATERKAALDKLLPFQRDDFRELFTVMRGLPVTVRLLDPPLHEFLPHTDKEIEEVAQGSGIAVDQLKARAKDLAEQNPMLGHRGCRLGVTFPEIYEMQVRAILEAACEVAAETGDAVVPEIMVPLVSMKKELAFLKSRIDAVATEVFADKGRILDYLVGTMVELPRAALIADEIAEEAAFFSFGTNDLTQTTYGLSRDDSGAFMPFYIREGLVETDPFVSLDPKGVGALVEIGAERGRQTRADIKLGICGEHGGDPASISICERIGLDYVSCSPYRVPIARLAAAQASLSGDDD

SEQ ID NO: 82908 - protein, 306 aa, Ipomoea batatas
GDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLFRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADNYETESEIASLLADGKVPIGVGENTKIRNAIIDKNVRIGKDVVITNKDGVQESDRPDEGFYIRSGITIIMEKATIRDGTVI

SEQ ID NO: 82909 - protein, 175 aa, Marinobacter sp. ELB17
MQFDNIPAGKNAPEDIYVAIEIPANSSPVKYELDKDMGALLVDRFMATPMFYPANYGFIPHTLADDGDALDVLVITPYPIQAGCVIRCRPVGVLNMEDEAGGDAKLVAVPHDKLTTAYAHVQDVTDLPELLRNQIHHFFENYKALEAGKWVKIQGWDNAAAAKKAIVDAIKAYGG

SEQ ID NO: 82910 - protein, 224 aa, Marinobacter sp. ELB17
MNQDELKQAVAKSAIDYISPRLNSSSVIGVGTGSTANCFIDFLAAIRNDFDGAVASSEATAERLKSHGIPVYELNSTADLEFYVDGADEVNEQLELIKGGGGALTREKIVAEVAQTFICIADESKKVDILGEFPLPLEVLPMARSHVGREIVKLGGDPVYRDNFTTDNGNIIIDVYNLDLSRPIQVEERLNQIVGVVTNGLFARRPADLLLLGTKTGVRTLKRG

SEQ ID NO: 82911 - protein, 513 aa, Marinobacter sp. ELB17
MPQRYIKKILNARVYDVANKTPLTEAVSLSRRFGNNIFLKREDLQPVFSFKIRGAYNKLVQLSEEQKAKGVICASAGNHAQGVALSAKKLGIKAVIVMPQTTPEIKVRSVREHGAKVVLRGDAFDEAAAHAHELIEKHGYTYIPPYDDPDVIAGQGTVAMELLWQFSKPIHAVFVCVGGGGLIAGMAAYIKYLRPEIKVIGVEPEDSNCLQAAMKAGKRVILDEVGIFADGVAVKQIGAYPWEICKDHVDEVITVSTDEICAAIKDIFEDTRSIAEPAGALGVAGIKKYIERGKIENENLIATLSGANMNFDRLRYISERTEIGEKREAILAVTIPEKPGAFKTFINALHKRNITEFNYRYADSKQATIFVGIQIQAGGLGRDELVRELRETGYLVLDLTDSDLAKQHIRHMVGGHAPGISNEKVFQFEFPERPGALLKFLMSLGTRWNISMFHYRNHGAAYSRVLLGAEVDDDEVRDFEKMLEKVGFRYENMTDNEAYQLFLGAGNGNSHSS

SEQ ID NO: 82912 - protein, 511 aa, Debaryomyces hansenii CBS767
MQKDQKPVNIVRSQSYQSSDDIIESNNGNRKHFVYDSEIRKQRLEGGTKWRDVLVVLCAGFALISDGYQNNVMTMLNLVFPELYPKAYDADMKTAVSNASLVGTIFGQIAIGFTCDYIGRKWSIVVATCFLILGTIMCAASHGVTTDGMFWMLIISRGVTGFGIGAEYPASSVSANEAANESMKRRGGAFTLCTNLPLSFGGPFAIIIFLIVYQITKGVDSGLWRTMFAIGAFWPLSVFYFRVKMATSELYKKSAIKRRVPYWLAFKYYWPRLLGTCGCWFLYDFVTFPNGVFSGGIIQTILGDTDDLETVAEWQLLLGIIAIPGVFVGAYLCDKIGRKYTLIIGFCGYIIFGLIVGIAYNKLKKIPALFVIFYGLMMSSGNLGPGDMMGLVSLESFATPIRATCYGFSAAIGKVGAVVGTKTFTPIQTNLPQGERWTFIIAAICGLSGVLVAFFFIPHLKEDDLLEEDIKFKNYLIDHGWDGEFGLQGEPSKDEELQANSDDDDPQVKVI

SEQ ID NO: 82913 - protein, 578 aa, Deinococcus radiodurans R1
MPKSPPVSRYYDVKRDEQGQRYIEVKVTGLALLQNPLLNKTTGFTPEERRELGLEGLIPPHISSFEEQKHRTYLRYLEAPTDLARHEYLRALQDRNEVLYYAILEDHLEEMLPIIYTPTVGEAVKLYSNNYRYPRGFTVSTNDIERVEEMLDNVTVNDVRMIVATDSSAILGIGDQGFGGMAISIGKLSLYTAAGGVGPDKTLPVELDVGTNRQDLIDDPLYLGVHHRRWQGQQYDEFVDAFVEAVSARYPKAIIQWEDFSRGTAFRVLERYRKVVPSFNDDIQGTGAMALAGLLRASRMKGEFLTEQVFVVVGAGAAGIGVASAIRQGLEAEGLAPEEAGRRVYVVDRYGLLMEGQPDLEPQQMPFVRRRGDLEGWTFGGEYPTLHEVLVHARATALLGFTGVPGLFRQEDIEAMLAHTPRPIVFPLSNPSSHVEARPSDIVAWTRGGAIVATGSPFPDVPYDNERIPVGQGNNAFIFPGLGFGAVVSRAREITDNMVMAAALTLAEYTTQHHPHLVYPPISELRELSIHVAVRVAEQAIQDGVCAERRVRNMDREQLAALIRERAWLPRPLPLRRE

SEQ ID NO: 82914 - protein, 327 aa, Glycine max
MTGSADPLVISFGEMLIDFVPDTSGVSLAESCAFIKAPGGAPANVACAISKLGGNAAFVGKMGDDEFGRMLVDILRKNGVNTDGVCFDTEARTALAFVTLRKDGEREFMFYRNPSADMLLKESELNMGLIKQAKVFHYGSISLISEPCRSAHLAAMKVAREGGALLSYDPNVRLPLWPSEEAARSGIKSIWFDADFIKVSDDEVHFLTQGDPEKEDVVMTLWHDKLKMLLVTDGEKGCRYFTKNFRGRVTGFSAKVVDTTGAGDSFVGALLTAVARDPNIFHNEPKLREALTFANACGAMCTTQKGAIPALPTAAEAEKFISNSKAK

SEQ ID NO: 82915 - protein, 474 aa, Shewanella sp. MR-7
MNMATDPAKISPLTELLQRQRASYLAAPNPDYAIRKERLIRLKAALLKYQQPLVEALSQDYGHRSVDDSLISDIMPVVNNINYSLKNLKKWLKPSRRHAGILLAPAQVKVHYQPLGVIGIIVPWNFPVMLSIGPLVTAIAAGNHAMLKLSEFTPATNSVIKQLLAEVFEESHVAVVEGEADVAAQFSALPFDHLLFTGSTTVGRHVMRAAANNLTPVTLELGGKSPVIIAPDMPLEIAVERMIYGKCLNAGQICVAPDYVLCPKAKVAEFIQVYQTKFQAMYGTITHNKDYGSIINARQFERLLTVLEDAKAKGAKVIPASNDVIDSQHRKLATQLITDTTEDMLLMQEEIFGPLLPVIGYDSLDEAISYVNHRARPLALYVMSFDEASQQKILKQTHSGGVCINETVFHVAADDAPFGGIGPSGMGHYHGKEGFLTFSHAKTVLSRGRFNTGKFVHPPYGTFIQRMLMKLFLR

SEQ ID NO: 82916 - protein, 947 aa, Echinochloa frumentacea
MAASVSRAVCGLQGPCLNGRRSREAPSGRRSVAAPRAWRNEAGVLLLASGSGRAQHCAPANAIADAAPVTQATKKRVFLFGKGKSEGNRGMKELLGGKGANLAEMSSIGLSVPPGFTVSTEACEQYQAAGCTLPQGLWDEVLDGLAWVEEYMGAGLGDPQRPLLLSVRSGAAVSMPGMMDTVLNLGLNDEVAAGLAAKSGDRFAYDSYRRFLDMFGNVVLDIPHALFEEKLEHMKEAKGLKNDTDLTASGLKELVEQYKDVYVEAKGEPFPSDPKKQLELSVLAVFNSWDSPRAKKYRSINQITGLRGTAVNVQCMVFGNMGNTSGTGVLFTRNPSTGEKKLYGEFLVNAQGEDVVAGIRTPEDLDAMKDCMPQAYEELVENCNILEGHYKDMMDIEFTVQENRLWMLQCRSGKRTGKGAVKIAVDVVNEGLVDRHAAIKMVEPGHLDQLLHPQFENPSAYKDQVIATGLPASPGAAVGQTVFTAEDAEAWHAQGKAAILVRTETSPEDVGGMHAADGILTARGGMTSHAAVVARGWGKCCVSGCASVRVNDAEKVVAIGDKVLQEGDWLSLNGSTGEVVLGKQPLSPPALSGDLGIFMSWVDEVRKLKVLANADTPEDALAARNNGAEGIGLCRTEHMFFASDERIKAVRQVIMAPTLELRQKALDRLLPYQRSDFEGIFRAMDGLPVTIRLLDPPLHEFLPEGNVEDVVRDLCAETGSNEEEALARIEKLSEVNPMLGFRGCRLGISYPELTEMQARAIFEAAITMTNQGVQVFPEIMVPLVGTPQELGHQVAVIREIANTVFTAMGKTIGYKIGTMIEIPRAALVADEIAEQAEFFSFGTNDLTQMTFGYSRDDVGKFIPIYLDQGILQHDPFEVLDQRGVGELVKFATERGRKTRPNLKVGICGEHGGEPLSVAFFAKTGLDYVSCSPFRVPIARLAAAQVLV

SEQ ID NO: 82917 - protein, 477 aa, Nocardia farcinica IFM 10152
MTIMAPAFQPETATDPRDPMGRLQRFFDPGTVLPLHPRDKSGVLAAIGEVDGVRTVAYCSDATVMGGAMGVEGCKHIVDAIDTAIDSGVPVVGLWHSGGARLAEGVEALHAVGLVFEAMVRASGRVPQISVVLGFAAGGAAYGPALTDIVIMAPEGRVFVTGPDVVRSVTGEQVDMATLGGPETHGKKSGVCHIVADDEADAMHRARKLVSMFAEQGEFDLVAAEHGNVDLQAMLPDSPKRAYDVKPIVHELLDNVDGESSFEELQGGYARSMVVGLGRLGGRTVGVLANNPLRLGGCLNSESAEKASRFVRLCDAFGIPLIVITDVPGYLPGVGQEWEGVVRRGAKLLHAFAEARVPRVTLVTRKIYGGAYIAMNARSLGATAVYAWPGSEVAVMGAKAAVGILHKKALAAAPEEEREALHERLTAEHEKIAGGVDRALAIGVVDEVIDPAKTRSVIAAALAAAPARPSHHKNIPL

SEQ ID NO: 82918 - protein, 338 aa, Dechloromonas aromatica RCB
MTQQRTLARYLTEEQRNKGVITGDLKLLIEVVSRACQAISIAIGKGGLGGVLGEAGSDNVQGEAQKKLDVLSNDILLDANEWGGHLAAMASEEMDLPHLVPHRFPKGEYLLTFDPLDGSSNIDVNVSIGTIFSVLKCPEGADLSTPEAAEQAFLQPGTAQVAAGYAVYGPTTLLVLTVGDGVAVFTLDREQGQFILTLENVQIPADTKEFAINMSNQRFWEAPVQRYVAEMQVGKEGPLGKDYNMRWVASMVADVHRIMTRGGIFMYPMDSKIKGQGGKLRLMYEANPMAMLIEQAGGAATTGRQRILDIQPEKLHQRVPVILGSKNEVERVTGYHSA

SEQ ID NO: 82919 - protein, 207 aa, Blastopirellula marina DSM 3645
MGIMTAADTKPMASTKVVNVPNAITLARFLLSIAVFVLLPWGQYVAAAVVFIIAAATDWMDGYWARKYNEVTQVGRVFDPFVDKIIICGTFIFLAAEPGSQIAAWMAVVIAGREMLVTVLRSFIEQHGGDFSANMPGKIKMVLQCVAAVASMVVLAYVQQTTAGPYTLALEWTALISAWLAVASTVHSGVIYIFAAAKMIRDQSTTT

SEQ ID NO: 82920 - protein, 342 aa, Dechloromonas aromatica RCB
MAIKVAINGFGRIGRCTLRAIYEQGLQNEFDVVAINAAGDLATNAHLLKYDTTHGRFRTSVETEGENCIIIDGKKIAFYSTKNPKDINWADHGVDIVLECTGAYTSKAKALPLLEQGAKRVLISAPGGDDVDATIVYGVNEGILKSGMTVVSNASCTTNCLAPVAKILSDSIGIKQGLMTTIHAYTNDQVTVDVRHKDLRRARAAAANIIPTKTGAAKAVGLVLPQLVGKVDGFALRVPTINVSLVDLTFTAGRATTKDEINALMTAAANGPLKGVMDVNNEPLVSSDFNHTTVSSTFDATQTRVIQGEDGSTLVKVLAWYDNEWGYSCRMLDAARAWMAAK

SEQ ID NO: 82921 - protein, 119 aa, Aspergillus niger
MSEQPSDPYIPSGANGAGAGASAAQNGDPRTREIDKKIQETVDTMRSNIFKVSERGERLDSLQDKTDNLATSAQGFRRGANRVRKQMWWKDMKMRVCLIVCIIILLIVIIVPAVVATKH

SEQ ID NO: 82922 - protein, 349 aa, Dechloromonas aromatica RCB
MPFNVPNTAPLRLAINGYGRIGRCFLRALLESSVAHKLQVVAINEPANLESMAYLTRFDSTHGRFPGNVEITGDKLLIDDQPIRVSHARTPEEVDWSNIDLVVECSGIYGRRPELTRFLDAGCPRLLLSHPGLSADDVDATIVTGINQQSLTGKERLVSAASCTTNAIVPLLDLIDREIGIEQAMLTTLHSVMNDQPLIDGYHHDDLRRTRSAMQSIIPVSTGLARGVERLLPQLAGRVQAKAIRVPTTNVSAIDLTINTQRPMSAHSINTLLANAAHGPLKKLVAYSEAAHASIDFNHDPHSAIVDGSQTRTSGTHLVNLFVWFDNEWGFANRMLEVADHWSRLWPTR

SEQ ID NO: 82923 - protein, 338 aa, Salmonella enterica subsp. enterica serovar Paratyphi B str.
MRVLVTGGSGYIGSHTCVQLLQNGHDVVILDNLCNSKRSVLPVIERLGGKHPTFVEGDIRNEALITEILHDHAIDTVIHFAGLKAVGESVARPLEYYDNNVNGTLRLVSAMRAANVKNLIFSSSATVYGDQPKIPYVESFPTGTPQSPYGKSKLMVEQILTDLQKAQPEWSIALLRYFNPVGAHPSGDMGEDPQGIPNNLMPYIAQVAVGRRESLAVFGNDYPTEDGTGVRDYIHVMDLADGHVVAMEKLADKSGVHVYNLGAGVGSSVLDVVNAFSKACGKPINYHFAPRRDGDLPAYWADASKADRELNWRVTRTLDEMAQDTWHWQSRHPQGYPD

SEQ ID NO: 82924 - protein, 393 aa, Dechloromonas aromatica RCB
MNVIKLTDLDVSGKRVFIRADLNVPQDEAGNITEDTRIRASLPSIKYCLEKGAAVMVTSHLGRPTEGELNHEDSLMPVAVRLGQMLHTSVRLITDWVDGGFEVKPGEVVLLENCRVNKGEKKNNDELAQKMAKLCDIYVNDAFGTAHRAEATTHGIAKYAPVACAGMLMGAEIDALSKALHEPKRPLVAIVGGSKVSSKLTILKSLASKVDQLIVGGGIANTFLLADGKRIGHSLAEPDLVKEAHTIMDIMKERGAEVPLPTDVVVADEVSALARANKISVDDVHANDRILDVGPKTAAKFAEIIANAGTIVWNGPVGVFELPQFAGGTKMMASAIAHSEAFSIAGGGDTLAAIAKFHIADDVGYISTGGGAFLEFLEGKTLPAIAILEERAA

SEQ ID NO: 82925 - protein, 477 aa, Dechloromonas aromatica RCB
MLRHTKIVATLGPASSTPEVLDRMVLAGIDVVRMNFSHGTADDHRARAEGIRAAAARHGRTIGILGDLQGPKIRVGKFEAGKITLVPGEKFILDAQCPLGNQERVGLDYKDLPKDVVNGDILLLDDGRLKLEVTGVRGHEIYTRIIVGGDLSNNKGINRQGGGLTAPALTGKDMDDIKTAADIGVDFVAVSFPKSAADMYMARQLLRAAGSTAVLIAKIERVEAITNLAEILDASDGIMVARGDLAVEVGDASVPALQKKMIRMARDRNKLTITATQMMESMITSPVPTRAEVSDVANAVLDGTDAVMLSAETASGKYPVETVESMARICVEAERSAEVTLDREFLDRIFTRIDQSIAMAAIWTAHHLKVKAIAALTQSGSTALWMSRMNSGVPIYALTPDAESVGRMVLFRGVCPLPMKQQHTDRDRLLAEAEQLLIDRGVVEKGDLIALTIGEPIGTTGGTNTLKIVRVGEHQLD

SEQ ID NO: 82926 - protein, 382 aa, Salmonella enterica subsp. enterica serovar Paratyphi B str.
MNLKEKTRALFAEIFGYPATHTIQAPGRVNLIGEHTDYNDGFVLPCAIDYQTVISCAPRDDRTVRVIAADYDNQVDEFSLDAPIVTYDSQQWSNYVRGVVKHLQQRNNAFGGVDMVISGNVPQGAGLSSSASLEVAVGTVFQQLYHLPLDGAQIALNGQEAENQFVGCNCGIMDQLISALGKKDHALLIDCRTLGAKAVSMPKGVAVVIINSNFKRTLVGSEYNTRREQCETGARFFQQPALRDVSLEAFNAVASELDPVVAKRVRHVLSENARTVEAASALEKGDLQRMGQLMAESHASMRDDFEITVPQIDTLVDIVKATIGDQGGVRMTGGGFGGCVVALIPEDLVPAVRQAVAQQYEAKTGIKETFYVCKPSQGAGQC

SEQ ID NO: 82927 - protein, 537 aa, Vitis vinifera
MISYHFNKATETICSLWSWWWAGSNKKLDVVAGAVLTVSVAVLAILWYLRTSRKGTAPWPPGPRGLPVVGYLPFLGSNLHHSFAELAHLYGPIFKLWLGNKLCVVLSSPSLAKQVVRDQDVIFANRDPPVAAFAYTYGGLDIAWSPYGSYWRNLRKVFVREMLSNTSLEACYPLQRSEVRKAITNAYSKIGTPMDIGQLSFQTVVNVTLSSLWGNTPEAHNDGKIGAEFREAASEITELLGKPNISDFFPTLAGFDIQGVERQMKRAFLSAEQVIDSIIDRKMKKSTAKEEGASDNGEKKDFLQFLLDLKVQEDTETPITMTQIKALLMDILVGGTDTTATMVEWVMAEMIRNPVIMTRAQEELTNVVGMGNIVEESHLPKLQYMDAVIKESLRLHPALPLLVPKCPSQDCTVGGYTIAKGTKVFLNVWAIHRDPQIWDSPSEFKPERFLSEPGRWDYTGNNFQYLPFGSGRRICAGIPLAERMIIYLLASLLHSFNWQLPEGEDLDLSEKFGIVLKKRTPLVAIPTKRLSSSDLYL

SEQ ID NO: 82928 - protein, 218 aa, Glycine max
MAEDRSEVSDYSSEDEGTEDYRRGGYHAVRIGDTFKNGSYVVQSKLGWGHFSTVWLAWDTHKSRYVALKIQKSAQHYTEAAMDEIKILKQIADGDPDDKKCVVKLLDHFKHSGPNGQHVCMVFEFLGDNLLTLIKYSDYRGVPLPMVKGICFHILVGLDYLHRELSVIHTDLKPENVLLLSPIDPSKDPRRSGIPLILPNTKDKTVTKNGITIENKSL

SEQ ID NO: 82929 - protein, 442 aa, Burkholderia thailandensis E264
MNALTDLSRVADAMAARLAIEPAVGMTGKVLEVIGTLVRVVGLEATLGELCELRSASGALIQHAEVVGFTRNVALLSPFGTLGEINRGTRVIGLRRPLSVKVGNGILGRVIDSFGEPIDGRGELDYDALRPVIAPPPNPMSRRMVDASLATGVRIVDGLITLGEGQRMGIFAPAGVGKSTLLGMFARGASCDINVIALIGERGREVREFVELIMGEDGMARSVVVCATSDRSSIERAKAAYAATAIAEYFRDQGKRVLLMMDSLTRFARAGREIGLAAGEPPARRGFPPSVFAELPRLLERTGMGERGSITALYTVLAEDDSGSDPIAEEVRGILDGHIILSREIAARNQYPAIDVLGSLSRIMPQIAAREHVGAAGRLRQLLAKHREIETLLQLGEYQAGSDPAADEAVAKIDRIRAFLNQRTDEYSPPDATLAALHELVR

SEQ ID NO: 82930 - protein, 535 aa, Vitis vinifera
MTPISPFLEKQIAMLSDAWSWWWESTNSSDEFARVSLTFALISLVISWYAWMFIKNRGGAPPPPPGPRGLPLLGYLPFLDPELHSHFADLARAHGPILKLRLGSKVGIVLTSPSLAREVLKDHDTIFANRDVPDLTNALQYGGFDIVCTPFGPEWRMLRRVCVREMLSSATLDVFYDLRRQEFQRTVRYLYGQAGSPVNVGEQMFLTVMNVITSMLWGGTVKGEERASLGAEFRRVVAAMTELMGKPNISDFFPGLARFDLQGIRKRFGECALKFEGIFDSIIQQRMKIDKEGGNGGGKDFLQFLLRLKDEGHAKTPLTMNHVRALLLDMVVGGTDTTSNTVEFAMAEMMNKPEVMRKAQQELEVVVGRDKKVEESHIGKLPYLYAVMKEVLRLHPALPLLVPHCPSESCVVGGYTIPKGARVFVNVWAIHRDPSIWKSPLEFDPERFLRGTWDYSGKDFSYFPFGSGRRICAGIAMAERMVMFSLATLLHSFDWKLREEKLDLSEKFGIVLTKKMPLVAIPTPRLSHPALYEYE

SEQ ID NO: 82931 - protein, 530 aa, Vitis vinifera
MKPISDFLRKLTSSREWSLWWESSNSSDELTRVTLALALIFLAIYWCAWVFIKKQGAAPPPPGPRGLPLLGHLPFLDPELHSYFADLARIYGPILQLRLGSKVGVVVSSPALTREVLKDQDVTFANRDVPEAALEAAYGGSDIVWTPYGPEWRMLRKVCVREMLSSTTLDSVYALRHREIRQTVSHLYSQAGSPVNIGEQTFLTVLNVITSMLWGGTVKGEERTSLGAEFRQVVTEMTELLGKPNISDFYSSLARFDLQGIKKQMKGLALRFDGIFNSIIEQRMEMDKEGGNGGGKDFLQYLLKLKDEGDSKTPFTMTHLKALLMDMVVGGTDTTSNTVEFAMAEIMNKPEVMKKVEQELEAVVGKDNMVEESHIQKLPYLYAVMKETLRLHPALPLLVPHCPSEPCIVGGFSIPKGARVFVNVWAIHRDPSIWKNPMEFDPERFLRGAWDYSGNDFSYFPFGSGRRICAGIAMAERMTMFSLATLLHSFHWKLPEGKLDLSEKFGIVLKKKVPLVAIPTPRLSDAALYK

SEQ ID NO: 82932 - protein, 297 aa, Arabidopsis thaliana
MRFSSSRPVSSPGRTENPPLLMRFLRTKSRSRSRSRSRRPIFFRRKNASAAAETQEPTSPKVTCMGQVRINRSKKPKPETARVSGGVTERRRQSRRCGWVKNAFPCHSFTGIIKPTCFSPVWRKWKSFSHASFSKKSEKRSSSSRSEPIFGRSTVEPEEPEETRKEENQEEEASSCKSFTATPPRNAFLLTRCRSAPYRSPSSANSLFEDQEETNKAPFQRHASSENVSVSEEPKTSVTETTERLEDSRRESAASEEPKRSVLGSPRQCLILTRCNSEPARLVPEMGYRQNPRLGFT

SEQ ID NO: 82933 - protein, 468 aa, Burkholderia thailandensis E264
MAMISESSSAAAAAPGGARAPDTLARSLNVRDVVMITVSGVTPASSIFVIAPFAIQQAGSGAVVSFVLGGLLALAFALCYAELSAAHRSAGGEYVMVKRVFGALPGYLTFVAVLAVNVFIPAVLASGAAPYLNAALGTQFRNQSVALAIVLASYALGILNIRTNAWITGAFLVIEILVLALIAYLGFSEPHRSPLALVHPVVANGAALVPATLAAIMPAVGTAIFCYNGFGAAVFLAEDLEGGNRDIAKAVICSLAVILVVELVPLTAIVLGAPSFVELAKSADPIGYVVRALSNPGVSRVVSGGIFLSVFNAIIAIVIMVGRFLYSSGRHALWSRACNGAFTRIHPRLESPWVATLTLAVPSTLLVFVSSLDELTAFTVDLLLLIYLAVGVAALASRVTRRDVDHHYRMPWWPLPPIVAIAGAGYTLYTTIAAATKPTDLYIIAGLAAVSLVTYAMWARRSEAFRAL

SEQ ID NO: 82934 - protein, 228 aa, Enterococcus faecalis V583
MPKLVFSRHGLSEWNALNQFTGWADVDLAPEGVEEAKEGGRKIKEAGIEFDVAYTSVLTRAIKTCNYLLEYSDQLWVPQIKSWRLNERHYGKLQGLNKKETAEKYGDEQVHIWRRSYDTLPPLMEATDEGSAANDRRYAMLDQRDIPGGENLKVTLERALPFWQDEIAPALKDNKTVLVAAHGNSLRALAKHIEGISDEDIMDLEIPTGKPLVYELNDDLTVKEKYYL

SEQ ID NO: 82935 - protein, 309 aa, Campylobacter lari RM2100
MRGYKIFSGSANEEFAKKISKYLSLPLSNAGVKRFSDGEISIQIDESVRGKDVFIIQSTCAPTNDNLMELLIMTDALRRSSASSITAIIPYFGYARQDRKASPRVPITAKLVANLIESAGVDRVATIDLHAGQIQGFFDIPVDNLYGSIIFNDYIKNKNYKNPIIASPDIGGIARARSVAKALGLDIVIVDKRREKANESEVMNIIGDVKDKEVILVDDIIDTAGTIVKAAEVFKNKGAKSVIACCTHAVLSGVAYERIAKDSLDELVVTDTIPLKQQMDKIKVLSVAPIFGEVIRRVYHNESVNSLFV

SEQ ID NO: 82936 - protein, 226 aa, Enterococcus faecalis V583
MNLKQMVGIEAAKYVEDGMIVGLGTGSTAKFMVDEIGRRVKEEGLSIVGVTTSKETEKQALALGIPLKSIDEVPYVDLTIDGADEISADFQGIKGGGAALLFEKIVATYSKKCIWIVDKSKMVDDLGAFPLPVEVVPYGSRQLVHLFEEKGYHPTLRLNAAGETLITDGGHHIIDLHLEKITDPEALGSYLDNLVGVVEHGLFLNMVSMVIVGYEDGPKTLHVPAR

SEQ ID NO: 82937 - protein, 629 aa, Aspergillus nidulans FGSC A4
MALDDISAVPKGALDTDPAVERPPPLLDADRSDSERLQPGVKRAEMLRKGWTRQGLIIAFTGLFLATLSINFGDYSTQVYVPYATSAFKQHSAMSAARVVGNITRIAAYPIIAKLGDASLRSPLRRTGADSFCFFVKVFGRAEMFILSIVFQAVGYAIYAGCKNVGQYIAGGIFEAIGSTGFGLTQQVFVADVTNLINRAVWSTLPDSLTVIPALYLGTEIAEAVLEKNEWRWGFGMWAIIEPVCSVLLVGTMLYYQKRARKDPSPAEFASEPTERNVDDGWWKRIYNLVWVQLDAFGAILLLLGLSLFLVPLSLTGSGNSDDWHRGSFIAMLVLGVVIFVAFLAWDTWCAKKPFIPYRMIKNRTVAAACLLGILDFFHYSVFSVFFTSYLQVAAHHGAGPATRIDNSLRVAFQVAGIFAAYFMKFTKRSQVWVFTGVPLCVLGMGVLLYLVDMGEGRVGNEAAFVTAKSLIGIGRGFYQTASQVSVQAKVSRGEVSVVTAVFFAAMSIGGAIGTSVAGAIWRSTLPPKLAQHLPAELKDQAQAIFGSIVVAQKYEVGTPARDAIDMCYRQSQRMLAIAALAALAPMLIIMFFLENVPLTDETTLIELHGNREAVKKNHSGGEGKEARS

SEQ ID NO: 82938 - protein, 127 aa, Desulfovibrio vulgaris str. 'Miyazaki F'
MSSITKEQVVEFIANMTVLELSEFIKELEEKFGVSAAAPAMMAVAAGPAEAAPAEEEKTEFDVILKAAGANKIGVIKVVRALTGLGLKEAKDKVDGAPSTLKEAVSKEEAEEAKKQLVEAGAEVEVK

SEQ ID NO: 82939 - protein, 336 aa, Deinococcus radiodurans R1
MARRRLPSMTHGNSSQSDRPRIISPLAPRADAAEVVRGVDLKGKTAVVTGGASGLGTETARALLLAGAHVILPVRDRAKGERVAAELRQSTGGTVELVDLDLGSLASVRRGAAEIRQLAPRIHILINNAGVMATPQSRTVDGFETQFGTNHLGHFLLTRELLPALMAAAPARVVALTSSGHRRSDIVWDDLNFERRPYDPWDAYGQSKTANALFAVGLTQRYADQGLTANAVHPGGIMTGLQKFVPLEDQRRMGWQDEHGTLNPVFKTPAEGASTSVWAATSPQLYGVGGLFLEDLQHSTPLDESAPNPLFGYKPYALDHESARRLWALSEALVGE

SEQ ID NO: 82940 - protein, 171 aa, Nocardia farcinica IFM 10152
MRIEVGGFAPEIEESAWLAPNATVIGRVRLAAEVSVWYGAVLRGDLEQIIVGERTNIQDGCVLHADPGVPLTVGSGVSVGHNAILHGCTIGDDVLVGMGATVLNGAVVGAGSLIAANALVPEGAQIPPGSLVAGVPGKVRRELSEAERDGIRLNSAVYLHNMATHRGARTL

SEQ ID NO: 82941 - protein, 1211 aa, Dechloromonas aromatica RCB
MAPPVIDRNNPWPWLDPFTEKAEAFFNGRDDDSAALQRCVLAGVATVLFGKSGLGKTSLLQAGLFPRLRKSGLLPVLVRLEHGSASPTAAAQIRTCLHKECTAYGLTMPGNPQFAPQLEKPEDRLWLDLHTNPVGLRDAHGQTWQVVFVLDQFEEIFTLGGQDSERQRLDFGALGDLVENRIPRALENAISVDEDLLDELRLDVQPYRVVFSLREDYLPNLERWCDRIPRLGPNRYRLLPMQEAQALDAIRLTGGDLVSPQDADRIVRFVSSQQEGPAVGMASGESAEVSIEPALLSLLCSGLNLERQKAGAAHLDASNLEQSGGRIMERFYDDATLDVAPAAIAFVEDELITPDGVRLFYPLKSILQNPGITKADIDTLIERRLLRRQPFTEGDRIELVHDRLAAVARQRRRNRESVAAQQRRLDEARREAAAKEANVRADLESKARESETRARLRAEKDASSQRRLQGILKFVVAALVVLLCLAGASAWFAREQSALARAAEGKAKRSAEEASIRRLVAEGQAMTTGAQSGGSILGILQLLAAHRLSDEAYPQASPGALGALRAEFMRSARLLHLSESDEAITTLDLSPDGLRIVTGSRNGSLQLWEAASGAPIGKPLIGHSSYVNSVAFSPDGKAIVSASRDHTLRLWEAGTGNPLGKPLQSDSAVCSVAFSPLGQRIVAGGLDGNLRLWDAATGQMLGEPLKGHSQRVCAVAFSPDGQHIVSGGDDKTLRLWNVSSGQPSGEVLKGHTEAVYSVAYSPNGLRIVSGSSDATLRLWDARTGKPIGDPLKRHRKAILGVAFSPDGRYIVSGSGDYTVRLWETETQKPAGDSLRGHTDEITGVLFSRDGERVVSGSYDKTLRLWTVAADDPTSVVLNGSDKALKSVAFSPDGTRLVWAGEDQDVHVLDLTTGKTTGKPFSGHREAVYSVAVSPDSKRIASGSSDMSVRLWDAATGALLVPPLQGHLGTVYGVAFSPDGARLVSGSADGTLRQWNAGSGAPIGSPMSGEGGSVSSVAFSRDGRRIVSASEDGKLRLWDTATGKPIGKPLVGHLKAVNSVAFSRDGRLIVSASDDMSLRLWDANSGAPIGKPLTGHTHYVNSVAFSPDGRYVVSGSKDQTLRLWDVRTGTPVGAPLEGHSDVIFGVTFSPDGRQVASVSGDSSLRRWPVLESWAERLCAKLGRNMSDSEWQRLVSPDIPYARQCPGLPKPGD

SEQ ID NO: 82942 - protein, 181 aa, Sulfolobus solfataricus P2
MATVTLEQSLDLYAMERSIPNIEYDPDQFPGLIFRLEQPKVTALIFKSGKMVVTGAKSTEELIKAVKRIIKTLKKYGIKIVGKPKIQIQNIVASANLHVNVNLDKAAFLLENNMYEPEQFPGLIFRMDDPRVVLLIFSSGKMVITGAKREDEVSKAVKRIFDKLAELDCVKPIEEEEELEL

SEQ ID NO: 82943 - protein, 217 aa, Shewanella oneidensis MR-1
MNQSLLAPFGTAIERVEAGLNALRQGLGVLVVDDEDRENEGDLIFAAESLTNAQMAMLIRECSGIVCLCLPDEKVKALALPPMVENNSSQYGTAFTVSIEAKVGVTTGVSAADRVTTIKTAIADHAKPSDLARPGHVYPLRAQPGGVLTRRGHTEGTIDLMQLAGLKPAGVLCEVTNPDGTMARLPEIIAFGALHNMPVLTIEDIVVYRKSLLANVG

SEQ ID NO: 82944 - protein, 352 aa, Rhodococcus sp. RHA1
MRLIATLLLGASQHEAEAAAFTSTRRSTVAQAVRFYEHGAPEVMRWENVEVGEPGPHGVRIRHEAVGLNFADTYFRTGLYPAELPAGMGVEAAGVVEEVGSGVTHVQVGDRVTYTGSPLGAYSTERVMPAAPLIPLPEAIRFDTAAAMTMRGLTTAYLLRRIHPLKAGDTVLLHAAAGGVGLIFTQWAKLLGINVIGTVSTDEKAAIARAHGCEHVIVYTRENVAERVREITNGAGVPVVYDSIGESTFQTSLDCLARRGLLVCFGTASGPIPPINAMQLAVKGSLFVTRPALADYIADPAERAELAGELFDHVEAGRIRIEINQSYGLEDAVQAHRDLESGRSIGSSVFRL

SEQ ID NO: 82945 - protein, 498 aa, Hydrolea ovata
  misc_feature (1)..(7): Xaa can be any naturally occurring amino acid
XXXXXXXSGSGVSTLEKKNPGRVVQIIGPVLDVAFPPGKMPNIYNALVVQGRDSLGQPINVTCEVQQLLGNNRVRTVAMSATDGLTRGMEVIDTGAAISVPVGGSTLGRIFNVLGEPVDDLGPVDASTTSPIHRSAPAFIQLETKLSIFETGIKVVDLLAPYRRGGKIGLFGGAGVGKTVLIMELINNIAKAHGGVSVFGGVGERTREGNDLYKEMKESKVINEENIEESKVALVYGQMNEPPGARMRVGLTALTMAEYFRDVNKQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGDEHYQTAQKVKQTLQRYKELQDIIAILGLDELSEEDRLTVARARKIERFLSQPFFVAEVFTNSPGKYVGLAETIRGFQSILSGEFDGLPEQAFYLVGNIDEAKEKAIKLEKESNLKK

SEQ ID NO: 82946 - protein, 199 aa, Vitis vinifera
MIGVLWEEKGLQSLCNCLGCCYTMGEPFTIQISSKLINQLADGGEKLKKKTKKPRQKLPGGRLQSQTKVPEKQVFDDSETRKGTAAAGWPPQSLLYMPVSTPQPAIRELDAIRSVLQDSERVLERLKTQEEHMVQEVTQRAKDLHDKEFKLPYQKPIPCLAERDACLECYKENVNDALKCANVVRSFADCARRARQQVN

SEQ ID NO: 82947 - protein, 125 aa, Vitis vinifera
MAGVGEAQNTASCASELTACADYLNSTSPPANCCTPLKNAVENDKDCLCNLYNNPSLLQSLNINVTDALQLPKNCGITEELNCNASSPSPTGSPPATPGKDGGGASMVAWTGMSSLLLLCASLML

SEQ ID NO: 82948 - protein, 477 aa, Xylella fastidiosa 9a5c
MHNTLLLFGATGDLAQRYLFPSLLHLFTDGLLPQDFRIRALALSPHNTTQFRDILRPRLEQALPIANTAHIQALLQRVDYLSVDLNDPTSIAEAVRDLTEHPCISYLAIPPGLYTNTALGLAQGGALQTPHRLMLEKPIGRDSINAREILNTIGTLIDEDRIFRVDHYLGKAAVQNLVALRFGNTLLEAVWNRNHIESVHILIAETEGVDGRNAYYARAGALRDMMQSHILQLLCLVAMEPPASLEADRIRDEKVKILRALRPLNAQNAAMHSVRGRYSAGTINSQPVPAYQPPEGSNVETFVGVTAYIDNWRWAGVPFHLCTGKRLAERSTQIVVTLKPVTHWLFERPDRNNAAPNRLCFKLQPQENIELNLMSSLAGPEWGTLELQPLELELSVPTGKHRHIAYERLFLDAFNGNPALFVRHDEVTAAWDWIDSVSNAWELSDLPLQPYPAGSWGPPQAHQFLPPLGIDGHGNDA

SEQ ID NO: 82949 - protein, 133 aa, Medicago sativa
MASSSDSWLKEYNEAMKLADDISGMISEHNSFPSSGPETQRHASAIRRKITILGTRLDSLQSLLSKLPVKSEKEMNRRKDNLANLRSKVNQMASTLNMSNFANRDSLLGPEIKPDAMSRTVGLDNNGLVGLHG

SEQ ID NO: 82950 - protein, 376 aa, Nerium oleander
MAIDCMFKSKSTVPEMCKDEKKPLVFDASLLQHQTHIPTEFIWPEHEKPCPNPREHPVPLIDLGGFLSGNPVAAMEASRLVGEACQEHGFFLVVNHGVDADLIADAHRYMDYFFELPLCDKQRAQRKLGEHCGYASSFTGKISTKLPWKETLSFRFSAEKRSSHMVEEYFEKTLGDEFAHLGNVYQEYCNAMSTLSLGIMELLGMSLGISRESFKDFFQDNESIMRLNYYPPCQKPELTLGTGPHCDPTSLTILHQDTVGGLQVFVDGEWRSISPNVSAFVVNIGDTFVALSNGRYKSCLHRAVVNNKTPRKSLAFFLCPKEDKVVSPPSELVDSNNPRIYPDFTWAKLLEFTQKHYRADMNTLQIFSNWLQQKNS

SEQ ID NO: 82951 - protein, 328 aa, Burkholderia thailandensis E264
MHAWSAQHVPPQGGKVAVVTGANSGLGWQIAQTLAAKGAQVVMGCRDTAKGELAAHAIRTRYPRARIEVEALDLADLASVCRFADAVADRHGRVDILCNNAGVMFLPLRRTRDGFEMQMGTNHLGHFALTGLLLPALRASHRARVVTMSSGFNRLGKIRLDNMLAERGYNKYRAYCDSKLANLMFTLELQRRFDHAGLSMRSIAAHPGYAATNLQFAGPVMENSSLGSFAMRLSNRLVAQPADVGALPAIHAATAVDIEGGAYIGPAHLCETRGYPANARIPHQARDVRMGKRLWEKSEQLTGVRYLDTPPPGSRRGASRYDATFRAL

SEQ ID NO: 82952 - protein, 162 aa, Parvularcula bermudensis HTCC2503
MVKRIHPLATGTDRRVAIVDTAWNDFIVRNLTEGAIETLKRQGVADDHILHVTVPGAFELPIAVRQLAETGAVDAIVALGCVIRGATPHFEFVAGEAAKGVASVMADTGVPVAFGVLTTDTIDQAIERAGTKLGNKGAEAASVAIEMIGTLAALKGMRRDES

SEQ ID NO: 82953 - protein, 261 aa, Brassica napus
MHLLTVTSSSGSNAEKPPQKKKKVHGPRPLSLLLLPDELSLNCLARVPRCYHPSVSMVSTALRRLIASPAIYVERSLLRRTEHVLYVALRSCVTETPRWYTLNLKPFGQAYGVNHSLVPVPSFPPVPSWGMSIFTVGSEIYVIGGCVNEKMVSTVFVIDCPSYTCRFLPNMKQARACAAAGIVGGKLYVIGGCKPRSSNWVEAFDLKTQTWETVTGLNKVEMYEKMIRSFLIDDKIYLMDRKSSFVYDPKEGRLERDPLLN

SEQ ID NO: 82954 - protein, 248 aa, Rickettsia prowazekii
MYNTNFGFKKVDYTKKQWLINNIFSRVADKYDLMNDLMSIGLHRLWKDEFIMQIPNLNSNILDVASGSGDIALKLAKKAKDRGNNISLILSDINEEMLNNAKKKSIDLNLFQNIKFIVANAEELPFSDNSFDYYTIAFGIRNVPDINKALKEAYRVLKPMGKFVCLEFSKVKEGILKDFYKFYSFNIIPSIGQIIAGNKEAYEYLVESIALFPSQDDFRIMIKESGFEEVHYKNLSGGIVAIHSAYKI

SEQ ID NO: 82955 - protein, 115 aa, Oryza sativa
MLVFFFSLSLAKHLFLCQLSQQEDLIVWMRTAALPQFRKLYGVIEEDLQADEIITMHIANNYNTYSFGGKKSLILTTSTWLGGKNDFLGYAYLITGSLSLFLTILFALIHVKNPR

SEQ ID NO: 82956 - protein, 209 aa, Parvularcula bermudensis HTCC2503
MSFVSVEEAAKAVAAGRFVIICDDEGRENEGDLMIAAEFADADAVNFCTIHGRGLICCAVEPAIADRLGLQLMVPQKDNRSGFGTAFTVSVEAREGVTTGISAADRARTIEVLCDPKSTPEDLVSPGHMFPLRAHPEGTLGRGGQTEASVDLARIAGCRPAGVICEVMNEDGTMARRDDLMKVAAKHDIPMVTVEAIKAYRKAKKVEAA

SEQ ID NO: 82957 - protein, 408 aa, Candidatus Kuenenia stuttgartiensis
MKLPVISLKAKRNSLHPWIFNRMIRHPQKPVPTGTLVEVVSKEGGFIGRGIYNRKSNIGIRLLTENVTEHLCKEFILKKLEYAKALREEVLGIHKTSDCYRLVHGEADGLSGLIIDKFAHVIVVEPYSAGYIGIMDWIVSSLKTLYPDSNVTVRPDARNAEKEGVDFSKVSRIYPCPDSVIICENNMRMMINFKSGHKTGFFLDQRENRLALSLLCRDKEVLDCFCYTGGFGISAMRAGARSATGVDLDEKALETAKENARLNSAAISYVHIDVFDFLRKMYNSGTQTDVVILDPAKLAGCTGEIKRAMRTYGDINRLGMQVVRPGGILLTCSCSGLISEKDFLSILTRSAAEAGVILQIFKITGAAPDHPFSSIFPEGRYLKAVFARVFPFAGKKTFVPNSSEYESY

SEQ ID NO: 82958 - protein, 476 aa, Burkholderia thailandensis E264
MSSEEQFHAIAAREGGLRRTLSARQMTMIAIGGAIGTGLFLGSGFAIGFAGPSVLISYAIGALISLLLMGCLAEMTVAHPISGSFGAHAEHYLGPWAGFLVRYAYWACIVLAVGTEVTAVALYMKYWLPAVPGWIWIASFSAVLVCVNALSVDVFGSVEYGFSVVKIAAIVAFIAIGGYVVFVDPSLVADPNAGAPGLRHYFAHGGFFPKGLWGMWVAVIVSIFSYLSIEMIAVAAGEAQDPERAVTRAFRSTVIRLVLFYLVTLALMLAIVPWTAAGRDESPFVKVMIAIHLPGAAGVINFVVLIAALSAMNSQLYITTRMMFSLACAGHAPRGLGKLTSRGVPLNALLLSTAGIAIATLVSIVYPDASFTIMMAISMFGAMFTWTMIFVTHYFFRRKRAAQGLPPPRFRMPGFPFATLAGAALMLAIMATTYFTAEFHMTLVFGVPFLVALSVLYFARYRRRPQALAQAESLPR

SEQ ID NO: 82959 - protein, 470 aa, Erythrobacter sp. NAP1
MADDKREELERLLDLQRSAFTASRPESMKMRKDRIRRAMALLKDHGENLCKAMSADFGNRAMHQSMITDIDGTINAGKNALSNMDKWAKPEKRKVQFPLGLMGAKAEVRYEPKGVIGILSPWNFPVNLAFSPLMQVFAAGNRAMIKPSEFTERTSLLMAELVEEYFTPDECVVVTGGPEVAAAFSSLPFDHLIFTGSTATGRRVMQAAAENLVPVTLELGGKSPVILGRSADFAKAGERIALGKMMNAGQICLAPDYMYVPEESEDEAIAGVTNAASTMYPTVLENDDYASIVSDRHFERLQGLVEDARDKGAEVIEVNPAGENFASANQRKLPLTVLRGVNDDMTVMQEEIFGPVLPVKTYKAVDEAVDYINANDRPLGLYYFGEDKDEQERVLSRTISGGVTTNDVIFHVSMEDLPFGGIGPSGMGSYHAIEGFKEFSHARAVYQQPKIDVAKLAKMKPPYPKAKQSA

SEQ ID NO: 82960 - protein, 164 aa, Picea sitchensis
MAPIAVGDKIPDGVLAYFDEENKLQQVSAHSLAAGKKIILFGVPGAFTPTCSMQHVPGFVEKAEELKGKGIDEIICISVNDPFVMKEWSKTYTNNKHVKFLADGSAKYTYALGLELDLSEKGLGIRSRRFALVCDNLEVKVANIEEGGSFEVSSAEEILKSLES

SEQ ID NO: 82961 - protein, 68 aa, Brassica juncea
MTTSKRLADRKIEKFDKNITKRGFVPETTTKKGKDYPVGPILLGFFVFVVIGSSLFQIIRTATSGGMS

SEQ ID NO: 82962 - protein, 238 aa, Wolbachia endosymbiont of Drosophila simulans
MSTIKIEKKSQLVKEVFDSVASRYDTMNDIMSLGMHRLWKDRMVNSVHFTKNSKVLDVAGGTGDIAIRIVRKEPSAKVTVCDINQNMLSRGRDKAINSNQINFDWVCANAESLPFEDSEFDYCTIAFGIRNVSDRKKALNEAHRVLKPHGKFICLEFAPMHYQNEIFTKLYDLYSFKVIPKIGSIVAKDKSSYEYLVKSIREFPTQADFKMEIEEVGFKNVEFHNMSYGIVALHIGTK

SEQ ID NO: 82963 - protein, 331 aa, Synechococcus elongatus PCC 7942
MIRSATLPFASALPSLPDNHRLRLFSGSSNSALSQEVSRYLGIDLGPMIRKRFADGELYVQIQESIRGCDVYLMQPTCWPVNDHLMELLIMIDACRRASARQITAVLPYYGYARADRKTAGRESITAKLVANLITQAGANRVLAMDLHSAQIQGYFDIPFDHVYGSPVLIDYLRSKNLADLVVVSPDVGGVARARAFAKKLDDAPLAIIDKRRQAHNVAEVLNVIGDVQGKTAVLVDDMIDTAGTICEGARLLRKQGASQVYACATHAVFSPPAIERLSASGLFEEVIVTNTIPIPEENRFPQLTILSVANLLGETIWRIHEESSVSSMFR

SEQ ID NO: 82964 - protein, 344 aa, Nitrobacter vulgaris
MSQELTLQQRMDGEAGSDPLRQAVKEAVAALARAAVDISDLTCRGALAGITGQAQGRNTDGDIQKDLDVRADQIIRDALGKLPIAALASEEMADLDILNPAAPICVAFDPLDGSSNINTNMSVGTIFSIMPTPSDVNAAFRQAGSAQLAAGFVVYGPQTSLVLTLGRGVDIFTLDRADRVFKLTGSSVQIPTDANEFAINASNRRHWDLPVRAYIDECLAGADGPCGKNFNMRWIGSLVAEAFRILIRGGIFLYPGDARDGYEEGRLVVYEAHPMAFIVEQAGGGASTGRKRVLDIVPDSLHQRVPLIMGSIKNVQRLEHMHTVPDVALEANAPLFGNRGLFRV

SEQ ID NO: 82965 - protein, 519 aa, Synechococcus elongatus PCC 7942
MSDYSDRSDFSERQDRSSDDRPNFRRFDRDRPSEGRRFEGRSEGGYRGRDDRGGSGGYRQNRDDRGGFRGRDDRGGYRGGDRDRPSEGRRFEGRSEGGYRGRDDRGGSGGYRQNRDDRGGFRGRDDRGGYRGGDRDRPSEGRRFEGRSEGGFRGRDDRGGSGGYRGRDDRGGFRGRDDRGGFRGRDDRGSSGSYRGRDDRGGFRGRDDRRDDRDNFRPSRDRELNREVNTSPAGDQEATDHELIYGRHAVLAALQGNRTLNRIWVTPRLRYESTFLELIDAAKAGGAVVDEVPVERIRQLTDGAVHQGIAAQVAPYPYQELSDLIAQAKAATTDPVIVVADGITDPHNLGAIIRTAEALGAHGLVIPQRRAVGVTAAVAKVAAGALESFPVARVVNLNRALEELKDAGFWIYGAAGEAKQSIHETSFSGPVVLVVGSEDEGLSLLTRERCDHLISIPLRGKTNSLNASVAAGMVLYEVSRQRQQLTHHLEGIADNGATALTTAAVEFAGAAAGLGELGL

SEQ ID NO: 82966 - protein, 898 aa, Streptomyces coelicolor A3(2)
MARYVYDFTEGGRDMAGLLGGKGSNLAEMTRLGLPVPPGFTLTTEACRSVLDTGGEPPGLWEEVAGHLTDLETGSGRLLGQPDNPLLLSVRSGARFSMPGMMETILDIGLDDDSVHGLAKVSGNERFAWDSYRRLVQMFGTTVMGVDPSLFERALAQLKEVRGVPDDVHLDAEDLARLVETYKNVIHQETGERFPQSPVEQLRRAVLAVFASWNGERARLYRRREHIADDLGTAVNVQRMVFGNLGSDSGSGVAFTRDPATGARGLYGDYLPNAQGEDVVAGIRNTVPLTELKRLDPGAYGRLRAHMETLERHYRDLCDIEFTIERGTLWMLQTRVGKRTAEAAFVLGADLADEGLITADEGLARVSGEGLARLMFPRFDTAVTGDVLARGVPASPGAAVGAAVFDSAEAVRRAADGERVVLVRQETTPDDLPGMIAAQAVLTSRGGKTSHAAVVARGMGKVCVCGADELTVDTGARRCTAPDGTIVEEGTVLSVDGTAGTVYAGAVPLVDSAVMRYLEAGAGGRATTGVVDAVARALARADAVRRLEVRANADTPQDAVRARRFGAQGIGLCRTEHMFLGERRKLVEEMILAGTDAGRERALAALLPLQREDFTGILEAMDGLPVTIRLLDPPLHEFLPDRADLAVRIATAEARGEEPDAHDAELLAAVGRMHEENPMLGLRGVRLGLVVPGLVAMQVRALGEAVAQRLTAGGAPRAEIMVPLVGDVRELRLVREEVERVLAEVSDTSGVPVTCPVGTMIELPRAALTAGRIAEDAEFFSFGTNDLTQTTWGFSRDDVEAEFFSAYLDRGVFPVSPFETLDRDGVGRLVGIAVEEGRATRPDLTIGVCGEHGGDPDSVHFFHSAGLDYVSCSPFRVPVARLEAGRAALDLADAGDSR

SEQ ID NO: 82967 - protein, 278 aa, Dechloromonas aromatica RCB
MAKKALCIGINNYPGTDMDLQGCVNDANDWAGVLAERGFKVTTLLDDQATKAAMVKAMSDLIGKGAKGDTLVITYSGHGTYQPDTDGDEADGLDEALCPYDLQTKGEALIDDEIHAIFNTRKSGVRLVLISDSCHSGTVTRAAKAEKDADFRPRFMPMGNWLPEKLLPKNRAGKTAATMTAPAGSSPLLAAARTNQLGDLLLAGCKEGPNNFSYDAKIKGRFNGAFTYYALKALKNMKEGATYVDWYKAIGKYLPSASYSQVPQLVGSTGARKGKIFE

SEQ ID NO: 82968 - protein, 156 aa, Brassica napus
  misc_feature (76)..(76): Xaa can be any naturally occurring amino acid
  misc_feature (121)..(121): Xaa can be any naturally occurring amino acid
  misc_feature (147)..(147): Xaa can be any naturally occurring amino acid
MRSSLMMEREARNETEREERDDLEETQNEADEFRSIPPWKSQITFRGIVASIIIGIIYSVIVMKLNLTTGLVPNLXNVSAALLAFVFLRKLDPSFLPRQGLVTKPFTKQENTVVQTCAVAXTAFAVGGGFGSYLLGLSTKTYEQSGXHTEGNSPGS

SEQ ID NO: 82969 - protein, 488 aa, Bacteroides fragilis YCH46
MIFTAENILLIGSILLFVSIVVGKTGYRFGVPALLLFLLVGMLFGSDGLGLQFHNAKIAQFIGMVALSVILFSGGMDTKFKEIRPILSPGIVLSTVGVFLTALFTGLFIWYLSGMSWTNIHFPLITSLLLASTMSSTDSASVFAILRSQKMNLKHNLRPMLELESGSNDPMAYMLTIVLIQFIQSDGMGTGNIIGSFIIQFLVGAAAGYILGKLAILILNKINIDNQSLYPILLLSFVFFTFAITDLLRGNGYLAVYIAGMMVGNHKITFRKEIATFMDGLTWLFQIIMFLMLGLLVNPHEMIEVAVVALLIGVFMIVIGRPLSVFLCLLPFRKITLKSRLFVSWVGLRGAVPIIFATYPVVANVEGSNMIFNIVFFITIVSLIVQGTSVSFVARLLHLSTPLEKTGNDFGVELPEEIDTDLSDMTITMEMLNEADTLKDMNLPKGTLVMIVKRGDEFLIPNGTLKLHVGDKLLLISEKNKQETVKNE

SEQ ID NO: 82970 - protein, 529 aa, Triticum aestivum
  misc_feature (469)..(469): Xaa can be any naturally occurring amino acid
  misc_feature (491)..(491): Xaa can be any naturally occurring amino acid
MHLVAMDIPLPLLLSTLAVAVTICYVLATFFRADKGRAPLPPGPRGWPVLGNLPQLGGKTHQTMHEMSKVYGPVLRLRFGSSVVVVAGSAAVAEQFLRTHDAKFSSRPPNSGGEHMAYNYQDVVFAPYGPRWRAMRKVCAVNLFSARALDDLRGFREREAALMVRSLVDAAATGGVVAVGKAANVCTTNALSRAAVGLRVFAAAGAELGAKEFKEIVLEVMEVGGVLNVGDFVPALRWLDPQGVVARLKKLHRRFDDMMNGIIAERRAGGSTAGEEKEGKDLLGLLLAMVQEDKSLTGGEEDRITDTDVKALILNLFVAGTETTSTIVEWAVAELIRHPDMLKRAQEEMDAVVGRDRLVSESDLPRLTFLNAVIKETFRLHPSTPLSLPRMASEECEVAGYRIPKGTELLVNVWGIARDPALWPDPLEFRPARFLPGGTHADVDVKGGDFGLIPFGAGRRICAGLSWGXLRVVTVTAATLVHSFDWELPGXQTPDKLNMEEAFSLLLQRAVPLMAHPVPRLLPSAYEIA

SEQ ID NO: 82971 - protein, 403 aa, Parvularcula bermudensis HTCC2503
MAAFKTLDDLDVGGKRVLVRVDFNVPMDGDRVSDTTRLERAVPTVRELVDRKARVILLSHFGRPKGARVPEMSLRPVADAFAGVLGRPVSFVEESRGEIAERAVAGLADGDVLLLENTRFEAGEEKNAADYADDLAKLGDFYVNDAFSAAHRAHASTEGIAQRLPSAAGRSMQRELDYLALALAAPKRPVMAVVGGAKVSTKLDVLENLIEKADKLVVGGGMANTFLLAKGMDIGKSLAEPDLAATARSIADKAAAQGCALLLPKDVVVAKEFAPNPDTRVCAPDDVAADEMILDVGPESVDQYAAELEGCATLLWNGPLGAFETPPFHTATVELAKFGAKLSVAGALTSIAGGGDTVAALNVAQAAEDFTYVSTAGGAFLEFIEGKTLPGVAALETSAASSA

SEQ ID NO: 82972 - protein, 335 aa, Parvularcula bermudensis HTCC2503
MTVKVGINGFGRIGRLALRSMLEHGRTDIEVVAINDLGPVETNAHLLQYDSVHGRLPMTVSTGDGKLTVDGKSIAVFAERDPKALPWGDHGVDVVMECTGIFTDRDKAAQHLAAGAKRVLISAPGKDADKTIVYGVNHDVLTADDHVVSNASCTTNCLSPVAKVLNDAIGIEKGMMTTIHSYTGDQPTLDTMHKDLYRARAAAMSMIPTSTGAAKAVGLVLPELNGKLDGFAMRVPTPNVSVVDLKFIAARDTSVEEINAAIREAADGPMKGILGYTLVKNVSTDFNHDSHSSIFHMDQTKVMDGSLVSVLSWYDNEWGFSTRMADTALAMAKFI

SEQ ID NO: 82973 - protein, 377 aa, Chlamydomonas reinhardtii
MALMMKSSASLKAVSAGRSRRAVVVRAGKYDEELIKTAGTVASKGRGILAMDESNATCGKRLDSIGVENTEENRRAYRELLVTAPGLGQYISGAILFEETLYQSTASGKKFVDVMKEQNIVPGIKVDKGLVPLSNTNGESWCMGLDGLDKRCAEYYKAGARFAKWRSVVSIPHGPSIIAARDCAYGLARYAAIAQNAGLVPIVEPEVLLDGEHDIDRCLEVQEAIWAETFKYMADNKVMFEGILLKPAMVTPGADCKNKAGPAKVAEYTLKMLRRRVPPAVPGIMFLSGGQSELESTLNLNAMNQSPNPWHVSFSYARALQNTVLKTWQGKPENVQAAQAALLKRAKANSDAQQGKYDATTEGKEAAQGMYEKGYVY

SEQ ID NO: 82974 - protein, 263 aa, Marinobacter sp. ELB17
MSDQQTPASAATPGSPQDDVTHFGFRDVPKSQKAGQVAEVFHSVAGKYDLMNDLMSMGVHRLWKRFTIELSGVRPGHQVLDIAGGTGDLTMKFSDLVGPSGKVVLADINASMLKVGRSRLADRGYAGNIEYVQADAEHLPFPDNSFNAVSIAFGLRNVTDKDQALRDMARVLKPGGKLMVLEFSKPTNPLLSKAYDSYSFTALPFMGKLIAGDSKSYKYLAESIRMHPDQDTLKAMMETAGFANCKYHNMTGGIVALHVGIKP

SEQ ID NO: 82975 - protein, 328 aa, Zea mays
MVRRTVLAALLVAAALAGGARAQLKEGFYDYSCPQAEKIVKDYVKAHIPHAPDVASTLLRTHFHDCFVRGCDASVLLNATGGSEAEKDAAPNLTLRGFGFIDRIKALLEKECPGVVSCADIVALAARDSVGVIGGPFWSVPTGRRDGTVSIKQEALDQIPAPTMNFTQLLQSFQNKSLNLADLVWLSGAHTIGISQCNSFSERLYNFTGRGGPDDADPSLDPLYAAKLRLKCKTLTDNTTIVEMDPGSFRTFDLSYYRGVLKRRGLFQSDAALITDAASKADILSVINAPPEVFFQVFAGSMVKMGAIEVKTGSEGEIRKHCALVNKH

SEQ ID NO: 82976 - protein, 215 aa, Glycine max
MAASITLSRLVSSTLTTASFFPPITLPSKLSSLRLPTRRHPKPLRFSSSTITATISVGDKLPEATFSYLDSSGEVQTTTVSELTKGKKAVLFAVPGAFTPTCSQKHVPGFVEKSGELRAKGIDTIACISVNDAFVMKAWKEDLKVNEEVLLLSDGNGTFTKAIGVELDLSDKPVGLGVRSRRYALLAEDGVVKLFNLEEGGAFTFSGAQDILDVL

SEQ ID NO: 82977 - protein, 260 aa, Glycine max
MEELEQWKEQLSHFANLALDRLLEVPPNQLYAAAAIVIFTTLLLLSIRLFKRAKSNTVVLAGLSGSGKTVIFYQLRDGSTHQGTVTSMEPNEGTFILHNEKTRKGKIKPVHVVDVPGHSRLRPKLDEYLPQAAGIVFVVDALDFLPNCRAASEYLYDLLTKGSVVRKKIPVLILCNKTDKVPAHTKEFIRKQMEKEIDKFRASRSAISAADLANEFPLGVPGEPFFFFTQCSNKVTTADASGLTGEISQLEEFIREHVKP

SEQ ID NO: 82978 - protein, 328 aa, Campylobacter lari RM2100
MKILITGGAGYIGSHTLKQFLETNHEICVLDNLSKGSKKSLDELSKIRPFKFFEQDLSDYAGIKKLFKEEKFDAIVHFAASIEVPESMENPLKYYMNNTANTSNLIQTCLETGVKKFIFSSTAATYGEPQTPIVDEQSPLAPINPYGQSKLMSEKVLQDANMANPEFKYCILRYFNVAGACMSYPIGQRYPKATLLIKVAAEVATGKREKLYIFGDDYNTKDGTCIRDFIHVDDISSAHLAALEYLENNESNIFNVGYGHGFSVKEVIETMKKVSGVDFTVELAPKRAGDPSVLISNADKIKTLTNWKPKYDNLELICKSAYEWEKQC

SEQ ID NO: 82979 - protein, 852 aa, Deinococcus radiodurans R1
MGAFGWEQDRGAPFSGRSPRILTRMTDAPRPTAGADAPARPPAAPLVAPNFITEIIERDLEAGKYPRVVTRFPPDPSGYAHLGHVFASLLDFNTARQYGGQFNLRMDDTNPELARQEYVDSIADDLKWLGLDWGEHFYYASDYFDRYYAYAEQLIRQGDAYVESVSPEELSRLRGNATTPGTPSPYRDRSVEENLDLLRRMKAGEFADGEHVLRAKIDLTAPNMKLRDPVLYRIVNKPHFRTSDEWHIYPAYDFEHPLQDAIEGVTHSMCSLEFVDNRAIYDWLMEKLNFDPRPHQYEFGRRGLEYTITSKRKLRELVQAGRVSGWDDPRMPTLRAQRRLGVTPEAVRAFAAQIGVSRTNRTVDIAVYENAVRDDLNHRAPRVMAVLDPVKVTLTNLDGEKTLSLPYWPHDVVRDSPDGLVGMPGGGRVAPEEAVRDVPLTRELYIERDDFSPAPPKGFKRLTPGGTVRLRGAGIIRADDFGTDEAGQVTHIRATLLGEDAKAAGVIHWVSAERALPAEFRLYDRLFRVPHPEGENADVEDDSAGPAEHEAEPGAGQETAPVSQGFMRYLTPDSLRVLRGYVEPSVAGDPADTRYQFERQGYFWRDPVELERVDSREDALVFGRIITLKDTWGKQGGGTQQKAEGKKRPSTKGRGPDEVRGEGSSSPAKAHAPKAQPLTPEQDAEFTRLLGLGASEGDARTIARDPALLAFVGGAAPGDTFAQVASWTVNELVAGLRAGEVKVRAADLAPLAEGVASGQLSARIAREALARAAASGDAPLTIIEREGLNAGLSAEALQQVVAQVIAANPDKAEAYRGGKTALLGFFTGQVMRATAGKADPQALAAALKDALA

SEQ ID NO: 82980 - protein, 143 aa, Marinobacter sp. ELB17
MAESAAGYDLTQLTAEQIEEKAVGLSADERRILLDHGTEPSFCGTLLDNKKQGVYECRLCDLPLFNSNAKFDSGTGWPSFFQPFDPQHIHYIEDDTLGMRRTEVRCPRCDSHLGHVFPDGPAPTGQRYCLNSVALMFKENAGD

SEQ ID NO: 82981 - protein, 391 aa, Synechococcus elongatus PCC 7942
MVRISGFCCAMSLAERQAALLVLADGSVFHGYACGAAGTVIGEVVFNTGMTGYQEVLTDPSYCGQIVSFTYPELGNTGVNPEDEESARPQVSGLIARNVARRHSNWRADRSLPDYLQQHNIVGIYGIDTRALTQHLRSTGAMNGGISTTILDPEELWAEVKAAPSMEGLNLVDQVTTDRPYEWQTPTSQTWEFIEGPTTESLTVVAIDFGVKRNILRRLASYGCRVIVVPADTPIEEILRHEPDGVFLSNGPGDPATVKNGISTAQALLQTGLPLFGICLGHQILGLALGAQTFKLKFGHRGLNHPCGLSQQVEITSQNHGFAIAADSLGPDVEVTHLNLNDRTVAGLRHRHLPVFSVQYHPEASPGPHDSDYLFEQFVALMRDRQPTPVA

SEQ ID NO: 82982 - protein, 266 aa, unidentified eubacterium SCB49
MNYQENLAIIIEASLVAGTEIMKVYASDFDVEHKGDNSPLTIADKNANDVINRYLKKTDFPIISEENKQIAFDVRKNWSTCWIVDPVDGTKEFIKRNGEFTVNIALVQGGNPIMGVIYVPVLKTLYFTADNGNKSYKIEAVSEGVSVVEILKNATEISPISIDDEGIVKVVGSRSHLNEDTEAFVSKLQEKHTVEIVSKGSSLKFCLIAEGEAHIYPRYAPTMEWDTAAGQAICQGAGVRVIDVTTNEPLQYNKENLLNPYFIVQE

SEQ ID NO: 82983 - protein, 387 aa, Triticum aestivum
  misc_feature (84)..(84): Xaa can be any naturally occurring amino acid
  misc_feature (364)..(364): Xaa can be any naturally occurring amino acid
TRCARRWFGSSLLALNKKTYELAGVSTPGNAPASYKEPGFGWMAGFLLAISFVGLLNLLPLRKALVIDYKLTYPSGTATAVLIXGFHTPQGEKNAKMQVRGFLRSFGISLIWSFFQWFYTGGQSCGFLRFPTFGLKAWKQTFFFDFSLTYVGAGMICSHLVNLSTLFGAVLSWGIMWPLISKPKGIWYPANVPESSMTSLFGYKSFMCVALIMGDGLYHFIKLTGITAKSLHAQSNRKHVKRAANEDTVSFHDLQRNEVFTREYIPNWLAYAGYASLSIIAIIVIPTMFRQAKWYYVVVAYVLAPVLGFSNAYGAGLTDMSMSYNYGKIALFIFAAWGGKDDGVIAGLVGCAIVNTSEVSADLXHDYKTGICTDITEILLSGSHQYG

SEQ ID NO: 82984 - protein, 623 aa, Kluyveromyces lactis NRRL Y-1140
MEFNLQQTCRPDLKRKFEDVDSNGVSDQRQDTDGKGEILRNKASKVNQNNEEIQLPSEMPQFNFFKFCYRHNPDIQHTCKDSMVFQDQVRSEKWMEKMKALDKESDRAIIKQTLDNFQHSNDKIRRLMLEGILQLCCFPQLSYIADEVKQLIKIDFISTLPEELSLKILGYLDCQSLCIASLTCKRWKTLADDDRVWYHMCEQHIDRKCPNCGWGLPLLHMKRARYLPVNEAHVHNQNGNQFQNVANGNGNEIGGGKSLINPGNSPNQTVAARARNSRYYTRPWKVIYRERFQVESNWRNGRCRIQLFKGHMDGVLSLKFNHRLLFTGSYDSTVAIWDTKSGNLIRRLTGHTDGVKGIYFDDQKMITASLDKTIRVWNYITGSCISTYRGHQDSVLSVDSYKKIIVSASADKTVKVWHVESRTCYTLRGHTEWVNCVKLHPKSFTCYSSSDDKTLRMWDIRTNSCIKVFRGHVGQVQKVIPLTIKDTENLVVDEKIEKVPNPELEEDFADDCTGIFDPNLKYPTHLLSCSLDNTIKLWEVSSGRCIRTQFGHVEGVWDIAADNFRIVSGSHDKSIKVWDLQNGKCIQTFTGHKAPIVCVGIGDSSFVSGDELGEVKMWHFDDI

SEQ ID NO: 82985 - protein, 303 aa, Zea mays
  misc_feature (36)..(36): Xaa can be any naturally occurring amino acid
AESRKDSVLACGGGGGSYHHHRSRFGDTTLTKVFVXGGLAWETPSEGLRQHFDVYGEILEAVVITDRETGRSKGYGFVIFRDPDAAARAVQNPNPVIAGRRANCNIAAFGPPRAAQPRGRGGGGGGRGPHVPDQPPQGSPSPYRVPSQMTPPHQAATLFYNPQFGYWYPPDYPYQQALYNSQVLQHYYPQMYGPASPSGPAYQYMGYMPGGPSPRTGFSPMQQPMRQPFFQQPTTQMDGSFPSVPSLPPNFRLQLPPRAVSRESDDASGSQSAQPVSSTPATVTNNEEDSRPVVSDSDPNTPN

SEQ ID NO: 82986 - protein, 520 aa, Streptococcus pyogenes MGAS10394
MTEISILNDVQKIIVLDYGSQYNQLIARRIREFGVFSELKSHKITAQELREINPIGIVLSGGPNSVYADNAFGIDPEIFELGIPILGICYGMQLITHKLGGKVVPAGQAGNREYGQSTLHLRETSKLFSGTPQEQLVLMSHGDAVTEIPEGFHLVGDSNDCPYAAIENTEKNLYGIQFHPEVRHSVYGNDILKNFAISICGARGDWSMDNFIDMEIAKIRETVGDRKVLLGLSGGVDSSVVGVLLQKAIGDQLTCIFVDHGLLRKDEGDQVMGMLGGKFGLNIIRVDASKRFLDLLADVEDPEKKRKIIGNEFVYVFDDEASKLKGVDFLAQGTLYTDIIESGTETAQTIKSHHNVGGLPEDMQFELIEPLNTLFKDEVRALGIALGMPEEIVWRQPFPGPGLAIRVMGPITEEKLETVRESDAILREEIAKAGLDRDVWQYFTVNTGVRSVGVMGDGRTYDYTIAIRAITSIDGMTADFAQLPWDVLKKISTRIVNEVDHVNRIVYDITSKPPATVEWE

SEQ ID NO: 82987 - protein, 526 aa, Streptococcus pyogenes MGAS10394
MTAFLMTVKEETMSILEVKQLSHGFGDRAIFENVSFRLLKGEHIGLVGANGEGKSTFMSIVTGHLQPDEGKVEWSKYVTAGYLDQHTVLESGQTVRDVLRTAFDELFKTENRINEIYASMADDKADIAVLMEEVGELQDRLESRDFYTLDAKIDEVARALGVMDFGMESDVTSLSGGQRTKVLLAKLLLEKPDILLLDEPTNHLDAKHIEWLKRYLQHYENAFVLISHDISFLNDVINIVYHVENQSLVRYTGDYYQFQAVYEMKQSQLEAAYERQQKEIANLQDFVNRNKARVATRNMAMSRQKKLDKMDIIELQAEKPKPNFEFKQARTPSRFIFQTKNLVIGYDYPLTKEPLNITFERNQKIAIVGANGIGKSTLLKSLLGVIEPLEGHIVTGDFLEVGYFEQEVTGVNRQTPLEVVWDAFPALNQAEVRAALARCGLTSKHIESQIQVLSGGEQAKVRFCLLMNRENNVLILDEPTNHLDIDAKNELKRALKAYKGSILMVCHEPDFYNGWVTDTWDFSKLT

SEQ ID NO: 82988 - protein, 319 aa, Oryza sativa Indica Group
MDPATTELRFDTPLLRIYNDGRVERLFGTETTPAGFDGATGVTSKDVVIDDATGVSARLYIPDLPASGPGHHRKKLPIVVYFHGGGMVLDSAASPTYHRYLNSLVSKAGALAVSVNYRLAPEHPLPAAYDDAWAALSWTASAADPWLSEHGDVGRVFLAGDSGGANVVHNVAIMAGAGQSSLPPGAAVEGVIILHPMFSGKEPIDGENAETRELTEKLWPLICADPEAGLDDPRLNPMAEGAPSLQKLGCRKLLVCSAESDIGLARAAAYYQAVMASGWPGMAEWLESKGEEHVFFLNKPDCEESVALMDRVVAFLAGN

SEQ ID NO: 82989 - protein, 178 aa, Triticum aestivum
  misc_feature (69)..(69): Xaa can be any naturally occurring amino acid
  misc_feature (100)..(100): Xaa can be any naturally occurring amino acid
  misc_feature (124)..(124): Xaa can be any naturally occurring amino acid
MAPTVMASSATSVAPFQGLKSTAGLPVSRRSNGASLGSVSNGGRIRCMQVWPIEGIKKFETLSYLPPLXSTEALLKQVDYLIRSKWVPCLQFNKVGFIFXVEHNASPGYYDGRYWTMWKLPNVXGCTDATQVINEVEEVKKEYPDAYVRIIGFDNMRQVQCVSFIAFKPPGCEESGKA

SEQ ID NO: 82990 - protein, 368 aa, Oryza sativa Indica Group
MATPAPELSRWLLRVALLAAPLAALLLQLPIPISLKPRSTDTAAAAAMDAAASEIEFDMPGVLRMYKDGRVERFDGTQTVPPSPSGDPANGVVSKDVVLDPAAGISARLYLPPGVEPGKKLPVVLFFHGGAFLVHTAASPLYHRYATSLAAAVPAVVVSADYRLAPEHPVPAAYDDAFAALRAVVAACRPDGAEPWLAAHGDASRVVLAGDSAGANMAHNAAIRLRKEGIEGYGDKVSGVVLLHPYFWGKDPVGGESTDAGYRGSFHGTWEFVSAGKLGLDHPCVNPLASPEEWRQLGAGRVLVTTAEHCWFVERARAYAEGIKKCGWDGEVELHETDGEGHVFFLPKPDCDNAVKELAVVTDFVRRC

SEQ ID NO: 82991 - protein, 339 aa, Dechloromonas aromatica RCB
MPIRVAINGFGRIGRMAFRAIAKEAEFADIAVVAINDLLEPDYLAYMLKYDSVHGNFAGDVAVDRNDLLVNGRRIRLSAERHPEQLAWGEVKADVVIEATGHFLTHDGCLKHVHAGARKVVQSAPAKDSTPMFVYGVNHETYAGEDIVSAASCTTNGLAPVAKVLHDKFGIRRGLMSTVHAATATQKTVDGPSGKDWRGGRGILENIIPSSTGAAQAVGKVIPALNKKLTGMAFRVPTSDVSVVDLTVELEKPASYADICAAMKAAAESGPLKGVLGYTGDSVVSTDFRGCRLPSIFDAGAGIALDPTFVKVVAWYDNEYGYTCNLLRLVRHISEAPTK

SEQ ID NO: 82992 - protein, 420 aa, Oryza sativa Indica Group
MATASSGVTQASVMAEARRPGSSASTFLGFVFGARQLPSIMVAKIKRQIGGLSLLAKLGLLLLALLLLLAAILLLVFLLPRHHRRPLPPGSPPVNASDPDNIVAFDFSPFLILYKSGRVHRMDGTDRVPAGVDEATGVTSKDVVIDRSTGVGARMYLPPAKGAGKKDLAGALPVLVFFHGGAFVIESAFTAKYHDYLNKVTAKARVVAVSVDYRLAPEHPVPTAYDDSWQALNWVAKNGRSGPEPWLRDRGNMSRLFLAGDSAGANIAHNMAMRAGKDGGQLEGGVAITGILLLDPYFWGKNPVGAETTDPARRRQYEATWSFICDGKYGIDDPLVDPLSMPAPEWRKLACSRVAVTVSDLDDFKERGKAYAAALRDSGWGGEVEEYETAGEVHVYFLDKPSSPKSAKELTFVAGYLSHE

SEQ ID NO: 82993 - protein, 407 aa, Pisum sativum
MAAATASSQLIFSKPYSPSRLCPFQLCVFDAKSVLSSSRRKHVNGSGVRCMAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 82994 - protein, 227 aa, Sulfolobus solfataricus P2
MDPKELLATYTLNYLRGKKIIGVGTGKTVKKLIEVLSSEENLKESSLFVASSIDTEIELSKRGFKVLSLFSAIQPEIYVDSFDIVTKDGIMIKGGGGALLREKLLAYFSKYRIFIGESTKLKDTKVIDIPIEVISVGVSYVKYKLEKMGFTVKIREGSGKMGPIISDNGNVILDVSVKTENLCEFDRMIKNIPSIVETGIFCKELYNKIILANEQGRIEEMDAGDGI

SEQ ID NO: 82995 - protein, 290 aa, Dechloromonas aromatica RCB
MSVKHPIIAITGSSGAGTSTVMQSFQHIFRRECLKAQIVEGDSFHRYDRLAMRAEMKAQEEAGNRNFSHFGPEANLLEELQDLFIAYGQNGTGKVRKYLHDAGEAEPFGQQPGTFTPWQEITATTDLMFYEGLHGAYADDQIDIAKQVDLCVGVVPTINLEWIQKLHRDQKMRGYSQEAVTDTILRRMPDYVSHLCPQFSRTHVNFQRVPIVDTSNPFIARDIPTADESMVVIRFANPKGIDFQYLINILHGAMMTRPNTLVVPGGKMGLAMQMIFTPMVLRLMDHKRRA

SEQ ID NO: 82996 - protein, 870 aa, Oryza sativa Indica Group
MSDAGAGGDGDEVIHDAPNFIRVYKSGRVERFLRIDFAPPSTDAATGVSSKDVVVVPGDGVSARIYLPSTPASGYGRRLPVLVFFHGGGFCLGSAFDAATHGHANRLAARAGVIVVSVEYRLAPERPVPALYDDAWAALQWVASHAAGEGQEPWLTAHADFGRVHVGGESAGANIAHHAAMRAGAEELGHGVKVNSLVLIHPYFLGGDGDGYSESDEMGMALLRELIRLWPVVCPGTSGCDDPWINPMADGAPSLAVLGCRRALICIGGKDAMRGRGRLYCEKLRECGWRGEVEIWEADGQGHGFHLLWPTCTQAEAQLRDNVLLAYEVHIQTQLVYLGESDAQMFTARSLQLDIQQNIFCVSFSGMTSQNIKHYARKIDVELLHGRLIVHEYPQLQGTKASLSLRATEKEMFICMKGHMHSISNQTCGCKPLIHHGSFNIPKHSWIKFQQPRFFYAYHICSQITTLRNTIVSCVTYPQEIRNMESEKHIICRHPPTYGNLITVLSIDGGGIRGIIPAVVLTFLESELQKLDGEEARIADYFDVIAGTSTGGLVTAMLAAPNKKRRPLFAAKDIKAFYMNHAPKIFPQLRGPFGRMMRIFRSMSGPSYDGKHLHEVVREKLGSTRLHQTLTNVVIPTFDIKRLQPTIFSSYEVKKKNNNTMDALLSDICISTSAAPTYLPAHFFRTEDCHGNIKEFNLIDGGVAANNPALVAIGEVSKQIFKKNPDFFPVKPMDYGRFLVISLGTGSPKIEGKYNAQNAKSWGVLDWLLVGGSTPLVDIFTQASADMVDIHIAAVFKVLHSEQNYLRIQDDTLEGTLASVDVATRDNLEKLANVGEILLNKPVSRANLETGQMMPACDDSEITNGEALKR

SEQ ID NO: 82997 - protein, 904 aa, Erythrobacter sp. NAP1
MATRMLIDARHSEETRVAVLKGNRIEEFDFESAEHKQIKGNIYLAKVTRVEPSLQAAFVDFGGNRHGFLAFNEIHPDYYQIPQSDREALLAEEAEAAEEEARLRDEEEEEGITPGEEYDAEDESAEALAEDLAEDGLEEIDTSDKDKVSTIEDGASDDDDDDDQDEDDSEDEGEESSEDGEDGDDGEKKPRRGRRGRGRRRQGGKKGQQKGRSRAKEVDEVRAKRMALRRRYKIQDVIQRRQVLLVQVVKEERGNKGAALTTYLSLAGRYTVLMPNSSHGGGISRKINSASDRKRLKQVVSDLSLPKSMGLIVRTAGLSRTKTEIKRDFDYLARLWDDIRQTTLASTAPSLIHSDSDLIKRAIRDIYNREIEEVVVEGEEGYKSAKAFMKMLMPSHARRVKAYSDPVPLFQRYGAEDQLRAMYDPMVQLKSGGYLIINPTEALVSIDINSGRSTKEHGIEQTALHTNLEAAREIARQLRLRDMAGLVVIDFIDMEYNSNVRKVEKAMKEALKNDRARIQVGRISGFGLMEMSRQRLRTGVLEATTRECPHCDGTGLVRTASSAGLSALRLIEDEAAKGKGSKICLEASTEAAVYLLNEKRHELVEIEQRYGVIVEVMPEGEDEGAKMKVSSQGPRPTEAPKFEPIVDDDEDEDDIPEDDGSEEDDDAPKKKKRRRRRGGRGRGKKRQDTGSSEDGEDNSDDSDDSDASDGDEASEETSDDGEEKPKRRRRRGGRGRRKKTDETVTSEDAENLEEVSEQVKEDMTVVAGPDDAPETAGAMAAETDAKADGETEEAPKEEKPKRKRAPRKKKVEEAPAEEAAPAEEAKVEEAPTEEEPKKKPARKRAPRKKKVEEAPAEEAPTEEAKTEDAAPAETAEEPASDDKADEQADGGKKRGGWWQRTFGE

SEQ ID NO: 82998 - protein, 404 aa, Vitis vinifera
MSSSISALKSCNVAVIGAGPGGLVAARELRREGHKAVVFERQAQVGGTWEYQPSVEADPLASDPSRTIVHSSLYPSLRTNLPREVMGFRDYPFLSPGLAHRDSRRFPGHREVLHYINDFTTEFGVTDLIRFEVEPWRWFIQGWWRLRSRRGNDEEVDEIFDAVVVCNGHHTEPRIAEIHGIDAWPGKQMHSHNYRIPEPFRDQVVILIGNAFSADDISRDIAQVAKEVHVASRSPGYDNMWLHPMVESVHRDGTVIFQDGSGVLADVIMHCTGYEYYFPFLDTNGIVTVDDNRVGPLYKHIFPPALAPGLSFVGLPWMAPLFAVFELQSQWIAGVLSGRIGLPSHEEMMKDLMGRLCDILIKLVIMSSSTLIGLLLRVGFQDLKNGERKCIMQFSSTTPTRDIS

SEQ ID NO: 82999 - protein, 345 aa, Synechococcus sp. WH 8102
MMGVHCVTNPLAQLLITGGAGFIGSHTGLVLLEAGHELLVFDDFSNSSPIALERVRELAGPAAAPRLRQMQGDIRSPRNLEQAFTKAPSGIDAVIHFAGLKAVGESVEKPLHYWDVNLNGSRCLLEAMDAHSCHTLVFSSSATVYGNPETVPIPATAPISPINPYGHTKAAVERMLSDLHASAQDAWRIACLRYFNPVGAHPSGRIGENPLGIPNNLFPFVSQVANGRREQLQVFGGDWPTPDGTGVRDYIHVMDLADGHRAALDCLLAEATQMVTLNLGSGQGQSVLEVVQSMQAASGRSIPNTITDRRPGDAAQRLGWRTQRSLEDICRDGWAWQQQNPERYT

SEQ ID NO: 83000 - protein, 249 aa, Picea sitchensis
MKFNIANPTTGCQKKLEIDDDQKLRAFYDKRLAQEVNGDALGEEFKGYVFKIMGGCDKQGFPMKQGVLTPGRVRLLLHRGTPCFRGYGRRNGERRRKSVRGCIVSPDLSVLNLVIVKKGENDLPGLTDTEKPRMRGPKRASKIRKLFNLSKEDDVRKYVNTYRRTFQSKSGKTRSKAPKIQRLVTPLTLQRKRARIAEKKKRIAKAKNEAAEYQKLLASRLKEQRDRRSESLAKKRQSRVSTGSKPSVA

SEQ ID NO: 83001 - protein, 498 aa, Marinobacter sp. ELB17
MSTVGHLINGQIVNDKNRTQPIFNPSTGDSTRQVALASKATVEQALAAAQAAYPAWRATPPIKRARIMFRFKELLEQNANHIAQLIGEEHGKIQHDALGELQRGIENVEYACGAPELLKGEHSANVGPGIDAWSEFQPLGVVAGITPFNFPAMVPLWMYPMAIVCGNCFILKPSERDPSSTLFIAQLLQEAGLPDGVMNVVNGDKEAVDTLLRDPRVQAVSFVGSTPIAEYIYTTASAHGKRCQALGGAKNHAIVMPDADMDNTVNQLLGAAFGSSGERCMALSVAVAVGDAAADALVAKMAEAMKALKVGAYNVPSNDFGPVITAQHRDKIVGHIDSAEKQGARIVVDGRNQVVNGHENGFFVGGTLIDRVTPEMTSYQEEIFGPVLQVVRVKTMQEAMDLINAHEYGNGTCIFTRDGEAARYFTDHIMVGMVGINVPLPVPVAYHSFGGWKRSLFGDLHAYGPDGVRFYTRRKAITQRWPSAGVREGAEFSMPTMK

SEQ ID NO: 83002 - protein, 537 aa, Capsicum annuum
MGNACRGSFRAKTFQGSYPQNHSTSKHSKVEEEQQPDPAPLVVKDHSTSTKNMNHRSSANQSCCVLGHKTPNIRDLYALGRKLGQGQFGTTYLCTELSTCIDYACKSIAKRKLISKEDVEDVRREIQIMHHLAGHKNIVSIKGAYEDPLYVHIVMELCGGGELFDRIIQRGHYTERKAADLTKIIVGVVEACHFMHRDLKPENFLLVNKDDDFSLKAIDFGLSVFFKPGQIFTDVVGSPYYVAPEVLLKNYGPEADVWTAGVILYILLSGVPPFWAETQQGIFDAVLKGHIDFDSDPWPLISESAKDLIRKMLCMRPSERLTAHEVLCHPWICENGVAPDRALDPAVLSRLKHFSAMNKLKKMALRVIAESLSEEEIAGLKEMFKAMDTDNSGAITFDELKAGLRKYGSTLKDIEIRELMDAADVDNSGTIDYGEFIAATIHLNKLDREEHLMAAFQYFDKDGSGYITVDELQQACADHNITDVLFEDIIREVDQDTDGRIDYGEFVAMMQKGNPCIGRRTMRNSLNFSMRDAPGAH

SEQ ID NO: 83003 - protein, 247 aa, Wolbachia endosymbiont of Drosophila simulans
MRKAGRLAAKTLDFIAPYVKVGVTTNELNDLCHDFIINAGAIPAPLNYRGYPKSICTSKNAVVCHGVPDNKPLKDGDILNIDVTVILNGWHGDTSRMFWVGKPSIKAKRLCDATYHALMEAIKQVKPGNKLNEIGLAIEKYIRDFGYSIVRSYCGHGIGKVFHAPPNVVHFYDQDENLVLKEGMFFTIEPMINAGKHETLLSKLDDWTVTTRDLSLSAQFEHTIGVTKDGAEIFTLSPKNWHFPPYN

SEQ ID NO: 83004 - protein, 335 aa, Campylobacter lari RM2100
MKKILITGADGFIGSHLVEMLYMQSKDENSPFYGYSIKALSQYNSFNYWGWLEDIECLKDIEVVCGDIRDPHFCKNITKDVEILFHLAALIAIPFSYVAPDSYVDVNVKGTLNICQSALENNVKRIIHTSTSEVYGTALYVPIDEKHPLQAQSPYSASKIGADTMAMSFYNAFNLPLTIARPFNTYGPRQSARAVIPTIITQIANGARQIKLGDVSPTRDFNYVKDTCMGFLELAKCQKAIGEVVNIGSNHEISIKDTLELIKKLMKSDVEFIIDTKRIRPENSEVFRLLCDNSKIKNLTNFTPQYDLEKGLAQTIKWFSNPLNLKKYKSDIYNV

SEQ ID NO: 83005 - protein, 288 aa, unidentified eubacterium SCB49
MKGIILAGGSGTRLHPLTQVVSKQLLPIYDKPMIYYPLSVLMLAGITEILIISTPQDLPNFERLFGDGSQLGLSLSYKEQPSPDGLAQAFVLGAEFIANDDVCLILGDNIFYGAGLQRMLEASIKTVQEEKKAVVFGYYVDDPERYGVASFDTDGNVLDIEEKPKNPKSNYAVVGLYFYPNNVVKIAREVKPSDRGELEITSVNSAYLAQHSLKMQLMSRGFAWLDTGTHEALTEATEFVKAIEKRTSLKIACIEEIAYFMKYINKDQLKLLAKPLGKSGYGAYLNKL

SEQ ID NO: 83006 - protein, 263 aa, unidentified eubacterium SCB49
MQSILHTAIEASIKAGEEILKVYSTDFEVISKNDDSPLTKADKNANDVIVSFLKDTEIPIISEENKQAEYKERKDWDTCWIVDPLDGTKEFVKRNGEFTVNIALVKNGTPVLGVIYVPVSKELYFTSEDSKTAMKITLSSEENFNVTELIDTATEIHPKSIDNTIRVVGSRSHLNDETQNFIDNLPGDTKVEIVSKGSSLKFCLIAEGAADVYPRFAPTMEWDTAAGQAICQAAGVQVLDQNTNKPLLYNKENLLNPYFLVTK

SEQ ID NO: 83007 - protein, 279 aa, Kluyveromyces lactis NRRL Y-1140
MTSVEVKKVLTTLLRDPENNRCGDCKVATHPRWASWSLGVFVCIKCAGFHRSMGTHISKVKSVDLDTWTEEHLEAVLEFGNNKKFNEYYENKLGGGTYVPDQSKIGQFIRTKYELKKWVGDDPIVDVKSSKHTAEAKDRVAQKAAAVRNSPSSDSPRSLDLDLGLNLNSVVTDKNVPQISSEKPSATNTNVYRPPDRPDLKKSILSLYANRKSTSPHSQSQSPSQSSLHLPTKNMSTSNSLSSGGKLTSNPWAVPRAVDDSRSGSSLSLDDDLFKNVWS

SEQ ID NO: 83008 - protein, 638 aa, Candida glabrata CBS 138
MNYTEEYGLPSQISISEYLFHRLNQLKIWTIFGLPGDFNMPLLDKLYSIPTMRWAGNTNELNAAYAADGYSRLKHLGCLITTFGVGELSAINGVAGSYAEHVGILHIVGMPPTSAQTKQLLLHHTLGNGDYSVFYRIANDIACHTAIINDTDLCADEVDNCIRAAWGYQKPVYLGVPVNQVDIPVDSSRLNNPIDLSILKKTKETDAQVIDLLLKQMYSASKPIIVVDACVRRHDALKETHALCELTNFPVFVTPMGKGTIDESYKNFGGVYSGSLSSPEVREVTDFADFVLFIGAILPEFSTSTFHFGFKKKNCCILFPTSVKIKKATFPDMLLKGTLQSLVDTIEPSKITYKHQAKVDIIAPKMEPSDSNLLRQEWVWNEISHWFKENDIIITETGSSAFGINQTRFPTNTIGINQALWGSVGFALCSCLGALFAVEEKTVVKHNLEIKLRNYNRNIFTENRTILFVGDGAFQLTVQELSTIIRWKLKPYIFIMNNNGYSVDRFLHHRSDASYYDVQPWNYLYLLELFGCTSFETRKIVTVSDFKELLADESFAKPDKIRMIEIMLPQSDVPKTLIARWQAEKELSNKRAGDFSENSSENSSPTIDPHWVKKQYLGPVTPTSSLSTELHSRSQMYL

SEQ ID NO: 83009 - protein, 364 aa, Mentha x piperita
MEASFENGRKRSSSSSSEEESAFSFAMELAAGSVLPMVIKSAIDLNLLELIKRGGEEGASAYELAAQINAENPKAAAEMIDRILQLLAAHSVLTCRVETPPSRRRRYSLAAVCKFLTRDEDGASLAPLSLLVQDRVFMEPWYHLKDVIVEGGVAFERAYGVHAFEYHAKDPKFNKIFNQAMHNQSIIFMKRILEIYKGFEGVKSLVDVGGGTGASSKMIVSKYPLIKAINFDLPHVIQDASPHPEVEHVGGDMFVSVPKADAIFLKWICHDWSDEHCRKLLKNCYDAILGNGKVIIAESTLPEDPNSGPDTIHAIRGDVIMLTVNPGGKERTEKEFRTLALQAGFKRLVKVCAAFHTCIMECHK

SEQ ID NO: 83010 - protein, 522 aa, Kluyveromyces lactis NRRL Y-1140
MIETSNWVVQKFGGTSIGKFSKQIVNEIIKVYSQEYDNNVAVVCSARSSYTKAEGTTSRLLLACDLASNNNYEYKNVLDLVERDHVANAEESVKDITIQETLIEDTKREINIVRRYLDASQVLGEVSTRTLDLVMSLGEKLSCLYVTALCQDNGVNARYVDLSFIVPSDYECKEGTLDNSFYTFLVTAFREKLSPILKETENGTKIIPVITGFFGVVPMGLLNGVGRGYTDLCAALIAVALNADELQVWKEVDGIFTADPRKVPQARLLDTVTPDEAAELTYYGSEVIHPFTMEQVIRTHIPIRIKNVQNPKGNGTIIYPSDQAKKGESTPPHPPVALTSSIFESKKKGATAITTKSDIVVVNIHSNKKTLSHGFLAEMFSTLDKYKLVVDLISTSEVHVSMALPVPDSDSLKALRCAVEELKRLGTVDVIKKMAIVSLVGKQMKQFVGIAGTMFTTLAEQHINIEMISQGANEINISCVIDESNAVRALQSIHAKLLDSPQNENFESAVNERLEQIKQMSL

SEQ ID NO: 83011 - protein, 149 aa, Brassica napus
LYVNDAFGTAHRAHASTEGVTKYLKPAVAGFLMQKELDYLVGAVANPKKPFAAIVGGSKVSSKIGVIESLLAKVDILILGGGMIYTFYKAQGYSVGKSLVEEDKLELATSLIEKAKAKGVSLLLPTDIVVADKFAADAESKIVPATAIP

SEQ ID NO: 83012 - protein, 357 aa, Dechloromonas aromatica RCB
MQFGRTTLSKFVIENTRASHGELGALLIDVAAAVKTISAMVAKGALAGHHGALDSTNVQGEVQKKLDVLTNDAILRHCEWGGQLAGMASEEMDDPYPIPAEYPRGRYLLVFDPLDGSSNSDVNVSVGTIFSIFSRRAAGDAELGDYLRPGSEQVAAGYAIYGPSTMMVLTLGNGTHGFTLDRESGNFILTHANIRVPEDTREFAINTSNERFWEPPVQRYVSECKAGKSGVRGEDFNTRWIASMVAEVHRILIRGGIFMYPKDSKDPSKPGRLRLLYEANPMAMLIEQAGGAASTGRQRILDVVPDSLHQRAPVILGSKNEVERLARYHHEYDTGADRPFVSPLFSERSLFRDESRA

SEQ ID NO: 83013 - protein, 452 aa, Sulfolobus solfataricus P2
MRKTKIVATLGPSSEEKVKELAEYVDVFRINFAHGDETSHRKYFDLIRTYAPESSIIVDLPGPKLRLGELKEPIEVKKGDKIVFSQKDGIPVDDELFYSAVKENSDILIADGTIRVRVKSKAKDRVEGTVIEGGILLSRKGINIPNVNLKSGITDNDLKLLKRALDLGADYIGLSFVISENDVKKVKEFVGDEAWVIAKIEKSEALKNLTNIVNESDGIMVARGDLGVETGLENLPLIQRRIVRTSRVFGKPVILATQVLTSMINSPIPTRAEIIDISNSIMQGVDSIMLSDETAIGNYPVESVRTLHNIISNVEKSVKHRPIGPLNSESDAIALAAVNASKVSKADVIVVYSRSGNSILRVSRLRPERNIIGVSPDPRLAKKFKLCYGVIPISINKKMQSIDEIIDVSAKLMQEKIKDLKFKKIVIVGGDPKQEAGKTNFVIVKTLEQQKK

SEQ ID NO: 83014 - protein, 267 aa, Vitis vinifera
MHANHLLLEEPIRMASILEPSKASFFPAMTKIVGTLGPKSRSVEVISGCLKVGMSVARFDFSWGDPDYHQETLENLKAAVKSTKKLCAVMLDTVGAELQVVNKCEKSISLLADGFVVLTPYQDQEASSELLPINFNGLAKAVKKGDTIFVGQYLFTGSETTSVWLEVSEVKGDDVVCMIKNSATLAGSLFTLHVSQIHIDLPTLSDKDKEVISTWGVKNKIDFLSLSYTRHAEDVRHARDHLSKLGDLHQTQIFAKIENVEVIHIYH

SEQ ID NO: 83015 - protein, 1432 aa, Shewanella sp. MR-7
MIELRIDNQIVTAEPNDNLLRAASKAGIAIPSLCDPTDATRQLGAAPHADKQDCNLCLVQIENTDASLRCVKACETPAEAGMKVITQSAYLTKQRQAALSTILSDHFADCEAPCQQACPAGVDVQSYLYHIAQGDHSQAIKVIKDTLPLPLSIGRVCPAFCETECRRGLVDDPIAIRQLKRHAADLDLADDEQGGSYQPPRLADTGKKIAIIGAGPAGLSAGYYLSNQGHSVEIFEAMPKAGGWLRYGIPEYRLPKAILDKEIELLCRNGLTIHTDTRLGHEIHLAQLVADFDAVCLAIGAQKAVPMNYKGSELAGCYLGVDFLKEHCLDKQLKLGKKVAVIGGGNTAIDCARTAVREGCDVTLIYRRTRAEMPAEAYEVHEAEVEGVKFHFLTNPIENHSDANGQVEAVTFSKMALGDADASGRRAPVDTGETFTEAFDTVIAAVSQAPDLSFMQDPMGQLSHGELALSRWNTLIGCEQTMSSGVEKLFVMGDARRGPATAVAAIGDGRKAAIAIDKMLKIGLSCDLHAHEFNSVKTIPSALIPNALKQTETSSKAGSTLYPHTPRQPRLKMPELTALQRLLNYSEVELGFPADAAMQEAARCLECACQANTDCKLRDYATDYGVEAKSLATENARHFSVDKSAPFIQFDANRCISCGKCVDVCQLQSGHCAIQFSQDSYQALPQEMTQHMERRAPRVGFSASMADSHCVQCGNCVQVCPTGALADARDKRQGDSTELKTASTICTYCGVGCRLDLKIDPKANRIRHIEGNKDSVVNQGMLCVKGRFGFDFIHSDKRLTTPLIRKNGELQPSSWPEAIAYVAKRLTEIKQKDGSNALASLASAKATNEDNFVLQKFVRSVLGTNNIDHCARLCHSSTVTGLQQSIGSGAMTNDIPSIKDSDVIFILGSDTTCAHPIIASKIQQAVMQHGARLLVADPKRVGIAEKAELYVAHRPGTDVMLLNAIMAEIIRHDWQDKAYIAQRTEGIEALYAELAKEDYSLENAALITGVKAEDIARLARTIGTAQKTAVYYAMGITQHTTGHDNVTAISNLQLLCGNIGVSGAGINPLRGQSNVQGACDMGALPNYFTGYQKVTDIHARMRFEDHWQTPLSGEIGVTATHMMHDIAKGKIKALYVMGENPVLSDPDQAHVLNALSKIDFLVVQDIFLTETAELAHVVLPAAAFVEKRGHFTNTERRVQRLEQALASPGEALPDWQIVQAVANAMGANWDYANEEAIWREINELTPQYRGIRWDRLSANAEGQISQGIQWPCPDETHPGTPIMHQSQFTRGLGLFTPVSYRLPAEMPCNEYPLTLSTGRLLEQFHTGTLTRKTPGLDLLGSPKVMISVYDAEQLGIHNGDKLRLTTRRGEIEIDAFVTKRAQAGVLFLPFHFVEAAANKLTINALDPVAYIPEYKVCAVRAEKVTTNVSETA

SEQ ID NO: 83016 - protein, 664 aa, Arabidopsis thaliana
MNSRSCICISAMKPCCRFLISFRSSSLFGFSPPNSGKFINSSKLHCTKIDSRSIRSGIHCRRIVLDRNAFCDSDSISWGGGGSRVLRARGSSRGRGRGVLVIPHVASDFRNYSTSSLDSHVNDKSFESMFVKPLVFKEVEKTEGIPKRERGNVGGGKDANFGNVGVRKETERCLSQTEVEKEAWKLLRGAVVNYCGFPVGTVAANDPGDTQTLNYDQVFIRDFVPSAYAFMLDGEGEIVRNFLLHTLQLQSWEKTVDCHSPGPGLMPASFKVKSAPLEGNDGSFEEFLDPDFGGSAIGRVSPVDSGLWWIILLRAYGKLTGDYTLQERIDVQTGIKLILKLCLADGFDMFPTLLVTDGSCMVDRRMGIHGHPLEIQALFYSALRCAREMLIVNDGTKSLVTAVNNRLSALSFHIREYYWVDIKKINEIYRYNTEEYSADATNKFNIYPEQIPTWLVDWIPDKGGYFIGNLQPAHMDFRFFTLGNLWAVISSLGNQEQNEGVMTLIEEKWDDLVANMPLKICFPALEKDEWRIITGSDPKNTPWSYHNGGSWPTLLWQFTLACIKMGKLELAKKAVAVAEKRLKEDEWPEYYDTKSGRFVGKQSRLYQTWTIAGFLAAKKLIEQPEKASLLFWEEDYQLLETCVCGLSKSSGRKNKCSRFTPPRS

SEQ ID NO: 83017 - protein, 264 aa, Vitis vinifera
MRLTKLIKRNPVLLAADGIILSHLPPEKVFLFQKAAVYKCNMAGKPAVITRVVDSMTDNLRPTRAEATDVANAVLDGSDAILLGAETLRGLYPVETISIVGKICAEAEKVFNQDLYFKKTVKYVGEPMTHLESIASSAVRAAIKVKASVIICFTSSGRAARLIAKYRPTMPVLSVVIPRLKTNQLKWSFSGAFEARQSLIVRGLFPMLADPRHPAESTSATNESVLKVALDHGKASGVIKSHDRVVVCQKVGDASVVKIIELED

SEQ ID NO: 83018 - protein, 504 aa, Salinibacter ruber DSM 13855
MSQIDPHLFVIFGATGDLTKRKLIPALYHLMQDEDVARRCVVLGAARSDWTDERFREAARTALREQGYAEETVDAWCTRNLHYQCLGPEGNDYEGLRERVEQLERHRNLTGNRVFYFSLPPSIYTQAIEGLGAVGLNTSSGWSRVVVEKPFGHDLDSAQRLNERVHQHFDEDQVYRIDHYLGKETVQNLMAFRFGNALFESMWNREHIDRVEITVAEPLGVGGRAGYYDQSGHVRDMVQNHLTQLLSLVAMEPPASMDADAIRDEKVKVLNAVQQPDPRADVALGQYRAGTMGGEPVPGYRDEPDVPADSDTETFAAMRLNVANWRWQGVPFFLRTGKRLPRKLTQIAVRFQSAPVSLFQADGGPCVPRDADCEAAPNELLITLQPDEGFDLRFEVKAPGNSDDGSMPLETQQLSFSYQDAFGPVPDAYETLLRDIIVGDPTLFVRADEVEASWQLYTPLLETDLPVHSYEAGTWGPDAVDRLLPTWTSTGRTRSHRAEATSSS

SEQ ID NO: 83019 - protein, 385 aa, Haemophilus somnus 129PT
MSLDLSEIRQQITQIDRSLLKLLSERHRLAFDVVRSKEISQKALRDVEREQQLLKELVQFAENENYQLEPQYITQIFQKIIEDSVLTQQVYLQKKLNEQREKNIHIAFLGKRGSYSHLAARNYATRYQEQLIELSCASFDEVFSSVQNEEASYGILPLENTTSGAINEVYDLLQHTDLSLVGELAYPIKHCVLVNAQDDLDKIDTLYSHPQVIQQCSQFIRTLARVHIEYCESSSHAMQLVASLNKPNIAALGNEDGGNLYGLKVLKSGIANQENNITRFIVLAKNPIAVSPQIHTKTLLLMSTAQKAGALVDALLVFKKYNINMTKLESRPIYGKPWEEMFYLEIEANINNPIAQQAFTELKAFSNYLKILGCYPSEIVKPAEV

SEQ ID NO: 83020 - protein, 195 aa, Coxiella burnetii RSA 493
MSVLVPMVVEQTSRGERAYDIYSRLLKDRVIFLVGQVEDHMANLAIAQMLFLESENPNKDINLYINSPGGAVTSAMAIYDTMQFVKPDVRTLCIGQAASAGALLLAGGAKGKRHCLPHSSVMIHQVLGGYQGQGTDIQIHAKQTQRVSDQLNQILAKHTGKDIERVEKDTNRDYFLTPEEAVEYGLIDSIFKERP

SEQ ID NO: 83021 - protein, 460 aa, Vitis vinifera
MAPSISLFKSRDVAVIGAGAAGLVAARELRREGHKVVVFERERQVGGTWVYTPTVETDPLGSDPSRHIVHSSLYASLRTNLPREVMGFLDYPFVSTGEPHRDPRRFPGHREVSLYLKDFAVGFGLNELIRFETEVVYAGLVEDEKWRVKSRSGNDAAIDVEEIFDAVVVCNGHYTEPRLAEIPGIDAWPGKHMHSHNYRIPEPFRDQVVVLIGGAASAVDISMDIAQVAKAVHIASRSVEAGILKKLSGNAIDNMWLHPMIESVQKDGTVIFYDGSVVLADVILHCTGYKYHFPFLDTSGIVTVDDNRVGPLYKHIFPPHLAPGLSFVGLPWKGIGFILYEFQSKWIAGVLSGRIGLPSEEEMMRDIEALYLLLEASGTPKRYTHGIGHCRMEYMDWFAGECGIPGIEEWRKEIYYATKKNYIVRPHAFRDEWEDEDLALKAHEDFTKCRSNGVDRTCIS

SEQ ID NO: 83022 - protein, 457 aa, Vitis vinifera
MAPSISLFKSRDVAVIGAGAAGLVAARELRREGHKVVVFERERQVGGTWVYTPTVETDPLGADPSRHIVHSSLYASLRTNLPREVMGFLDYPFVSTGEPHRDPRRFPGHREVSLYLKDFVVGFGLNELIRFETEVVYAGLVEDEKWGVKSRSGNDAAIDVEEIFDAVVVCNGHYTEPRLAEIPGIDAWPGKHMHSHNYRTPEPFRDQVVVLIGSAASAVDISMDIAQVAKAVHIASRSVEAGILEKLSGNAVDNMWLHPMIESVQKDGTVIFYDGSVVLADVILHCTGYKYHFPFLDTSGIVTVDDNRVGPLYKHIFPPHLAPGLSFVGLLWKVLPFPMFEFQSKWIAGALSGRIGLPSQEEMMADVSAFYLSREASDTPKHYTHNLADSQFEYDDWLALECGIPGVEEWRKKMYQATAKNKKVRPDKYRDEWEDEDLTLEAQKDFARCRPNGGGDN

SEQ ID NO: 83023 - protein, 483 aa, Pseudomonas aeruginosa UCBPP-PA14
MQLKDAKLFRQQAYVDGAWVDADNGQTIKVNNPATGEIIGSVPKMGAAETRRAIEAADKALPAWRALTAKERANKLRRWFDLMIENQDDLARLMTIEQGKPLAEAKGEIAYAASFLEWFGEEAKRIYGDTIPGHQPDKRIIVIKQPIGVTAAITPWNFPSAMITRKAGPALAAGCTMVLKPASQTPYSALALAELAERAGIPKGVFSVVTGSAGEVGGELTSNPIVRKLTFTGSTEIGRQLMAECAQDIKKVSLELGGNAPFIVFDDADLDAAVEGALISKYRNNGQTCVCANRLYVQDGVYDAFVDKLKAAVAKLNIGNGLEAGVTTGPLIDAKAVTKVEEHIADAVSKGAKVVSGGKPHALGGTFFEPTILVDVPKNALVSKDETFGPLAPVFRFKDEAEVIAMSNDTEFGLASYFYARDLARVFRVAEQLEYGMVGINTGLISNEVAPFGGIKASGLGREGSKYGIEDYLEIKYLCLGGI

SEQ ID NO: 83024 - protein, 426 aa, Pseudomonas aeruginosa UCBPP-PA14
MSKTNESLLKRRQAAVPRGVGQIHPVVAERAENSTVWDVEGREYIDFAGGIAVLNTGHLHPKVIAAVQEQLGKLSHTCFQVLAYEPYIELAEEIAKRVPGDFPKKTLLVTSGSEAVENAVKIARAATGRAGVIAFTGAYHGRTMMTLGLTGKVVPYSAGMGLMPGGIFRALAPCELHGVSEDDSIASIERIFKNDAQPQDIAAIIIEPVQGEGGFYVNSKSFMQRLRALCDQHGILLIADEVQTGAGRTGTFFATEQLGIVPDLTTFAKSVGGGFPISGVAGKAEIMDAIAPGGLGGTYAGSPIACAAALAVLKVFEEEKLLERSQALGERLKAGLREIQAKHKVIGDVRGLGSMVAIELFEGGDTHKPAAELVSKIVVRAREKGLILLSCGTYYNVIRFLMPVTIPDAQLEKGLAILAECFDELA

SEQ ID NO: 83025 - protein, 92 aa, Dechloromonas aromatica RCB
MKDYYGLLGVAPDASNEIIKTAYRKKAAQFHPDRNPEPDAASKFRAVQEAYEVLADVDRRKVYDETRRTSLIDDPLVVAREIWSSHLGNMQK

SEQ ID NO: 83026 - protein, 316 aa, Haemophilus somnus 129PT
MTIYADNSYSIGNTPLVRLKNFGNNGNIIAKIEGRNPSFSVKCRIGANMVWQAEKDGILTKDKEIIDATSGNTGIALAYVAAARGYKITLTMPETMSSERKRLLRGLGVNLVLTEGVNGMKGAIAKAEEIVASNPNHYVMLKQFENPANPAIHQQTTGPEIWSGTEGKIDVLVAGVGTGGTISGISRYIKQDQGKKIITVAVEPEESPVITQTLAGEETKPGPHKIQGIGAGFIPKNLDLSLVDQVEKVSSETAIITARRLMAEEGILGGISSGAALAVADRIAQRPEFSDKLIVVILPSASERYLSTALFDGFEG

SEQ ID NO: 83027 - protein, 557 aa, Vitis vinifera
MGDKQEEDRSESSDYTSEDEGTEDYRRGGYHAVRIGDTFKNGRYIVQTKLGWGHFSTVWLAWDTLNSRYVALKVQKSAQHYTEAAMDEITILQQIAEGDPDDKKCVVKLLDHFKHSGPNGQHVCMVFEYLGDNLLTLIKYTDYHGLPLHMVKEICFHVLEGLDYLHGQLSIIHTDLKPENILLLSMIDPSKDPRKSGATLILPSNKDKNVFESGVGKDIKTSNGDLTKNQKKKIRRKAKQAAKGCVEKDAAVEAEPDPETSGALESSPNVKLDLASVEDQPNSSGNGDRLLDADGKKGPGQGNQGHRRGSHSMRQKLLASVDLKCKLVDFGNACWTYKQFTNDIQTRQYRCPEVILGSKYSTSADLWSFACICFELATGDVLFDPHSGDNFDRDEDHLALMMELLGMMPRKIALGGQYSREFFNRYGDLRHIRRLRFWPMNKVLVEKYEFSEKDANDMADFLVPILDFVPEKRPTAAQCLLHPWISAGPLLLEPSMPSVKIQAGESVICEKKKREKDEREAMEIGMGNIAISADSKPVEDPQSSSKPSSKASTSAPR

SEQ ID NO: 83028 - protein, 182 aa, Vitis vinifera
MSACKDQDPRIHGIKTKIRVVPNFPKPGIMFQDITTLLLDPKAFKDTIDLFVERYKGKNISVVAGIEARGFIFGPPIALAIGAKFVPLRKPRKLPGEVISEEYILEYGRDCLEMHVGAVEPGDRALVVDDLIATGGTLCAAMNLLERVGAEVVECACVIELPDLKGRDRLNGKPLYILVEYH

SEQ ID NO: 83029 - protein, 234 aa, Shigella flexneri 2a str. 301
MNDIAHNLAQVRDKISAAATRCGRSPEEITLLAVSKTKPASAIAEAIDAGQRQFGENYVQEGVDKIRHFQELGVTGLEWHFIGPLQSNKSRLVAEHFDWCHTIDRLRIATRLNEQRPAELPPLNVLIQINISDENSKSGIQLAELDELAAAVAELPRLRLRGLMAIPALESEYVRQFEVARQMAVAFAGLKTRYPHIDTLSLGMSDDMEAAIAAGSTMVRIGTAIFGARDYSKK

SEQ ID NO: 83030 - protein, 327 aa, Arabidopsis thaliana
MVVMMMNFRVYLMRVNLDNNVVESSSSSSSSCIKREAKVISLGDEVDDISQVFHCDGLLLCISITQAKTRLVVWNPYWGHTRSIEPTHQFNKFDSYSYALGYDKSSKSHKILRCITCLRPHFHEFIIYDFNSNSWRVFHVTPDWQLGTINSGVSLKGNAFWVAEEKYYETSETNEEFFLLSFDFTRETFGPLLPLPFQFVESEDALSVSNVRDEQLAVLYQPWDTLMMEIWVTSKIEPNAVSWNSKVFLSVSIRKLIGPQFQFCLGSFFIDEEKKVAVVFDKGYRIQRYIAYIIGVDGSMKEVDLGESDRRCYPIVWSYVPSLVQLN

SEQ ID NO: 83031 - protein, 312 aa, Streptomyces coelicolor A3(2)
MPRRPIDITIPDLRDTRAVVTGASDGMGLGMAIRLASAGAQVVLPVRNPRKGEAALTKIRQHAPDADVSLRSLDLSSLASVAALGKTLLEEGQPIHLLLNNAGVMTPPERQATVDGFELQFGTNHLGHFALAAHLLPLLRAGQARVTSQVSIAANQHAINWDDLNWECSYNGRKAYSQSKIALGLFALELNRRSEAGGWGITSNLSHPGVAPTSLLAARPEVGRDKDTVLVRMIRAMSARGVIVGTVETAQLPALMAATSAAAKPGGFYGPSGPGHLGGPPGEQELYSRLRSADEAQRVWRTSEELTGTHLR

SEQ ID NO: 83032 - protein, 469 aa, Corynebacterium glutamicum
MTEHYDVVVLGAGPGGYVSAIRAAQLGKKVAVIEKQYWGGVCLNVGCIPSKSLIKNAEVAHTFTHEKKTFGINGEVTFNYEDAHKRSRGVSDKIVGGVHYLMKKNKIIEIHGLGNFKDAKTLEVTDGKDAGKTITFDDCIIATGSVVNTLRGVDFSENVVSFEEQILNPVAPKKMVIVGAGAIGMEFAYVLGNYGVDVTVIEFMDRVLPNEDAEVSKVIAKAYKKMGVKLLPGHATTAVRDNGDFVEVDYQKKGSDKTETLTVDRVMVSVGFRPRVEGFGLENTGVKLTERGAIEIDDYMRTNVDGIYAIGDVTAKLQLAHVAEAQGIVAAETIAGAETQTLGDYMMMPRATFCNPQVSSFGYTEEQAKEKWPDREIKVASLPFSANGKAVGLAETDGFAKIVADAEFGELLGAHLVGANASELINELVLAQNWDLTTEEISRSVHIHPTLSEAVKEAAHGISGHMINF

SEQ ID NO: 83033 - protein, 458 aa, Helicobacter hepaticus ATCC 51449
MSLSQIKQKLQNNINLSPSYGHLVKVMQNMLVANGVKPSVGDIVKILSHYEAPSLKECNQSSEESLQFAHNMQTHNLGMVMAIEGEHFFISPFSFIEGHKCGDKVEILNHGLHIPVGENMLGRVINPLGEPIDDKGALHTSHTTLLMRPPISALKRGLINEVFEVGVKSIDGILTCGKGQKMGIFAGSGVGKSTLMGMIVRGSNAPIKVIALIGERGREVPEFIHKNLNNDLTNTILVVATSDDSPLMRKYGAFSAMAIAEYFKSLGNDVLFIMDSITRFAMAQREIGLALGEPPTSKGYPPSVLTLLPQLMERAGKEDGVGSITAFFTVLVEGDDLSDPVADQSRSILDGHIVLNRDLTDMGIYPPINILNSASRVINDIISPEHLQVIRKFRRLYSLLKENEVLIRIGAYQRGADKELDEAITKRSLMESFLKQEMNEQWSFERSFQELLHIMEDV

SEQ ID NO: 83034 - protein, 559 aa, Chlamydomonas reinhardtii
MEITPELITQYGLMSKISTGSTYLDMMFCLLVPLILKHLIPLLATLPSKLWKEKAAAKTFTRIIEHTQRSSYYWWDNDQQPPNSILQRALLNKINKHVQTLSELPEADLTIKKRPAAEDAAAAAEACGNKASDDSEDGSGSTEHDYAFNLAPPVGQWVDLKNGIRFMRETENLDDKAKATKITYMLESKEKDGNERIEAFVADALETFRKQQSAKVDPARYLYMPVLSGFRAPASSGDGEGASAPSAVYKRYKLSEEKTFASFFHPDKDSTLRLVDSFLNKTGKFAIPGYPQKLGFLLYGPPGTGKTSLIKALAQHTKRSIISVPLSKISTNQELMDIIFDNKLTIQNSSDSAVSLPFNKTIFVMEDVDAASSVVQRRNGGGAAASAGPSRAEVMALAESIANAKLAAAASAAAVGGGTAIGPSLPMAAFGKNLFKGDDELNLAGLLNVLDGVVDTPGRIIVMTTNHPEKLDPALIRPGRINKKVYMGRLRVCEALSMVRHYFGPVSAADEAALRAVFEDDALSPADLEAMCAEHDTPAELVEAVERRLREGTEEFKPC

SEQ ID NO: 83035 - protein, 196 aa, Helicobacter hepaticus ATCC 51449
MSSYIPYVIERTGRGERSYDIYSRLLKDRIILLSGEINDHIASSIVAQLLFLEAEDPEKDINFYINSPGGVITSAFSIYDTMNYIHSDISTICIGQAASAGAFLLSSGTKGKRFSLPNSRIMIHQPLGGAQGQATDIEIQAREILRLKKILNEIMAHNTGQKIEKITQDTERDFFMSGEEAKKYGLVDEILTKSLK

SEQ ID NO: 83036 - protein, 532 aa, Burkholderia xenovorans LB400
MSTILSRIDRQSDAFRNNEAHYDALLAELRERHAHVLAGGGERLVERHHARNKMLARERIDLLLDPLSPFLELSPLAAWGMYGNAVPSAGVITGIGLIAGTPCMLIANDATVKGGSFFAETVKKHVRAQDIAGHHRLPVIYLVDCGGAYLPEQDRVFPDKDHFGNTFYRQCQMSAAGIPQIAAVFGGCTAGGAYIPALADEVVMVRGQARIHLGGPQIVKAAINEIVDGETLGGAEMHTRVSGVSDYLAENEAQALQRVRDIIANLNRPRPLSGAVREVVPPRYDIGELRGILPPGLKESYDVREVIARLVDDSGFQEFKPEFGSTLVCGTAYWCGYPVGILANNGVLFSESATKGAHFIELCNQRNIPLLFLQNITGFMVGTEAERGGIARHSAKLVYAMATARVPRLTVIIGGSFGAGNYGMCGRGFDPRFLFAWPNSRIATMSADVAATVLTDLRRSSLKAAADEAEIAEIDRVTREQFTTQSDPYYATARLWDDGLIEPSETREVIGLCLALAAAEAPATGPSPVFRM

SEQ ID NO: 83037 - protein, 363 aa, Actinobacillus pleuropneumoniae serovar 1 str. 4074
MGFKCGIVGLPNVGKSTLFNALTKAGIEAANYPFCTIEPNTGVVPMPDPRLDALAEIVKPERVLPTTMEFVDIAGLVAGASKGEGLGNKFLANIRETDAIGHVVRCFENDDIVHVAGKIDPADDIEIINTELALADLDSCERAIQRLQKRAKGGDKDAKFELSIMEKILPVLENAGMIRSVDLDKDELHAIKGYNFLTLKPTMYIANVNEDGFENNPYLDRVREIAEKEGAVVVPVCAAIESEIAELDDEEKVEFLQDLGIEEPGLNRVIRAGYRLLNLQTYFTAGVKEVRAWTVSVGATAPKAAAVIHTDFEKGFIRAEVIAYDDFIQFKGENGAKDAGKWRLEGKDYIVQDGDVMHFRFNV

SEQ ID NO: 83038 - protein, 205 aa, Brassica napus
MEYVNPEGLRLDGRRFNEMRQIVAEVGVVSRADGSAVFEMGNTKVIAAVYGPREIQNKSQQKNGHALVMCEYSMAHFSTGDRRRQKNDRRSTELSLVIRQTMEACILTEVLPHSQIDIFLQVLQADGGTRSACINAATLALADAGIPMRDLAVSCSAGYLNSTPLLDLNYVEDSAGGADVTVGILPKLDKVTLLQMDAKLPMETF

SEQ ID NO: 83039 - protein, 395 aa, Glycine max
  misc_feature (71)..(71): Xaa can be any naturally occurring amino acid
MEHKVATTTEGQSIRCKAAICRKAGEPLSIEEIIVAPPMPGEARIRIICSSLCQTDISFRNMQMYLLCFEXDHPAIYPRILGHEAIGVVESVGEDVTEVTKGDVVVPIFLPDCGECIDCKSSKSNLCSKFPFEVSPWMPRYATSRFTDLKGEIIHHFLSVSSFSEYTVVDIAHLIKIDPAIPPNRACLISCGISAGIGAAWRAAGVEPGSTVAIFGLGSIGLAVAEGARLCGATKIIGVDVNPERYEIGKRFGLTDFVHSGECENKSVSQVIIEMTGGGADYCFECVGMASLMHEAYASCRKGWGKTIVLGVDKPGSKLNLSCSEVLVSGKSLRGCLFGGLKPKSHVPILLKRYMDKELNLDEFVTHEMEFKDINKAFDLLIEGQCLRCVIWMDK

SEQ ID NO: 83040 - protein, 144 aa, Klebsiella pneumoniae
ESNGKYVDRNGHAVDYQTGPIIWGEPGTNGQHAFYQLIHQGTKMVPCDFIAPAITHNPLSDHHQKLLSNFFAQTEALAFGKSREVVEQEYRDQGKDPATLEHVVPFKVFEGNRPTNSILLREITPFSLGALIALYEHKIFTQGA

SEQ ID NO: 83041 - protein, 459 aa, Oryza sativa
  misc_feature (289)..(289): Xaa can be any naturally occurring amino acid
MAASTSATSFSTPTKPASSSSSSSSPNSVCFARASGRCRMASVVVRAEAVDATISPTVSALRPSKTMAITDQATALRQAGVPVIGLAAGEPDFDTPHVIAEAGMNAIKDGYTRYTPNAGTLELRKAICNKLQEENGISYSPDQVLVSNGAKQCITQAVLAVCSPGDEVLIPAPYWVSYPEMATLAGATPVILPTSISENFLLRPELLASKINEKSRLLILCSPSNPTGSVYPKELLEEIADIVKKYPRLLVLSDEIYEHIIYQPAKHTSFASLPGMWDRTLTVNGFSKXAFAMTGWRLGYLAAPKHFVAACGKIQSQFTSGASSISQKAGLAALNLGYAGGEAVSTMVKAFQERRDYLVKSFKELPGVKISEPQGAFYLFIDFSSYYGSEVEGFGTIKDSESLCMFLLEKAQVALVPGDAFGDDKCIRMSYAAALSTLQTAMEKIKEAVALIKPRVAAK

SEQ ID NO: 83042 - protein, 1705 aa, Shewanella sp. MR-7
MKLKILTCTIAAALYGAGAMQAAASIGDVHKLKGLQLTSDQIAKLNAPETKIDDADLGIGLNLQITPQANKFEFEDGITGEQIYIVRLNQKPLAQVSTELLASTTASKTFGKSSNSKLFVAGQPASSAVKNYRSRLLDSQRQVIADVQSTVGARQVRQQFTNAVNGFSIAMTQEEAQRVSQLANVSSVRRSKTYELLSDAGPELIQANKIWSGEATDSVPYKGEGIIVGIVDTGINSDHRSFADVGDDGYDHTNPWNAGNYVGDCTKSGFETMCNDKLIGVRSYPVITDNFTSGVYGATRPAVGEDYQGHGTHVASTAAGNVLLDVDYVNPDSGTEASDGSVIKPKLFPRMSGVAPHANIVAYQVCHPSNAINAGCPGEALIAGIEDAINDGVDVINFSIGGQDSNPWADDVELAFLSAREAGISVAVAAGNSGQPVGYKEYFGRIDHASPWLMNVAASTHAREVEITTKLIDPMGGSEVPKWSEIVGGAINTAPVTGMVVNAKNFGDEYCAKPFPAGTFDLKDGDGNPTDVIVVCKRNSLEDPNAVARTAKADNIKAGGADGMIMYNYATADALVPTASYSVPSIHITKEEWDGRYDNGLAGYGLSDWLAKGSNHMLTISGTTIERTMDPERADWLAAFSSRGPSPSTPEALIPAVAAPGVDIYAAFADEHPFSSSAASGDFAFLSGTSMASPHVAGSMALLRQAQPSWSATEIQSALAMTAENKVQYYRLDDKNGDVALASTYRAGTGRINVANAVNAGFVMDETVERFKAADPHNGGAVHKLNIPQLVNFECKPKCQWIRTIKATKDGTWSVTNGDVINWSVDSRSQFVQNGVSIKVTPNEFTLAAGETMDIVVEASIMDTQDWFSNAEVELHSNLTFTETSGRASEAHWPVVFKYDKNGMPGRLSAVAHRNEANAVIKGIDLPEGDNIHGRIFSPVKAEVKTVVLPKDNDGNFPWSSNADLTVSMDERIDEATYVEMIDVPANARRLIVESFGTTQSELSEVLDKGNLIVFVGKDYNGNGKADPFEELLCVSNHIQYNNFCNINQPEEGKYWALFYNPRKGSASNNYYNALEETFQYATTVVMDQVASEMSVDVPASNGRDPVDITVNWDMPEMKEGDVYYSLLDFGTSEVNAGNIGKVAFKLERGVDDVHLDATQTAAVAGDQIPFTFEVQPNNTGADRAFSIVATIPSGFSLRAEDVLSSSSTIVKDVKLENGKLTISGIQPDTSELEPRYNITTNVDDAMCRTPDFGNKKPGGYVNLEEFTIYPIFSGFAPVEYGANGKALSGKDNNILYRNGITLPISTVFNGAYDSFHLYNNKDSINVWKQNHLDIRGHGIVSLFQNQPFFYPYHDIFPYNSFPYASIGMLWRGFGLGAGATQDILSVPLINKTTERAGISIASTPSGWGILEYDNARSYKPLGYDANRVYQWEEKDDRFDFELIFNANTRFGDGEYELMMAYDNINFGSQDDRGSIGLQGFQGGLYAYGPLQKYLGEQYAFNNLKDKIHNGLVICYDYVGPESSQFEVTAWTTVKNNAAGQVLTVDAVSQVEGMADISMSHSVTVPSNISIGAIADQTIAENTSLEGLKVVFADEQNSVNKITVTGEHISAVVDGNTSGSSITITPEANFHGDVEVTVTVSDVESPTDAASTSFMLTVESDGVEPPTTPVTPEPKPDTNKDSGGALGGLSMLLALGALIRRRKTH

SEQ ID NO: 83043 - protein, 396 aa, Shewanella sp. MR-7
MDKVGMSSYDIAIIGGGISGVGIAQYAAAAGYSTLLIEKGEIGGQTSANSSKLIHGGLRYLESGQVNLVRKSLQERRHLLDFAPSLVKPVPFYIPVYQDSQRNPWTIRAGLSLYALLSEFDPLGRFVSIPAVHWHRFNGLKLQGLKAVFQYWDAQTDDKLLTQSVARSAEALGAHVYAEAEFLQLNHLNEQIELSFRHRGEVQQIEAKLVINAAGPWVNEVIAKVTPPLAGAKIDWVQGAHLLLDLPAPDGILYLESCFDKRVIFVMPWYGKMLIGTTETELTSLDTPPQVTESEINYLLGIYRHYFPLSPSIDELKTKIVQTFCGVRVLPKQASSAFERTRDTLMQTSISHPRLLSLYGGKLTTFRSTSAEVLEWVEQKLGKRTPIANVDSLRLS

SEQ ID NO: 83044 - protein, 387 aa, Blastopirellula marina DSM 3645
MAVKADYYEVLGVSRTANGDEISKAYRKLAIKFHPDSHPDDENASLKFKQAAEAYEVLSDAEKRGRYDQYGHAGVEGGHRQFSDAEDIFEAFGDIFGGGVFGDLFGGRGRTRSGRRVSKGADIKAQVTLDLEEAARGVEKTITFDRREPCETCKGSGAAAGSQAERCTRCGGHGQVVQQAGILRVQTTCPSCAGAGVKITDPCRSCRGQGFQNRRVELDVNIPAGVDDQMRVRLSGEGQPSPNGGPAGDCYCFISLRRHKLFERDGEHLILKMPISYTQAVLGAQIEVPTLIDGAHMLTVPKGTASGEVFKVRGQGMPDPHGRGKGDLYVQTYIEVPKKLDTRQEELLRELAEFEHTNVSPHRKSFLESIRDYLFSSGDEDEAVKEK

SEQ ID NO: 83045 - protein, 434 aa, Salinibacter ruber DSM 13855
MPFNFDVYERSAYREPAPIDHDSPFQSMMERFDVAAEILELSPGFYEYLCRPARMHVTSIPVEMDSGRVKIFEGYRVIHNNVLGPSKGGIRFAPDVTLNEVKALAGWMTWKCSLVDLPFGGAKGGVACNPEEMSPGELERLTRRYTADLFDVFGPDKDIPAPDMNTNEQIMAWVLDTYSMHARQTENAVVTGKPVGLGGSKGRRQATGRGVMTVTLAAMEQIGLAPGDCTVAVQGFGNVGATAADLLGEQGCTVVAVSDITGGYYNENGLDLKAMKAYTQQNGGTLAGYEEAQHITNEELLTLDVDVLVPAAKEDQINREIAEDLRARIVAEGANGPTHPAADEVLAEKEVLVIPDILANAGGVTASYFEWVQNRQGFFWTEEEVNRRLDRMMGEAFDKVYTAADKYDVSLRIAAYVVGIRRVAEALRMRGIYA

SEQ ID NO: 83046 - protein, 341 aa, Triticum aestivum
MERYEVIKDIGSGNFGVAKLVRDVRTKELFAVKFIERGHKIDENVQREIMNHRSLRHPNIVRFKEVVLTPTHLAIVMEYAAGGELFERICGSGRFSENEARFFFQQLLSGVSYCHSMQICHRDLKLENTLLDGSEAPRLKICDFGYSKSSVLHSQPKSTVGTPAYIAPEVLSRREYDGKVADVWSCGVTLYVMLVGAYPFEDPDEPKNFRKTITRILSVQYAVPDYVRISMECRHLLSRIFVANPEQRITIQEIKNHPWFLKNLPIEMTDEYQMSLHMVGVNAPPQTLEEVMAIIQEARIPGDGSKFAGQLSVPGLGSMELDDIDDVDADVEDSGDFVCAL

SEQ ID NO: 83047 - protein, 631 aa, Oryza sativa Indica Group
MASISGAAAPPSSSAACRLRLRRQLLLRPSHLRLRAPHSIADLSRSSSSSSEQQPSSTPAAPLASRPGQNGSTRGAVEKDPIKLWERYVEWLYQHKELGLFVDVSRIGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQVDIQLLRYRTMTFFSMNAMTEERNILQGTRSALYSNDRESISVTVQEVTPRAVGALVALYERAVGIYASLVNINAYHQPGVEAGKKAAGEVLALQKRVLTVLNEARHIEMIYKIIQHMAANDRALIAEGSCGSPRSIKVYLGECNVDEDMLAA

SEQ ID NO: 83048 - protein, 119 aa, Vitis vinifera
MVERMESSQLTTLNLTNDDLVKDHLRHLMGGRSHVENELLCRFVFPERPGTLMKFLDTFSPRWNISLFHYRGQGEAGANVLVGIQVPETEMTEFKRRADALGYEYAVETSNKAYLLLMH

SEQ ID NO: 83049 - protein, 325 aa, Arabidopsis thaliana
MANTPLIVSFGEMLIDFVPDTSGVSLAESTGFLKAPGGAPANVACAITKLGGKSAFIGKFGDDEFGHMLVNILKKNGVNSEGVCFDTNARTALAFVTLKKDGEREFMFYRNPSADMLLKESELNKDLIKKAKIFHYGSISLISEPCRTAHMAAMKTAKDAGVLLSYDPNVRLPLWPSTEAAIEGIKSIWNEADIIKVSDDEVTFLTRGDAEKDDVVLSLMHDKLKLLIVTDGEKGCRYYTKKFKGRVPGYAVKAVDTTGAGDSFVGAFLVSLGKDGSILDDEGKLKEALAFANACGAVCTTQKGAIPALPTPADAQKLMKSKSKG

SEQ ID NO: 83050 - protein, 317 aa, Mycobacterium sp. JLS
MSPHALVIGEALIDIVERDGEVQGEHVGGSPLNVAVGLSRLGRRVDFLTHIADDARGRRIVEHLEAAGVHLVAGSRNAARTPTARAMLDDKGSARYEFDIDWNLTGTPEAAPPLVAHTGSIATVLEPGCRATAALLDAYHLSATITFDPNIRPALIDDADAARARIDRLVERADVIKASDEDLRWLDPNRTPKQIARAWLQLGPSIVAVTEGGQGAFAVCAAGSARVAALPVEVVDTVGAGDAFMSGLIDALWTHGLLGAEKRRELRAIRLDALHDVLQTAALSSALTVTRAGADLPDRATRDAAAREPATLIDRRR

SEQ ID NO: 83051 - protein, 357 aa, Gibberella zeae
MAEFVRAQIFGTTFEITSRYSDLQPVGMGAFGLVCSARDQLTNQNVAVKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLRNKFKNADDSAIDLLERMLVFDPKKRITATEALAHDYLSPYHDPTDEPVAEEKFDWSFNDADLPVDTWKIMMYSEILDYHNVEAGVTNMEEQFNGQ

SEQ ID NO: 83052 - protein, 311 aa, Streptomyces coelicolor A3(2)
MTTVNHWTPGDIPDQAGRTALITGGNSGIGLETARALARHGARVILAGRSRTRLDQAAEAVRAATPEARTDTLVLDLSDLSSVRDAATRIAETETVDLLFNNGGVMNLPERRTTHDGLEMTVGTNHLGHFAFNAQVWPAVRRSPAPRVVTVSAIAARWPMGRLEDLMSEKSYRAMGAYAKSKRANIVYTLELARRTASSPVEALVVHPGAAMTNLQQHGTGPLSRMVTPIAARLLMGSAEGAAWPSLYAATSPHVQSGWFIGPAGRDQTSGTPRPAKLPTGADDPAEGRRLWAASEQLTGVPFDIEAEAAV

SEQ ID NO: 83053 - protein, 355 aa, Phaeosphaeria nodorum
MAEFVRAQIFGTTFEITSRYTDLQPVGMGAFGLVCSAKDQLTSQAVAIKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDVWSAGCIFAEMLEGKPLFPGKDHVNQFSIITELLGTPPDDVIHTICSENTLRFVQSLPKRERQPLANKFKNAEPAAVDLLENMLVFDPKKRVRAEQALAHPYLAPYHDPTDEPVAEEKFDWSFNDADLPVDTWKIMMYSEILDYHNVDAAAQEGENGGS

SEQ ID NO: 83054 - protein, 251 aa, Microcystis aeruginosa PCC 7806
MSKCAEFNPMYRRELLQFIGSHALFGAINPEFTWNYQNIDHWGELSRNYRLCTTGKQQTPINLSIVTEKELYQPTFNYRPIPLKIRHNGHTILVQTEKVGSMSFHGENWDLLQFHFHHPSEHQIKGQSFPLEIHLVHRNGKGNLAVVGILAEIGAFNPYLQTIWDYLPQEPSPEMIIPDTWVNVGLLLPENSGFYEYRGSLSTPPCSEDVLWLVWQNAIEISPQQLQQLAAILPRNARNIQPLNGRSILHS

SEQ ID NO: 83055 - protein, 386 aa, Streptomyces coelicolor A3(2)
MTETRRGATATCRPTGAPERHGPIGTQREKEPGEPSDGQGEAVVEGHEAALLLSESRASVDPELRSAIATLPESMRRVALYHFGWQHADGTPAAGNAGKAIRPALVLTAAAALGGPGARAAAVRAAAAVELVHNFTLLHDDVMDRDATRRHRPTAWTVFGDADAILAGDALQALALRLFAADPHPASAAAATRLADCVMELCEGQHADTAMERPPPDEVTLDETLVMAEAKTGALLGCACAVGALYAGAATEDVEALDAFGREPGMAFQLIDDVIGIWGDPAPHRQAGRCDLAARKKSLPVVAALTSGTPAAAELAELYTGPYDENKEDLERTALAVERAGGRDWAQAQAADRMARAMQELARAVPEPEAAGGLLALAEFVTRRST

SEQ ID NO: 83056 - protein, 348 aa, Shigella flexneri 2a str. 301
MEFFKKTALAALVMGFSGAALALPNITILATGGTIAGGGDSATKSNYTAGKVGVENLVNAVPQLKDIANVKGEQVVNIGSQDMNDNVWLTLAKKINADCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKNGTAVVRSSRVPTGATTQDAEVDDAKYGFVASGTLNPQKARVLLQLALTQTKDPQQIQQIFNQY

SEQ ID NO: 83057 - protein, 598 aa, Pseudomonas syringae pv. syringae B728a
MVSFRPSRCNSVFYGVPPLDATTINSLFLIGALLVAASILVSSLSSRLGIPILVIILAVGMVAGVDGGGIIFDNYATAYLVGNLALAVILLDGGLRTRVASFRVALWPALSLATVGVLITTVLTGMMAAWLFNLSVIQGLLIGAIVGSTDAAAVFSLLGGKGLNERVTASLEIESGSNDPMAVFLTVTLIGMLASGQTGLHWGLLGHLIQEFGIGSFIGLGGGWILLQLVNRINLAAGLYPILVIAGGLAIFALTNAIHGSGFLAVYLCGLVLGNRPIRSRHGILHMLDGMAWLAQIGMFLVLGLLVTPHDLLPIAIPALGLALWMILVARPLSVMVGLLPFKAFHDREKAFIAWVGLRGAVPIILAVFPLMAGLPNAQLYFNLAFFIVLVSLLLQGTSLPWMAKLLKVTVPPDPAPISRAALEVHVTSEWELFVYRLGAEKWCIGAALRELKMPEGTRIAALFRGQQLLHPSGSTTLEVGDLLCVIGHEHDLPALGKLFSQAPQRGLDLRFFGDFVLEGDARLGEVAALYGLKLDGIDPGMPLSQFIVQKNRGEPVVGDQVEWNGTIWTVAVMDGNKIQKVGVKFPEGTRPGPGLFL

SEQ ID NO: 83058 - protein, 426 aa, Brassica napus
  misc_feature (305)..(305): Xaa can be any naturally occurring amino acid
MSKTTNQNRRPSFTSSTESSMRKRHGPSSSSSAVKPISNTAVMVAKKRAPLGNITNQRKDSRIFPNSSSADSAHCPNKSAKLKLAAPTQPVCVNACETKSTCEEEVVPIERKAFSNLCITPSSDTTTNVMSETENKEEKFMNIDNKDDADPQLYATFACDIYNHLRAAEAKKQPAVDYMETVQKDVNSTMRGILVDWLVEVSEEYRLVPETLYLTVNYIDRYLSGNVISRQKLQLLGVACMMIAAKYEEVCAPQVEEFCYITDNTYLKDEVLDMESAVLNYLKFEMSAPTVKCFLRRLFSGCPRXVHEAPCMQLECMASYIAELSLLEYTMLSHPPSLVAASAIFLAKYTLDPTRRPWNSTLRHYTQYEAMELRGCVMDLQRLCSNAHVSTLPAVRDKYSQHKYKFVAKKFCPSIIPPDFFKNSLY

SEQ ID NO: 83059 - protein, 534 aa, Synechococcus sp. PCC 7002
MLGEMWSFNGRYKILHMTWFAFFLSFVVWFNFPPFATTIAQDFGLDKAQLGTIGLCNVALTVPARIIIGMLLDKYGPRLTYSLLLIYAAVPCLIFATAQSFNQLVLGRLLMGIVGAGFVIGIRMVAEWFPPKDVGTAEGIYGGWGNFGSAFSAFTMVIFGIILAFLPGAFNFGQPESFKILFFPEFNTAILNWRAAIAGTGIIAALYGMLYYFSVSDTPPGKTYHRPKSARGMEVTTKKDFWFLLAMNLPLTLILMVLAWRLQKVNFLNGTGFAIAILALVGLYLFQTYNCWTVNKDLMTGKKRYAPEDRYEFSQVAILELTYIVNFGSELAVVTMLPAFFEGTFSLDKATAGIIASSYAFMNLMSRPGGGLISDKMGSRKWTMVVLTVGMGVGYLLMSSVAGTWPLAIAVLLTMACSFFVQAAEGSTFAIVPLVKRRITGQIAGNVGAYGNVGAVAYLTVLLLLTEASAGANGGEPVMATVNAGFFQVLGITGLIVAFLCAFFLKEPKGSFAEFHEGETEMTATPPIEEEATY

SEQ ID NO: 83060 - protein, 250 aa, Helicobacter hepaticus ATCC 51449
MLPILTKPLIQYGVEEALESGCCNIGIVTGRGKRAIEDYFDVSYELEHQISGTDKEELLNEIRNLTDTCTFSYTRQIAMKGLGDAILKGKNLIGKEAFAVILADDLCINPQGKGVLAQMVELYKKYQCCIVAIEEVKRSDVDKYGIIEGEEIESGVYEVSNMIEKPSIDKAPSNFAIIGRYILTPDIFDILAVTKPGKKGEVQITDALLEQSKKGRVLAYKFQGKRYDCGSIDGYVKATIDFYQALNANV

SEQ ID NO: 83061 - protein, 255 aa, Streptomyces avermitilis MA-4680
MIEILNSARLERARDTGALVGNILHTLKQRSAVGTNLLDIDQWAKEMITEAGAQSCYVDYAPSFGRGPFGHYICTAVNDGVLHGRPHNYTLADGDLLTLDLAVARGGVAADAAISFLVGKARPAESVAMIEATERALAAGIAAAKPGARIGDLSHAIGTVLSKAGYPINTEFGGHGIGSTMHQDPHVANTGRPGRGYKLRPGLLLALEPWVMADTATLVTDADGWTLRSATGCRTAHSEHTIAITDSGAEILTRP

SEQ ID NO: 83062 - protein, 408 aa, Caulobacter crescentus CB15
MAFDAPYDVAAIRAQFPILAREVHGKPLIYLDSAASAQKPDAVLDAMMGLARTSYANVHRGLHTLANETTEAYEKARETVARFINAERDEVVWTKSATEAVNLVASSFGLSLNAGDEIVLSEMEHHANIVPWHFLRERKGVVLKFIPVLDDGRLDMEAYKGLLSDKTKMVAVTHMSNVLGTVNDVAEIVRLAHAAGAPVLLDGCQGVVHTKVDVKALDVDFYVFSGHKLYGPTGIGVLYGKAERLAALPPYQGGGEMIASVALDKITYADPPHRFEAGTPAILEAVGLGAAIEWLNGLDRDAIFAHEHALYERVAERLRGVNGVRILGDAPGKGAVLSFTVEGAHAHDIAQVLDRYGIAVRAGTHCAEPLMRRFGVTSSARASFALYNTEAEADAFVDALAKARSFFS

SEQ ID NO: 83063 - protein, 372 aa, Opitutaceae bacterium TAV2
MSHQTHYTGATLLTRLLERQGIAHLPGIPGGAILPFYDALHDSPAIRHILARHEQGAGFIAQGMARVTGRAAACVATSGPGATNLLTAIADAHLDSIPLVALTGQVPQTLIGTDAFQEVDTYGLTVPITKHNFLVRTPAELLEIVPLAFEIAESGRPGPVLIDLPKDVQTASLPFALSDADLPTPGMRAPSPPCPDADLVALARLLANARRPVIYLGGGIIAANASHHALALAQHLAAPIVSTLNALGAIPDHDPHFMGMLGMHGTRATHTLLDEADVLLAIGARFDDRATGKAAEFCPHATIAHIDIDRAEIGKIKNTFLGLTGERRRHPPPPARAPRRAPPHSRRPPRPRHLVRPRPHPARRASPAPSPP

SEQ ID NO: 83064 - protein, 496 aa, Enterococcus faecalis V583
MSKKEINQVVASSYQLYINGEWTTGSGNKMIASYNPSNGEKLAEFVDATNADVDRAVEAAQEAFQTWKDVDVVTRSNLLLKIADLIEENQEHLAMVETLDNGKPLRETQSIDVPASADHFRYFASVIRGEEGSVKEFDKDTLSIVVKEPIGVVGQIIPWNFPLLMGAWKLAPALAAGNTVVIHPSSSTSLSLLELFKIFDQVLPKGVVNLITGRGSDSGNYMLAHPGFDKLAFTGSTEVGYTVAKAAADRLIPATLELGGKSANIIFEDANWERALEGVQLGILFNQGQVCCAGSRVFVQSGIYDQFVEALKEKFEQVNVGFPWEKDVEMGAQINEHQLEEILKYVEIGVKEGATLITGGQRLTENGLDKGAFLAPTLLANGTNAMCVAQEEIFGPVATVIKFETEEEVIRLANDSEYGLGGAVFSQDINVALRVARGVRTGRMWVNTYNQLPAGAPFGGYKKSGIGRETHKSMLDAYTQMKNIYIVTKEEADGLY

SEQ ID NO: 83065 - protein, 384 aa, Synechococcus elongatus PCC 7942
MTVTLPSVSEKHRVRLQPLELPERLLLGPGPSNAHPAVLEAISRPPIGHLDPKFLELMTEVQGLLRYIWQTDNRLTIPVSGTGSAAMEATIANSVEPGDVVLVGVMGYFGNRLVDMAGRYGADVRTIHKPWGDVFSLAELRQALEEHRPQILALVHAETSTGAEQPLAGVGDLCREFDCLLLIDTVTSLGAVPTLLDEWGVDLAYSCSQKGLSCPPGVSPFTMGPRAEEKLARRKGKVANWYLDMSLLNQYWGSDRVYHHTAPVNMNFGIREALRLIADEGIETVWKRHRDNAEYLWAGLEDLGLTCHVPVENRLPTLTTVRIPEGVDGKAVSRQLLDEHGIEMGGGLGELAGKVWRIGLMGYNSRRENVDRLLSILADVLPRS

SEQ ID NO: 83066 - protein, 277 aa, Oryza sativa
MVSSHAAIVFFLVAASSLLSSVAADYGYPADYGYAAGSKLGPENWGKLSPAYKLCGDGKKQSPIDIVTKQAISNPNLDSLNRTYTASDGTLVNNGKDILASHPDKVGTVTVNGKVYSFRRVHWHAPSEHTINGEKHPLELQMVHAAADGSLAVIAILYKYGAPDSFYFQLKRKLAELAADGCSFGEENAQVALGLVHLRSLQKRTGSYFRYAGSLTAPPCTEDVFWSVLGKIRQISQEQVALITALLPAGGARPTQPLNGRTVQFYNPPNSTISFKV

SEQ ID NO: 83067 - protein, 311 aa, Shigella flexneri 2a str. 2457T
MALPILLDCDPGHDDAIAIVLALASPELDVKAITSSAGNQTPEKTLRNVLRMLTLLNRTDIPVAGGAVKPLMRELIIADNVHGESGLDGPALPEPTFAPQNCTAVELMAKTLRESAEPVTIVSTGPQTNVALLLNSHPELHSKIARIVIMGGAMGLGNWTPAAEFNIYVDPEAAEIVFQSGIPVVMAGLDVTHKAQIHVEDTERFRAIGNPVSTIVAELLDFFLEYHKDEKWGFVGAPLHDPCTIAWLLKPELFTTVERWVGVETQGKYTQGMTVVDYYYLTGNKPNATVIVDVDRQGFVDLLADRLKFYA

SEQ ID NO: 83068 - protein, 427 aa, Hordeum vulgare
MANKHLSLSLFLVLLGLSASLASGQVLFQGFNWESWKHNGGWYNFLMGKVDDIAAAGITHVWLPPASQSVAEQGYMPGRLYDLDASKYGNKAQLKSLIGALHGKGVKAIADIVINHRTAEHKDGRGIYCIFEGGTPDARLDWGPHMICRDDRPYADGTGNPDTGADFGAAPDIDHLNLRVQKELVEWLNWLKADIGFDGWRFDFAKGYSADVAKIYIDRSEPSFAVAEIWTSLAYGGDGKPNLNQDQHRQELVNWVDKVGGKGPATTFDFTTKGILNVAVEGELWRLRGTDGKAPGMIGWWPAKAVTFVDNHDTGSTQHMWPFPSDRVMQGYAYILTHPGTPCIFYDHFFDWGLKEEIDRLVSVRTRHGIHNESKLQIIEADADLYLAEIDGKVIVKLGPRYDVGNLIPGGFKVAAHGNDYAVWEKI

SEQ ID NO: 83069 - protein, 408 aa, Mycobacterium sp. JLS
MLPDTDRRTRSTWLLLGPAFVAAIAYVDPGNVAANVSAGAQFGFLLVWVIVLANVMAGLVQYLSAKLGLVTGRSLPESVAGRTRTPTRIAYWLQAELVAMATDLAEVVGGAIALYLLFDLPLLIGGVITGAVSLALLAVQNRRGQRHFERVISGLLLIIAIGFLTSVFVEPPPVADVAGGLIPLFEGTDSVLLATAMLGATVMPHAVYLHSGLARDRHGHAEPGARRRLLLKATRIDVGLAMLIAGAVNMSMLLVAATNLQGMSDTDTLEGAHAAVQQTLGPAVALCFAIGLLASGLASTSVGAYAGAMIMGGLLRRTYPLLVRRLVTLVPALAILAIGVDPTRALVLSQVVLSFGIPFALIPLIRLTSDRAVMGDDVNHRITTTLGWVVAGLISLLNVVLIYLTVTG

SEQ ID NO: 83070 - protein, 141 aa, Haemophilus somnus 129PT
MTLEQTLAIIKPDAVERNLIGNIISRLEDKGFQIIAMKMLHLNQEQAEGFYTEHSDKAFFAELIRYMTSAPIVVLVLQKENAVKDYRTFMGTTNPEIAENGTLRYEFAINQTQNSVHGSDSLENAQREIAYFFAEAEIYAR

SEQ ID NO: 83071 - protein, 245 aa, Parvularcula bermudensis HTCC2503
MRGKGEEEGVVLRRSAPYSMDMPTPLISPSILSADFAQLGQEVRAITEAGADMIHVDVMDGHFVPNITIGPSVVKALRPHSSLPFDVHLMIAPVDPYLEAFAKAGASILSIHPEAGPHLHRSLQTIRQLGVKPGLALNPATPLETVTPVLDEIDLILVMSVNPGFGGQKFIDGQLARIERLRRMVDATGRDITIEVDGGITPETARRVLDAGATALVAGTAVFKDGPDSYRANIAALKAAGDVLA

SEQ ID NO: 83072 - protein, 431 aa, Microcystis aeruginosa PCC 7806
MSKSLFTDASSRLEQALKYVSISDDAIERLKYPKASLSISIPVRMDNGTLRIFQGYRVRYDDTRGPGKGGVRYHPNVSIDEVQSLAFWMTFKCALLDLPFGGAKGGITLNPKELSKAELERLSRGYIEGIADFIGPDVDILAPDVYTNEMIMGWMMDQYSIIQRKISPAVVTGKPLTMGGSRGRDTATGTGAFHVIHSLLPKLDKKPANTTVAVQGFGNAGAVVADLLAKAGYQVVAVSDSQGGIYREKGLDIASIREYKQEHRGITAIYCEGTVCNIVEHEAISNEELLALDVDILIPAALENQITAENADRVRAKYIFEVANGPTTSEADRILDSKGILVFPDILVNAGGVTVSYFEWVQNRSGLYWRLNEINERLKERMVTEAEKVWSFAQEFDISLRTAAYAHAIDRLGEALDAKGTRDYYQNKTRA

SEQ ID NO: 83073 - protein, 358 aa, Haemophilus somnus 129PT
MKSYTIAVLSGDGIGPEIMAEAIKVLDAVQKKYNFKLNYRTFDVGGIAIDNHGTPLPASTLNGCEESDAILFGSVGGPKWEHLPPNQQPERGALLPLRKHFKLFCNLRPATLYQGLEKFCPLRADIATKGFDMMTVRELTGGIYFGQPKGRDGEGMQTRAFDTEVYYKYEIERIAKVAFETAMKRRKHVTSVDKANVLISSVLWRETVNEVAKNYPDVTLDHIYIDNATMQLIKQPEFFDVLLCSNIFGDIISDEAAMITGSMGMLPSASLNEHGFGLYEPAGGSAPDIAGKGIANPIAQILSAAMMLRYSFNLNEAADSIENAVKQVLSQGYRTADLADEHPPISTAEMGDLIVNAI

SEQ ID NO: 83074 - protein, 473 aa, Parvularcula bermudensis HTCC2503
MTEEMTRELTFRQNVNMMFDRATTYLDIDEGLKHKIKICNSVYTVRFGVKLRGSIHTFTGYRAVHSEHMEPVKGGIRYALSVNQDEVEALAALMTYKCALVRVPFGGSKGGLCIDPTQWDADELERITRRFTYELAKRDLIHPSQNVPAPDMGTGEREMAWMADAYKRMHPTDIDAMACVTGKPPHAGGIRGRVEATGRGCQYALQSFFSFPEDVAACGLDGGIEGKRVIVQGLGNVGYHAAKFLSEEDGAKIVGVIERDGAILHDDGIDIEEIKHFLTRNGGIKGYPHGKYIEDGLSALTADCDILVPAAIEGVINGANAADIKARIILEAANGPVTANADTILREKRVEVIPDLYTNAGGVTVSYFEWVKNLSHMRFGRMQRRAEEKRAMALITELERATGQPLNDQFKARFAQGDQEIDLVRSGLDDTMRTAYARMRQTRVTTKGIEDMRTAAYATALTDIAKSYESLGL

SEQ ID NO: 83075 - protein, 190 aa, Zea mays
MRGPNAATATSKGGAMAGFKQDLLRNLLLGIRACRPFDATSVEDRKRAVKRSADVAMAAARAAAGGGRARWPKAILAAAAASGHSPGGIRKARKSACKRVVRRPRRATASCDVVARRLVRSRTMALRKVIPGADATAAMDDEAVLLRETIDYAVHLRAQVDVLRRVSAAVQRSTFLRDGPAQSMGGGGGS

SEQ ID NO: 83076 - protein, 731 aa, Oceanicola granulosus HTCC2516
MTDFRIERDGDVAVIVWDAEGRSMNVMTRDAFAALDRLVDEALADDGVRGIVITSAKKDFAGGMDLGVLASVRDQAGEAPAQALFDFTMSGHAVLRKIERAGMDPKTNKGGKPVACALPGTAAGIGTEIALACHRRFMAEGKGKVGLPEIKVGLFPGAGGTTRYSRMVGAMAAAPVLLEGRMLDAKAAKAAQLVDEVVPADALLERAKAWVREAGDGDIVKPWDQKGWKMPGGAPYHPAGFMTFVGASAMVNHQTQGVYPAAKALLSAIYEGAQVPFDTALRVEARWFTKVLMDPTSSAMIRALFLDKQALEKGANRPKAPDQSVQRLGVLGAGMMGAGIALVAAQAGIEVVLLDQSREAAEKGKAYSQSYAEKGAKRGKTTPEAAEAMLARITPTDRVEDLAGCDLIVEAVFEDPKVKAEITARVEAVIGEDCIFATNTSTLPITGLAKASARPEQFIGIHFFSPVEKMMLVEIIKGRETGDRAVAKALDFVRQIRKTPIVVNDARFFYANRCIIPYLNEGARMVTEGVPPALVENAAKLLGFPLGPLQLIDETSIDLAVKISAATRAAMGDAYPADMAPVDDLMAWLAGEGRLGRKARAGFYAYDDAGKRTGLWPGLAERHPPAAEAELLDVQHRLLFAQVLEAVKALEEGVLTDIREGDVGAILGWGFAPWSGGPFSWLDMVGAPWAAERCDQLAAAYGERFACPALLREMAESGARFYDRFGAADAA

SEQ ID NO: 83077 - protein, 255 aa, Arabidopsis thaliana
VGFSQKLQTRLKSQLKNLTDDKHGIGSSWRQDKGNSSISMQIDLEKQLDCWRENPSWTDQIPVVKVGIPKGSLCNLKAEVNVGLPPDAVYNIVIDPDNRRVFKNIKEVMSRKVLVDDGLRQVVEVEQAALWRFLWWSGTISVHVLVDQDRADHSMKFKQVKSGFMKRFEGSWQVKPLFVDEHMCDRLKPKTLEEYNRCTGGKGRIGSKVTLDQLIQPAIVPPPPISWYLRGITAKTTEMLIHDLLAETARSVQLE

SEQ ID NO: 83078 - protein, 216 aa, Zea mays
  misc_feature (167)..(167): Xaa can be any naturally occurring amino acid
  misc_feature (183)..(183): Xaa can be any naturally occurring amino acid
MSSSRMLPIVEPEILVDGPHDIDRCAYVTETVLAACYKALNEHHVLLEGTLLKPNMVTPGSDSKKVTPEVIAQYAVRTLQRTVPAAVPAVVFLSGGQSEEEATLNLNAMNKLSTKKPWALSFSFGRALQASTLKAWAGKVENVEKARAAFLARCKANSEATLGTYKXDAAADTESLHVKDYKXLSCFSLRSPVFWNSCLRVGWLSGLLVRAFIIRT

SEQ ID NO: 83079 - protein, 489 aa, Acidobacteria bacterium Ellin345
MCHGSLPCNERMDYTQASASQTLTAANPASNKPEKPTLVRGMSFLDAVLLLVGGIIGSGLFLTSSDVAKTTYTPLIFMSAWIVGGIVSLLACLSVAELGSMFPEAGGQYVYLREAYGDFPAFLYGWMIFSVNVTGSNATIAAGFAAYAGAIIAPLNATRPIFSIGAWTFNMGHATAISAIVFLTWINVVGLRPAVILQNIATWAKFIAIAGFLVLGFLIGHGSWHNATQPIPGHVGFLSLASGFGVALIAVFWVYDGWVYATWVAGEIKDPQRNVPRSLIYGIAIVAAVILAVNVLYLYAMPMQQMAMQDTVGQAAAQILFFPAIGRWFSALVAIACFGAAACSILSGARVYYAMAADGLFFQKLAEVHPRWRTPAFSLIVQCIWSCALVLTGRYDQLFTFVMFISVIAYAAAASSIFVLRRKRPDMPRPYKCPGYPWVPLAYCVICGAWALNALWSKPFESLAGVGIMLIGAPAYIYWHRAKRKPAVL

SEQ ID NO: 83080 - protein, 480 aa, Bambusa oldhamii
MVKICCIGAGYVGGPTMAVIALKCPAIEVCVVDISVARITAWNSDQLPIYEPGLDDVVKQCRGRNLFFSNDIEKHVAEADITFVSVNTPTKTRGLGAGKVADLTYWESAARMIADVSKSDKIVVEKSTVPVKTAEAIEKILTHNSKGINFQILSNPEFLAEGTAIQDLFNPDRVLIGGRETPEGRKAVQALKDVYAHWVPEDRILTTNLWSAELSKLAANAFLAQRISSVNAISALCEATGANVAEVAYAVGKDSRIGPRFLSASVGFGGSCFQKDILNLVYICECNGLPEVANYWKQVIKINDYQKSRFVNRVVSSMFNTVSGKKIAVLGFAFKKDTGDTRETAAIDVCKGLLGDKAKISIYDPQVTEDQIQRDLAMNKFDWDHPIHLQPMSPTAVKEVSVTWDAYEATKGAHGVCILTEWDEFKTLDYKKIYDNMQKPAFLFDGRNVIDPEKLREIGFIVYSIGKPLDPWLKDMPAMA

SEQ ID NO: 83081 - protein, 491 aa, Erwinia chrysanthemi str. 3937
MAVTSTAQACDLVIFGAKGDLARRKLLPSLYQLEKAGHIHPETRIIGVGRAEWDRDAYIKVVREALETFLKEPLDPALWTTLSNRLDFCNLDVEDTEGFKRLGTMLDQQNRTTINYFAMPPSTFGAICRGLGQAGLNKEPARVVMEKPLGTNLASSRVINNQVAEFFNECQVYRIDHYLGKETVLNLLALRFANSLFANNWDNRTIDHVQITVAEEVGIEGRWGYFDQAGQMRDMIQNHLLQILTMIAMSPPADLSTDRIRDEKVKVLRSLRRIDRSNVHEVTVRGQYTSGFVQGKKVPGYLEEEGANKTSNTETFVAIRVDIDDWRWSGVPFYLRTGKRLPSKCSEVVVYFKNPALNLFHDSYQQLPQNKLIIRLQPDEGVEIQILNKIPGLDHKHRLQTTKLDLSFSETFNQQHLADAYERLLLETMRGIQALFVRRDEVEEAWKWVDSIMDAWAMDNDSPKPYQAGTWGPVASVAMITRDGRSWNEVE

SEQ ID NO: 83082 - protein, 136 aa, Glycine max
  misc_feature (31)..(31): Xaa can be any naturally occurring amino acid
MEMATSFLYPPPPSVLLNTMTVVGLAALPVXGLSEVRGNNLKYSKFNNNNASSSSQKQRFGSISSRTGMLCLYTPAFLAASASFVLSPSQNLRFLLLKSALSIHFFKRIFEVLFIHKYSGEMASDAAFIYQAAISH

SEQ ID NO: 83083 - protein, 289 aa, Coccidioides immitis RS
MASALAGPRFPPLPKTLLIISLKMYFTPSRTIDYIQGLLEPRNDIIRQENRSRLLLALIPDFLTIYPCSEAIKEFESNLAAPQDADTPPPLLLGAQDCFWDSLGPYTGEISPVCLRDMNVSIVELGHAERRAIFGETDQQVARKAAAAADQGLIPLVCIGEVSTLGPIVSEAIGRAVGECEAQIRPVLEALPRDAPVIFAYEPVWAIGKPQPARVDHVGAVVSGIRSVIERIDRHRKGEVRILYGGSAGPGLWGPGGLGKEVDGMFLGRFAHDIEGVRKVVREVEESLR

SEQ ID NO: 83084 - protein, 511 aa, Solanum tuberosum
MAASWCIEKRGSIRNDSFRDNDNIPETGCLSIIVLGASGDLAKKKTFPALFNLYRQGFLQSNEVHIFGYARTKISDDDLRSRIRGYLSQGKENEGEVSEFLQLIKYVSGSYDSAEGFTSLDKAISEHEFSKNSTEGSSRRLFYFALPPSVYPSVCRMIKSYCMNKSDLGGWTRTVVEKPFGKDLASSEQLSSQIGELFDEPQIYRIDHYLGKELVQNLLVLRFANRFFLPLWNRDNIDNIQIVFREDFGTEGRGGYFDEYGIIRDIIQNHLLQVLCLVAMEKPVSQKPEHIRDEKVKVLQSMLPIEDEEVVLGQYEGYKDDPTVPNNSNTPTFATMVLRIHNERWEGVPFIMKAGKALNSRKAEIRVQFKDVPGDIFRCQKQGRNEFVIRLQPSEAMYMKLTVKKPGLEMSTVQSELDLSYGQRYQGVVIPEAYERLILDTIRGDQQHFVRRDELKAAWEIFTPLLHRIDNGEVKPIPYKPGSRGPAEADELLQNAGYVQTHGYIWIPPTL

SEQ ID NO: 83085 - protein, 251 aa, Campylobacter lari RM2100
MIEIKKPAEIEKLRKANELVARTLDYLEGIIVPGMSLKEIDIKAEEFILDHGAKPSFKGLYGFPGSICISLNQACIHGVGDERVLKEGDILGLDVGTCIDGYYGDAARTIPIGKISATDEALIACAKDALYYAIDIIKEGMRFKELSYELGEFITKRGFVPLKGYCGHGIGKKPHGEPEIPNYLENGASAKSGPKIKNGMVFCIEPMVCQKDGTPVHLKGNWEAGSKDGLNAAHYEHCVAIINGKADILSK

SEQ ID NO: 83086 - protein, 476 aa, uncultured archaeon
MREVGREKRMRVVMKFGGTAVANGEKIKTAANLVMRSKEAAENMEIVVVTSAIYAVTDTIYEQANRIAEEGKVEKVKEFVEELQEKHNKIAYWAIDNVQVLEKVKGEIKERMAEMEKALVGICLLGELTLRSLDYIGSFGERLAAPILAGAIQSAGIDAVHFTGGDVGIITNAEYGSAKLMEGVEQEVRARIMPLLGDKIPVVCGFTGETKDEKITTLGRGGSDYTATIIGAAIDADEIWLWKDTEGIMSADPKRIKNARKIPYISYIEAMELSYFGAAVLHPRAIEPVMEKKIPIRVKNLLNPDDEGTLIGEEQEKTKKAAKAITLIENTSIVNIAGTGIGSISDVASRIFSVLAAKNVDIIMISHGSSERTLSLVIDSAQLERAIDAIQSIHAVDTVIRDISYNSNVCTVGVVGVGMAGTVGVAGKVFSALGNEGISVKMISQGSSEFNISFVVQKEEAYKAAQAIHDVFEMGS

SEQ ID NO: 83087 - protein, 2140 aa, Arabidopsis thaliana
MDYPKEFVAVGKAIMLEKGNYGHWKVKMRALIRGLGKEAWIATSVGWKAPVVKGENGEDVLKTEDQWTDAEEAKATANSRALSLIFNSVNQNQFKRIQNCESAKEAWDKLAKAYEGTSSVKRSRIDMLASQFENLTMDESENIEEFSGKISAIASEAHNLGKKYKDKKLVKKLLRCLPSRFESKRTAMGTSLDTDTIDFEEVVGMLQAYELEITSGKGGYSKGVALAVSSEKNEIQELKDSMSMMAKNFSRAMKRVEKRGFARNQGSDRDRDRDRDRNSKRSEIQCHECQGYGHIKAECPSLKRKDLKCSECRGIGHTKFDCIGSKSKPDRSYIAESDSDSDDEDSEEDVKGFVSFVGIIEDDNVSSDSSDSEVGCEKEEISADDESDVEMDVDGEFRKLYENWLVLSKEKVIWLEEKVKVQEQIEQLKGELAVANQIKSEMILKYSAKEEKNRELSQDLSDTRKKIHMLNKGTKDLDSILAAGRVGKSNFGLGYHGGGSSTKTNFVRSKAAAPTQSQSVFRSKSNSVPARRKYQNQNHYHSQRTVTGYECYYCGRHGHIQRYCYRYAARLSKLKRQGKLYPHQGRNSKMYVRREDLYCHVAYTSIAEGVKKPWYFDSGASRHMTGSQANLNNYSSVKESNVMFGGGAKGRIKGKGDLTETEKPHLTNVYFVEGLTANLISVSQLCDEGLTVSFNKVKCWATNERNQNTLTGVRTGNNCYMWEEPKICLRAEKEDPVLWHQRLGHMNARSMSKLVNKEMVRGVPELKHIEKIVCGACNQGKQIRVQHKRVEGIQTTQVLDLIHMDLMGPMQTESIAGKREKSETANSFKILALQLKNEKKMGIKQIRSDRGGEFMNEAFNSFCESQGIFHQYSAPRTPQSNGVVERKNRTLQEMARAMIHGNGVPEKFWAEAISTACYVINRVYVRLGSDKTPYEIWKGKKPNLSYFRVFGCVCYIMNDKDQLGKFDSRSEEGFFLGYATNSLAYRVWNKQRGKIEESMNVVFDDGSMPELQIIVRNRNEPQTSISNNHGEERNDNQFDNGDINKSGEESDEEVPPAQVHRDHASKDIIGDPSGERVTRGVKQDYRQLAGIKQKHRVMASFACFEEIMFSCFVSIVEPKNVKEALEDHFWILAMEEELEEFSRHQVWDLVPRPPQVNVIGTKWIFKNKFDEVGNITRNKARLVAQGYTQVEGLDFDETFAPVARLECIRFLLGTACGMGFKLHQMDVKCAFLNGIIEEEVYVEQPKGFENLEFPEYVYKLKKALYGLKQAPRAWYERLTTFLIVQGYTRGSVDKTLFVKNDVHGIIIIQIYVDDIVFGGTSDKLVKTFVKTMTTEFRMSMVGELKYFLGLQINQTDEGITISQSTYAQNLVKRFGMCSSKPAPTPMSTTTKLFKDEKGVKVDEKLYRGMIGSLLYLTATRPDLCLSVGLCARYQSNPKASHLLAVKRIIKYVSGTINYGLNYTRDTSLVLVGYCDADWGGNLDDRRSTTGGVFFLGSNLISWHSKKQNCVSLSSTQSEYIALGSCCTQLLWMRQMGLDYGMTFPDPLLVKCDNESAIAISKNPVQHSVTKHIAIRHHFVRELVEEKQITVEHVPTEIQLVDIFTKPLDLNTGNRKFSYPNPKTLAMVRTRGDSRRPTRAPANTRAVARTRSEARRAAPSAPATTPIVGRTRRDARRTAPTIISDDSDSSSDDAVPDPKAARSPVAVPSKQAAEAPPPPSHAPDDSPAPVSDLPPKTSTAPPINDPAPDLLRNAFSSRGRLPYDPSDRCSIHRHHQAERDAADPSIWTPPYEPLTIQFLTSQGVERYKDFKLRDPYEQRYVPRGPPEMRDMMKVIEDNHLLDTVAEIDPFVKEVIWEFYANFHIFNEETKKSKVFVRGKMYEFSPQMINKTFRSPAIKWHAKAEFERVTMSKHALAKYLSDGKVVTWKDLRTPVMPTHLAGLYLICCINWIPSKNNSNVTVDRAKMLYLLNERIPFNFGKLVYDQVEKAARSPGQIQNILPFPNLIYRVLMFQRVITLENYEKPGPHPKLFNPDVRGGIEHPKRRGEYLFGTSLPGDLRHVSTLLTTIATRIEGGDYGLVSSSSHSSQGVNADVEAQGLEPEADDDYVPPVDEGWSPENSDSFVNSLDVDNEEGYEDTQSS

SEQ ID NO: 83088 - protein, 213 aa, Porphyra yezoensis
AGGIAEMAGLPSEVRDTTDALDALGNTTAATGKGFSNGSAVLTAYALLTALVQDSGLAPNPLQLVGPAAAAAGVAGAHVTDGGQVVSLVDIYVVVSVFIGIMLPFFFGALTMLAVSRAAQAMIVEVRRQFRDIPGLREGARGVQPQHVRCVNISTRSAIIEMVIPGALAILTPLIVGFGFGQRALIGLLLAAIGSGYMLGIMMSNAGGAWDNA

SEQ ID NO: 83089 - protein, 108 aa, Triticum aestivum
MHPTRWELSYMVDLQAAALVISVVAAEVGRGRAMKVRDVPAYLKPRLTWENVKKSTDQAVDRYIEKYIETSSVDPLFHVCFGGMAFAYLVGLPQERRHLEHLEKHGGH

SEQ ID NO: 83090 - protein, 368 aa, Oryza sativa Japonica Group
MAHARSTGSLPVANVQALAETCNDPDQQIPERYIRADANADEVISGDDCTAAIPTVDLSKLLDPLSSDEETEKLGSACQQWGFFQLINHGVSEDVIRDARKDIAEFFRLPMETKKAYSQLPSGIEGYGQAFVVSHEQKLDWADMFYLVLRPGESRNMALWPAHPPSFRNSIDRYSSETARVARCLLEFMAKDMGVRPGSLLERFQDQPQGIRMNDYPPCREAGKVVGLSPHTDAACLTLLLQVNDVPGLQIRSPGGRWLAVGAPPDDGAFIVNVGDILEIMSNGKYRSVEHRAVVRPDRERVSAAVFHQPCQDAVVGPLPELVGEGGGDNARYTSMGYLDFMKRYYSAKLDGRNHLDGLRIKLSSSKG

SEQ ID NO: 83091 - protein, 269 aa, Streptococcus pyogenes MGAS10394
MRKDSFPLETKYAFARQIIKEAGLFIKSKMSEQLDIQVKTQFDDLVTNVDQETQQLLMDRIHQTYPCDAILAEENDVRHPINQGNVWVIDPIDGTVNFIVQGSQFAVMIAYYEQGIGQFGLIYDVMADQLLAGGGDFEVTLNGDKLPAYQEKPLERSLIGCNAGMFARNDRNLAHLISKTLGVRVYGGAGICMVKVMKQELLAYFSFIQPWDYAAAKVLGDKLGYVLLTIDGYEPDFQTRQKIMFVPKCQLTRIASFLTKDSAVTLEDQ

SEQ ID NO: 83092 - protein, 944 aa, Coprinopsis cinerea okayama7#130
MADPPRTPFSFHSTKTVRDPKSIGLWTVGRTIGKGASGRVRIARHAKTGQYAAIKIISKSTLPPMMSQVSLNRLADVTEHVQLSVEREIVVMKLINHPNIMKLYDVWETSTDLYLVLEYVQGGELFDYLCSKGRLPVHEALLYFQQIISAVDYCHRFNIAHRDLKPENILLDENSNIKIADFGMAAWQSNPDAETLRTSCGSPHYAAPEIINGQPYNGAAADIWSCGIILHALLVGKLPFDDDDCPALLEKILRAKFTMPTDIPASAQNLLGRMLEKDVKKRITMAEIMEHPFFLSQDPPKVDYALPDLESIAQPVPSVSALDPDIFANLRTLWHGTSDAVLIDSLINNERNWQKGIYHLLVDYRSRNPQVYDEDEQAVAKLHKERKRRRQQRKPVQNDGDADDIPPRAAPPTPRSASRHNRLGIDLSFDELLPHAKSSSSSLSERNETSRPTHLQPPPMSTQRSSDSTTSEGTSVSSTTATTTTATSSSLLTPFSPLWETLDLPKLTVPNTQDREMQTFFNHIVTHLNVLQAKTASSEISTWGASSSLGSAASGGGSESGTIKSGRSGLSASSAAVPNARMTSARKTGVDHEDGFFRPSRHSSPRLDSSLIAPIQQKGKGKEKASLHLPEEGDEDDEDSLGEVEGRQQLGASTVEALRYTETQPLSVRSHSRRALYPVTPSRTTNKENEDVPLDAYRSNLTRQALANHAKRNLSTPKAITIVEPQPVSQRKHIRQGSRKPPQTPLSALSPLDNRGVGGLSSSSAYAHGYTSPPPHPSSTATPKRTWIDTVFKPKAPNYTLYSRRGVQETRNECRRLLMDLDLLVSIEENERMGVLKCRSIEIQDPFRVHNVPKAIRFRVEGQRAPYNLVQSGITMSLSFYHEKGSFEAFQDIYHSLRARWDMDKVESVAEGDEDEMEGMTKLASGLSALSTRAIGGRPASQAY

SEQ ID NO: 83093 - protein, 318 aa, Oryza sativa Japonica Group
MLRSTHPPPSSPSSSSSGGGGGGGSSASSSSEKTMVGGGGGGGGGSGSAAPSGAKLLQILNVRVVGSGERVVVLSHGFGTDQSAWSRVLPYLTRDHRVVLYDLVCAGSVNPDHFDFRRYDNLDAYVDDLLAILDALRIPRCAFVGHSVSAMIGILASIRRPDLFAKLVLIGASPRFLNDSDYHGGFELEEIQQVFDAMGANYSAWATGYAPLAVGADVPAAVQEFSRTLFNMRPDISLHVCQTVFKTDLRGVLGMVRAPCVVVQTTRDVSVPASVAAYLKAHLGGRTTVEFLQTEGHLPHLSAPSLLAQVLRRALARY

SEQ ID NO: 83094 - protein, 260 aa, Oryza sativa
MAEEKKTPCLNERILSSLSKRSVAAHSWHDLEIGPGAPQVFNVVVEITKGSKVKYELDKKTGMIKVDRVLYSSVVYPHNYGFIPRTLCEDGDPMDVLVLMQEPVIPGCYLRAKAIGLMPMIDQGEKDDKIIAVCVDDPEFRHFNDLKELSPHRLAEIRRFFEDYKKNENKEVAVNDFLPPATAQEAIKYSMDLYAEYILHSLRALINYHRQMEQSDPDLMKKITIKVSWVMLFLSSHFCIIFETRDNIMFLHLCRIYANQ

SEQ ID NO: 83095 - protein, 1307 aa, Ceratodon purpureus
MSATKKTYSSTTSAKSKHSVRVAQTTADAALEAVYEMSGDSGDSFDYSKSVGQSAESVPAGAVTAYLQRMQREGLIQNFGCMVAVEEPNFCVIAYSENASEFLDLIPQAVPSMGEMDVLGIGTDIRTLFTPSSSAALEKAAATQDISLLNPITVHCRRSGKPLYAIAHRIDIGIVIDFEAVKMIDVPVSAAAGALQSHKLAARAITRLQALPGGDIELLCDTIVEEVRELTGYDRVMAFKFHEDEHGEVVAEIRRMDLEPYMGLHYPATDIPQASRFLLMKNRVRLIADCYASPVKLIQDPDIRQPVSLAGSTLRAPHGCHAQYMGNMGSIASLVMAVIINDNEEYSRGAIQRGRKLWGLVVCQHTSPRTVPFPLRSVCEFLMQVFGMQLNLHVELAAQLREKHILRTQTLLCDMLLRDAPIGIVSQTPNIMDLVKCDGAALYYGKRVWLLGTTPTENQIKEIADWLLEHHNDSTGLSTDSLADANYPGAHLLGDAVCGMAAAKITAKDFLFWFRSHTATEVKWGGAKHDPDEKDDGRKMHPRSSFKAFLEVVNKRSPPWEDVEMDAIHSLQLILRGSFRDIADSDTKTMIHARLNDLKLQGVEERNALANEMSRVLETAAAPILAVDSRGMINAWNAKIAQVTGLPVEEAMHCSLTKDLVLDESVVVVERLLSLALQGEEEQNVEIKLKTFGTQTTERAVILIVNACCSRDASDFVVGVFFVGQDVTEQRMFMDRFTRIQGGEKTTVQDPHPLMRPSFDGDEFGRTFKRNSALGGLKDHATGSVERLDLYLRRAEECMEVMETIPSPKFNNKQCQYLAGKLKAVLQSASLFLRISHHEHHELGASIDMGRHVEIFKLLLALAKEIESFIQGCCKDEWIKAAMTLTNVSEYVSSMGFNLELCKIAFCKSCAASGSLTLDQIEVICKDEAEVVKRNASIDVDTLFAKVIYDLTEKTLSSDQNDLAIYLLQRLKRAKPILPSFSSRPSWWNFYDDWSFSEKFFQWIQITGSLGSGSSATVEKAVWLGTPVAKKTFYGRNNEDFKREVEILAELCHPNITSMFCSPLYRRKCSIIMELMDGDLLALMQRRLDRNEDHDSPPFSILEVVDIILQTSEGMNYLHEKGIIHRDLKSMNILVKSVKVTKSEIGYVHVKVADFGLSKTKDSSTRYSNQTWNRGTNRWMAPEVINLGYESTEGEISFDGKVPKYPLKSDVYSFGMVCYEVLTGDVPFPEEKNPNNVKRMVLEGVRPDLPAHCPIELKALITDCWNQDPLKRPSFAVICQKLKYLKYLLMTGFSSYQDSYPSTEEPS

SEQ ID NO: 83096 - protein, 276 aa, Oryza sativa
MEKPEWSMDDFEIGKYIGEGKFGKVYLAREKQSGYVVALKVTFKAKLDKYRFHAHLRREIEIQHGLDHPNVLRLFAWFHDAERVVLVLEYAARGELYKLLRTVRRFSERTAATYVASLAGALAYCHKKQVIHRDIKPENLLLDIEGRLKIADFGWAVRSNAKRHTLCGTIDYLAPEMIEKKAHDHAVDNWTLGILCYEFLYGSPPFEAAEQDDTLRRIVKGFAFPHSYVLQMLGFIAALVKLNKDFFGTYELPGGKMELQGVSGKGRISFRTRYSR

SEQ ID NO: 83097 - protein, 89 aa, Physcomitrella patens subsp. patens
MDPFSSPPPSGSGLGVSNEVMMGQVKQQLAQAYAEEFFGTVRDKCFSKCVTKPSSSLSGGESSCISRCVERYIEATGIISRAVISSLPR

SEQ ID NO: 83098 - protein, 372 aa, Zea mays
MSGGVEPETPPGSSSRSGGSRSVGGKPPRHHLTSIRHCASIARIAAASAGFGLDSGTLSLISPTADIHPGFLPVFRSGSFADIGPKTYMEDEHVCVDNLVEHLGFYGPGIPAPGAFYGVFDGHGGTDAACFVRKNILKFITEDCHFPNSIEKAIRSAFVKADNAIADSHSLDRNSGTTALTVLIFGRTLLVANAGDCRAVLGKRGRAVELSRDHKPSCIVERLRIENLGGTVFDGYLNGQLAVARAIGDWHMKGSKGSVCPLTPEPEFREVRLTEEDEFLIIGCDGLWDVMSSQFAVSMVRKELMEHNDPQRCSRELVHEALRRDCCDNLTVVVVCFSADPPPQIEIPRFRVRRSISMEGLHRLRGALDSNI

SEQ ID NO: 83099 - protein, 479 aa, Vitis vinifera
MEYLGYVFVGIVTLLLVCIPHWLRSWRKPQCNGKLPPGSMGWPILGETLQFSTPYTNRGVSPFIRKRMDRYGPLFRTKLLGWPFVISADPDVSRFVLQQEGKLFHCWYMESFDNLFGPQNVLSSQGALHKCLRSLILSQFGSESLRTRVLSQVEELVLKKLQLWSNHTSVDLKEGITSMMFDFTAKMICNYDESKTPEKLRENYSAFLSGLISFPLNIPGTSYWKCLKGRERARKTLRNRLLERLASPEREHKDIMDFIIQEMKKDDTILTEEIAVDLLFGLPFGANETTSSTLILAVQYLGSHPSALAEITREHESILRNRKQKDSGITWEEYKSMSFTMMVVNETVRMGSILPSIFRKVDKDIEIKGYTIPAGWMVLVSPPAAHFNPNVHKDPHVFNPWRWQGQEPTSGSNALMGFGGGIKLCAGVDFAKLEIAIFLHHLVTKYRWEVIKGGEVVWRQSTGPIFPNGFHVRISEKTK

SEQ ID NO: 83100 - protein, 256 aa, Sinorhizobium meliloti 1021
MSRLEGKIAIVTGASSGIGRAAALLFAREGAKVVVTARNGNALAELTDEIAGGGGEAAALAGDVGDEALHEALVELAVRRFGGLDTAFNNAGALGAMGEISSLSVEGWRETLDTNLTSAFLAAKYQVPAIAALGGGSLTFTSSFVGHTAGFAGVAPYAASKAGLIGLVQALAVELGARGIRVNALLPGGTDTPANFANLPGAAPETRGFVEGLHALKRIARPEEIAEAALYLASDGASFVTGAALLADGGASVTKA

SEQ ID NO: 83101 - protein, 177 aa, Tannerella forsythensis
MEAATRHPLGGFADLITIEEYKRTERPKIVLTWTPHPRALPQAVPNSFAEWINAAGYELVITHPEGYELDPQFVGTARVEHNQRKAFEGADFIYAKNWAAYKDPHYGEVLSTDRSWTVDTEKMALTNQAFFMHCLPVRRNLIVTDEGIESPQSLAIAQAPFPRDFGTNRTQGGCLKT

SEQ ID NO: 83102 - protein, 378 aa, Schizosaccharomyces pombe
MSFEGKTITCKAAVAWGAKEPLSIEDIQVAPPKAHEVRVKVDWSAVCHTDAYTLSGVDPEGAFPIVLGHEGAGIVESIGEGVINVRPGDHVILLYTPECKECKFCRSGKTNLCSKIRETQGRGLMPVGTSRFSCRDKTLLHYMGCSSFSQYTVVADISLVAISHSAPLRSICLLGCGVTTGFGAVTHSAKVESGSTVAVVGCGCVSLAAMQGAVAAGASRIIAIDINADKEVYAKKFGATDFIDSSKVKDLVQYVIDVTDGGVDYAFDCTGNVTVMQQELQFCHKGWGKLCVIGVAAAGKTLDFRPFLVVTGRQVLGSAFGGVKGRSELPNFVDEYMQGHFKVDEYITNEEPLKNINKAFDHMHEGKCIRCVVDMNKP

SEQ ID NO: 83103 - protein, 114 aa, Zea mays
  misc_feature (23)..(23): Xaa can be any naturally occurring amino acid
  misc_feature (46)..(46): Xaa can be any naturally occurring amino acid
  misc_feature (59)..(59): Xaa can be any naturally occurring amino acid
  misc_feature (81)..(81): Xaa can be any naturally occurring amino acid
QFYKAFFENRIQNCASNMVNNTXREKIFFASQYKFHADTNKLYWKXIFDIIPHEIATIXKRWKKDKVKMPSITFVQCPKPXKPTYLSQMRHILVMLKHAPSSHMMQPSLTSPCF

SEQ ID NO: 83104 - protein, 298 aa, Physcomitrella patens subsp. patens
MSKANEDVSLLKSPITYRDIVGAEGKLGSDPVTPEDAALMQSAETRTYGKTQKDGAASVMQAAAEENVKAGFVQKSDHSQVAEEGVAAQKILLPGAAVGMEYIAGQPVMVAVKPTPTDSFFATADAVTIGDALEAAAVGASDRPVGENDARAIQSAVMRATGAPPRAGGVAAAAMSAADLNPRVPSADKTTLADLLVDATITMEADKVATQEDAAKVLAAEMRAPHEGEVTPGGVAAAIQAAADMNELIGLIEPAVGNPARSFPLEDTPMPQQNALIPETEHTPKPATGEGQVHAKVD

SEQ ID NO: 83105 - protein, 685 aa, Lotus japonicus
MPLLSSQNYITVTQNQSIQDDETLVSAEGTFEAGFFSLGNSQRQYFGIWYKSISPRTIVWVANRDAPVQNSTATIKLTDKGNLLILDGSKGIIWSSNGSRAAEKPYMQLLDSGNLVVKDGGKRKKNLIWESFDYPGDTLLAGMKIKSNLVKGPTSYLTSWRNTEDPASGEFSYLIDTRGFPQLVITRNATAYYRAGPWTGKLFSGSSWLRLRKILTFSMQFTSQEISLEYETANRSIITRAVINPSGTTQRLLWSDRSQSWEIISTHPTDQCTYYGLCGANSMCDISNNPICHCLEGFRPKFQAKWNSFDWPGGCVPMKNLSCQNGDGFLKHTGVKLPDTSSSWYGKNKSLDECGTLCLQNCSCTSYAYLDNDIGGSACLIWFGDILDLSIHPNPDQGQEIYIKVVASELDHRRNKKSFMTKKLAGSLAGIVALVICIIILGLATSTCIQRKKNERGDGDSTRSKLLDWNKRLQIIDGIARGLLYLHQDSRLRIIHRDLKTSNILLDNEMNPKISDFGLARIFIGDQVEARTKRVMGTGYMPPEYAVHGSFSIKSDVFSFGVIVLEIISGKKIRKFYDPHHHLNLLSHAWRLWIEGSPLELVDKLFEDSIIPTEILRYIHVALLCVQRRPETRPDMLSIVLMLNGEKELPKPSLPAFYTGKHDPILLESPSRRCSTSVTISLEAR

SEQ ID NO: 83106 - protein, 531 aa, Coccidioides immitis RS
MARELTHIRDLSEKSTYNCDTVTLQDILGDPLIKECWQFNYLFDIDFLMKQFDPDVKNLIKIRVIHGSWKKDSPNRIYIDEACARYQNVEPIIAYMPEPFGTHHSKMMILIRHDDCAQIIIHTANMIPGDWANMCQGVWRSPLLPLLPLDRDYDQSISGIIGSGRRFKRDILAYLDAYGRKKTGPLVEQLKKYDFDEVRAALIASVPSRQEIPNLDSQKKTIWGWPAVQDVLRQIPTHKQLSCEPKKPRIVIQISSIASLGQTDKWLKDTFFNALCPPSAAARFSIIFPTPDEIRRSLNGYRSGGSIHMKLQSAAQQKQFDYMRPYLCHWAGDCENNQNADIEKSVSSTVTLDTSTPNNTFVREAGRRRAAPHIKTYIRFSDAEDMRTIDWAMVTSANLSTQAWGAAINANQEVRVCSWEIGVLVWPDLFLNDPQTADRDDKMLSKAYERGEYAQMIPCFRQNAPCLSEVERLELEESSRGDDKSKAWRTLVGFRMPYNLPLKPYSSRDIPWCATATHTEPDWLGQTWEEG

SEQ ID NO: 83107 - protein, 276 aa, Dehalococcoides sp. VS
MIKISIQGARGSFHDIVARHKFPGDSEIIESNTSHQVFEDVKKGLADYGVVAIENSLYGSFLENYDNLLNYESKIVGETYLHVILNLIALPGVKMEQIREVYTHPIAMIQAESFLEKHPSVIRIESHDTAGSVRMIKEKSLKTAAAIGSNLAAQLYDMKILAKDIETEKQNYTRFLIIAKEPKYPPQANKTSLAIKAENNAGSLYKCLKCFYDQGINLSKIESRPIMGRTWGYYFYLDFERGLNTPETQRALKELEKVTESIHILGSYEQGKVFEE

SEQ ID NO: 83108 - protein, 355 aa, Neurospora crassa
MCFGGRGKDDEAEASRSRELDKQIRADEKRLSKEVKLLLLGAGESGKSTILKQMKLIYAQGFSKNEKLEWRPVIFANILQSFRLIFDAMNEFNIKLEDEDNEKNMVQMMVDYEMRGDEPLPLEYFEPAKKLWQDSGVRQAIEKGNEFALHDNLQYFCSDLDRLWDRNYVPSDQDLLRSRLRTTGITETVFDLGQLTYRMFDVGGQRSERKKWIHCFENVNCLLFLVAISGYDQCLVEDKDGNQMNEALMLWESIANSHWFTKSALILFLNKIDLFKEKLPRSPITNHGFTDYHGPPDDSKQASKYFMDKFRALNRNPDKEIYGHFTNATDTNLLKITMGSVQDMIIQRNLKQLIL

SEQ ID NO: 83109 - protein, 288 aa, Picea sitchensis
MEGKEEDVKLGANKYSERQPLGTAAQTREKDYKEPGPAPLFEPGELASWSFWRAGIAEFMATFLFLYITILTVMGVKRSDDVCTGSVGIQGIAWAFGGMIFCLVYCTAGISGGHINPAVTFGLFLARKLSLPRAVFYMICQCLGAICGAGVVKGFMESEYEMDGGGANSVAHGYTKGDGLGAEIVGTFVLVYTVFSATDAKRSARDSHVPLLAPLPIGFAVFLVHLATIPITGTGINPARSLGAAIIYNKSHAWDDHWIFWVGPFLGAGLAAIYHQMIIRAIPFKTRS

SEQ ID NO: 83110 - protein, 954 aa, Ustilago maydis 521
MVPDTEFSEALSKPLNVIQQIHNDAQDKSPSNITKLVETHFRHLFASPDASAKIPLLSPDNISQLLPPLNTDAPIAHRLVRFRAMIQDTGLGTEVFLAKHQHAGRTFTGLYGGEASIGNSSDSSNQADHNELDHQNLAERTVMYVVSLPGQSVWAANAHREAIAGPNSDPSLDELVMDTSAVSLNEAVSPKRVQEVRERIRKAVAKGKKIGSAGKEPRLVAISKLHPPSAILAAYRQAGQLHFGENYVQEMVDKAKVLPREIRWHFVGGLQSNKGKLLASIPNLYLLETLDSVKAANVLQKALASPDAAKRDEPLRVYLQVNTSGEEAKSGLAPILAVDAEQARESDLLQLAVHVITKCPNLRLRGVMTIGAAANSSSADAEAAKSVDEIVSANPDFERLIQTRANLVQLLRKSEKVQTADASHIKEAYSELLDGSDAHGGLELSMGMSADMDVATMAGSDNVRVGTDCFGRRPATREEAMSAMKHELEVGPEAAAAESTHQRGSQSLLASSTTADARMPNLCRAYLAKSPLPDTPHVGGLVKLYDLDAAEKFKTTELIEVVGILETAALPQAEWQDTGSAAASSSEPAQVPCIHAIYAAPAELDSIGSEESSSTPDANVLSQPTQRQALIDFLAGALGGDKVAAELVLLAVIARIHVRRANLCLGALTLNVSNFAAPPSSSSQTQLSLRLKQLLPAVVDVSMDLGALNDDKRPLYPKSAGGATGLEAGQLQLVNGTTILVNEGAMGEGQLKDTGIHNIKALSSVLESYKLPYAFPYSEFEFDTDLNAVILSQGKSFLPFDVQCPLQPMDGAVELYSSSLPQVDQAQLWTWRKALSNARNLATAKAFVIPESVSEHIQQEFVAERRKEQEDAKHSHGGVGSKAEGLGQEDLLRRMSIVRLLALSYGEKSLSIETWSKAVELDKLLAQRVTAVQQQQQRSQHASATMSGAASVSR

SEQ ID NO: 83111 - protein, 506 aa, Candida glabrata CBS 138
MSLTIKRNNSVENEENSKRLKDATGERVYDVVATMVSLIPGKEQSYEIKDKSVTSVGRSRSCDIVLQEPDISTVHCEMYIVSMKLDNSERKLINIVDKSRNGTYINGNKLIKRDYVLKNGDRVVFGKRCSFLFKYASTTFEDLNEEDKASDISDENRKDESSIFKKPQFSFTSSQSQVRKFAKLKPLSFFDKYLLGKDLGSGHYAIVKEAKNKTTGETVAVKIFHPQQNDDQKKNKQFREETTILMKIHHPNIVNLLDSFVEPISKTQIQKYLVLEKIDDGELFDRIVKKTSLPQEESKAIFKQILTGLKYLHSQNIIHRDIKPENILLNIRRRQSPDERQLGPWDEDEIDIQVKIADFGLAKFTGEMQFTNTLCGTPSYVAPEVLVKKGYTSKVDLWSAGVILYVCLCGFPPFSDQLGPPSLKEQIMSAKYAFYSPYWDEIDDAALHLISNLLVLDPENRYDVDAAAAHPWLDSVSHLDVSHNLKRLQIDENRMPKTYSELSSLH

SEQ ID NO: 83112 - protein, 496 aa, Pseudomonas fluorescens PfO-1
MTTTRNDWEQRFQSLTLESRAFINGEYRPAISGETFECLSPVDGRFLASVASTDEADANLAVEAARQSFNAGVWANKAPAERKRILIRFADLILQHQEELALLETLDMGKPISDSMSIDIPATANAIRWSAEAIDKIYDEVAATPHDQLGLVTREPSGVVAAIVPWNFPLIMASWKFAPALAAGNSFILKPSEKSPLTAIRIAQLALDAGIPKGVFNVLPGFGHTVGKALALHMDVDVLAFTGSTAIAKQLMIYAGQSNMKRVWLEAGGKSPNVVFADAPDLRAAAQAAAGAIAFNQGEVCTAGSRLLVERSIREQFIPLLVEALQAWKPGHALDPATTVGAVVDQRQLDNVLRYISIGREQGAELIAGGRRTLEDTGGTYIEPTIFDGVTNAMTIAKEEIFGPVLSLITFDTVEEALHIANDSIFGLAAGVWTSNLSKAHTFARGLRAGSVWVNQYDGGDMTAPFGGFKQSGNGRDKSLHAFDKYTELKATWIKL

SEQ ID NO: 83113 - protein, 123 aa, Brassica oleracea
MAATAEVIPAGEVIACHTVEDWNNKLKAAKESNKLIVIDFTAVWCPPCRFIAPIFVELAKKHLDVVFFKVDVDELATVAQEFDVQAMPTFVYMKGEEKLDKVVGAAKEEIEAKLLKHSQVAAA

SEQ ID NO: 83114 - protein, 500 aa, Photorhabdus luminescens subsp. laumondii TTO1
METKDLIVIGGGINGAGIAADAAGRGLSVLLLEAQDLAKATSSSSSKLIHGGLRYLEHYEFRLVSEALAEREVLLNLAPHIAFPMRFRLPHQPHLRPAWMIRIGLFLYDNLGKRVSLPGSKGLKFGANSVLKPELVRGFEYSDCWVDDARLVVLNAQEVKKRGGEVRTRTKVTRAWREQEGWMVEAEDLRTGKTYTWRAKGLVNATGPWVKEFFDDGLKLKSPYGIRLIKGSHIVVPKVHDEPQAYILQNEDHRIVFVIPWMDEFSIIGTTDVEYQGDPKEAKIDDQEINYLLRVYNDHFKKQLNRDDIVWTYSGVRPLCDDESDSPQAITRDYTLDIHDEQGKAPLLSVFGGKLTTYRKLAEHATEKLMQYYPTAGKAWTRNGQLPGGNLEGCDRDGYARLLRKRYNWLPEGVAVRYARTYGSNSELILQGANNLTDLGESFGHGLYETELRYLVDNEWVVELDDAIWRRTKLGMWLKEEQKQRIAAWLAENAKPRTEI

SEQ ID NO: 83115 - protein, 550 aa, Oryza sativa Indica Group
MESLRIAASHRPPLLLPSPHQLRRRHIAAVPLSLPHTSLSLSSHHHHHHRFAPTPFRRRIPPLLASQTPNPEADSPAPAGAKLAPLLVSLAVGLAVRFLAPRPPEVSPQAWQLLSIFLSTIAGLVLGPLPVGAWAFLGLTAAVATHTLPFAAAFSAFTNEVIWLIVISFFFARGFVKTGLGDRIATYFVKWLGGSTLGLSYGLTISEAFISPAMPSTTARAGGVFLPIIKSLSLSAGSKPNHPSSRKLGSYLVMSQFQAAGNSSALFLTAAAQNLLCLKLAEELGIIVANPWVAWFKAASLPAIASLLATPYLLYKIFPPETKDTPDAPALAAEKLERMGPVTKNEWVMIGTMLLAVSLWVFGDAIGVSSVVAAMLGLSILLLLGVLDWDDCLNEKSAWDTLAWFAVLVGMAGQLTNLGIVSWMSSCVAKLLESFSLSWPAAFCVLEASYFLIHYLFASQTGHVGALYSAFLAMHVAAGVPRVLSALALAFNTNLFGALTHYSSGQAAVYFGAGYLELPDVFRMGFVTALINILIWGVVGTFWWKLLGLY

SEQ ID NO: 83116 - protein, 321 aa, Salinibacter ruber DSM 13855
MQSISFENGDEMPMIGLGTWKSPPGEVYEAVTTALEAGYRHVDCAPIYKNETEVGAALSDSFDAGGIRRDDVWVTSKLWNNAHHPDDVRPALEQTLSDLRLDALDLYLIHWPVALQPEVDFPESPDDFVSPEAVPLTETWAAMEALKKDGLVRHIGVSNFSVPNLQMILDAGEVRPEMNQVEMHPYLPQPELVSFAEAHNIPITAYSPLGSGDRPDAMKADDEPTLMANPTINDIADRHGVSPAQVLLQWGVARGTAVIPKSTTPAHIKDNLAAADLDLSADELETIDSLDSKYRYLAGAAWTMEGSPYTQAGLWGEEQIR

SEQ ID NO: 83117 - protein, 492 aa, Vitis vinifera
MGYLWYAFAFTATLLVCITHWVYSFRKPKFNGKLPPGSMGLPILGETLQFFAPNTALDVAPFIRERMNRYGPLFRTSLVGWPLVISTDPDLSRFILQQEGKLVHSWYTESFDNVVGKQNVLSAKGAMHKCLRNLILNQFGSESLKTRFLTQVEELVLKHLQLWSNCTSVELKEAIASMIFGFTAKKLFDYDESRTPEKLRENYAAFLDGLISFPLKIPGTSYWKCLQGRKRAMKTIRNMLDERRASPEREDKDYIDFVLEEMQKDQTILTEEIVLDLLFALPFATYETTSSALVLAIQYLGSHPSALAEITKEHESILRSRERVDSGITWNEYKSMNFTMMASPKNFLVINETVRLGNIVPGIFRKVAKDIEIKGYTIPAGWMVMISPPAVHFNPTLYKDPLVFNPWRWQCQEPNAGSRNFMGFGGGIRQCVGAEFVKLQMAIFLHHLLTKYRWTVIKGGDTVWKPGLVFPKGFHVQISERTKLYEDSPMET

SEQ ID NO: 83118 - protein, 475 aa, Haemophilus somnus 129PT
MKTQAYINGEFISAKNHRTFPVINPANQQVICEIACCGKEETELAIKSAKQAQVHWKKYTAKERSKILKKWFELIMQHQESLAYLLSLEQGKPLSESRAEIAYGASFVEWFAEEAKRAYGEIIPQVREDHRLLVIKQPVGVVAAITPWNFPNAMITRKAAPALAAGCAIIIKPAPETPLSALALAALAEQAGIPKGIFNVLPTVYAEEVGSVLTRSTDVRKLTFTGSTKIGKILMQQCADTVKKISLELGGNAPSLIFNDADLDRTVDSVIASKFRNSGQTCICTNRIYVQSEIYRAFADKLKQKVRSFIVGDFQQEAVNIGPLINESAVRKIERHIEDALSKGAILTLGGQRHSLGGTFFEPTILENVSQDMLVCHEETFSPLAALIPFDTEEQAISMANDSEFGLAAYVYTQDFSRIWRLSEELECGLVGVNEGIISNEVSPFGGVKQSGLGREGSRHGLDEFLEMKYLCMKV

SEQ ID NO: 83119 - protein, 344 aa, Parvularcula bermudensis HTCC2503
MMTNADPFRRLFVQGAGSWGTALALLGLQTGAEVVLWTRREDHAAAMRGDRENQRYLPGVSLPPALTITADRGAIAGCDAVLSVVPAQFAGGELAALREASGAAALPVALCSKGIEAETRRLMPEVLKAAWPEAAPAMLSGPSFAADVAKGLPTAVTLADADRDRGERWLATLGTLTFRPYWSADLTGVAIGGAVKNVLAVACGVVEGQGLGESARAALMARGFAEAARFAVALGAKVETLRGLSGLGDMILTCVSPQSRNYSLGVALGQGETAADILSKRHTVAEGAKTAPVLTALAREHGVEMPVAEAVAALVAGDIEVDDVVDSLLSRPLRPESPLLRDKT

SEQ ID NO: 83120 - protein, 406 aa, Oceanicola granulosus HTCC2516
MTFENLGLSPRLAARLAEQGLTAPTPIQTQAIPHALEGRDVLGLAQTGTGKTAAFGLPLIQALTAAGTHAAPNTVLALILAPTRELAAQIVDSLRAFAGNGGSPRIGLVVGGKSINAQANALRRGTDILVATPGRLIDLLDRKALTLGKARYLVLDEADQMLDLGFIHALRRIAPLLPKERQTMLFSATMPKQMSEIAGAYLTDPVRVQVSPPGKPADKVDQSVHFVAKDAKQALLIDLLDAHRDERALVFARTKHGAERLMKQLDRAGFAASSIHGNKSQGQRNRALDGFREGKVRVLVATDVAARGIDIPGVGYVYNYELPNVPENYVHRIGRTARAGADGRAVAFCGEEEMGELRDIEKVLGKPIAIAGGSPWQVAGGGKPGKPRGQQPPRRRRSRRPARKAA

SEQ ID NO: 83121 - protein, 680 aa, Neurospora crassa
MASEEGPSRSASPTNVDNTFPQYPPRAELTVAGPPSLISSRMTDIGTEDGQGSDTTPRGGGPSSANPNRRSGFYSDTQSRPETSGTGLSSRGPWAQSVPLRQQLTGKRGSIAGSIGSAGGRPISAASRSHVPSLTSHGFFRPMSSQKLQAQRGAGRPPTMNRPYVITGEAGARNSVISTGSGRIGAQIAEDAELRMPSRGTEMTEQETMERMTANTSPINGFFPTSSVTDSVRPLQSPVDARNINVEMNKDYREESPTTPPRSPTRTSRSFRSSFLMPRMNESGITGSNREIEGGEKLQSAASSPNIPPQSYERQRARFKRRAKRQNRANLGKNYEYFEGNTVFCLGGRFQNTKQRPINIATGSLIVLPCILFFIFSAPWIWHNISPAIPVTFAYLAYICVSSFLHASASDPGILPRNLHKFPPPEMEDSPTGPPTTDWVLVHSAEASTAAMEVPIKYCKTCQLWRPPRAHHCRLCDNCVETQDHHCVWLNNCVGRRNYRYFFTFVSSATVLALYLIGACLAQILVYKNQHHISFGHAVNHFRVPFAMVFFGFLTFLYPAALTGYHIFLMARGETTREYLNSHKFPKSDRYRAFTQANWLKNWFVVLCRPRPPTYYGFKVKYNQGDQRLGSHRRWQQPAVSDSKEGMEMQNVSPQLPQTGFMGPTALRNSNNGSTAEVRA

SEQ ID NO: 83122 - protein, 268 aa, Actinobacillus pleuropneumoniae serovar 1 str. 4074
MSKIPLRTEEEIEKLRVACKLASDVLVMIEPYVKEGVSTAELDRICHEYIVNEQKAIPACLNYHGFPNATCISLNEVVCHGIPSADRKLKKGDILNIDVTVIKDGYYGDNSKMYVVGEPSIRDKRLIEVTLESLYIGLRTVKPGIRLKEIGKTIQRYVEKQGFSVVREYCGHGIGTEFHCDPQVLHYNSDDGGVVLQEGMVFTIEPMVNAGKKEIRNMPDGWTVKTKDRSHSAQFEHQIVVTKEGCEVMTIRDEEIAEGRISRMMKNV

SEQ ID NO: 83123 - protein, 490 aa, Trichodesmium erythraeum IMS101
MVTATKPEQKVKIGPTKLLINNEWVESASGKRFETINPATGEVICNVAEADAPDVDKAVIAARKAFTSGEWPKISAAKRGELLYKLADLIEKNIEELARLETLDNGKPFKDSLNTDLPLAIACYRYYAGWADKVQGKTIPISGPYFCYTRHEPVGVVGQIIPWNFPLLMQAWKLAPALAMGNTLVMKTAEQTPLSALRVGELVIEAGFPPGVVNILSGYGPTAGAAISHHKDIDKVAFTGSTEVGRLIMEAAAKSNLKRVTLELGGKSPNIVFADADMDAAIEGSHFALFFNQGQCCCAGSRLFVEEKCYDEFVNKSVERAKLRMVGDPFTERVEQGPQVDEEQFNKVMSYIESGQQDGAQMLCGGSRVGDRGYFIAPTVFADVQDNMKIAQEEIFGPVMSIIKFKDIDELVERANNSMYGLAAGVWTQDVTKAHTLAHRLRAGTVWVNCYDVFDAAAPFGGFKQSGLGRELGEYGLQQYTEIKTVTMKM

SEQ ID NO: 83124 - protein, 181 aa, Hordeum vulgare subsp. vulgare
MASDGRVERIASSIRAIPNFPKPGILFQDITTLLLDPQAFRDTTDLFVERYKDKSITVVAGVEARGFIFGPPIALAIGAKFVPIRKPKKLPGEVISEEYSLEYGTDKIEMHVGAVQPNDRVLIVDDLIATGGTLCAAAKLIERVGAKVVECACVIELPELKGRDKLGDLPVFVLVQADESV

SEQ ID NO: 83125 - protein, 259 aa, Lotus japonicus
MEHTEAGTVQAVLFQEEAVETIKGTQKMEPSEAGTVQMSDNVVLRKLLRGPRYYDPPADCGWETCYNCGEEGHATVKCAAAKELKKPCYLCGSLMHQAKRCKKEIQCYVCKSFGHLCCANTTGSTPIEISCYKCGQTGHTGLARCSHVQGKNFFTENAGVMVKEEVRKRGHTLSNTESPTFQKENGYMGDRSAPHDMGMPYMEKKPLTEERAITTQQPSKHRGGCREDQAMLFITGSQHLGIGESEKLQQVVAFQNSGL

SEQ ID NO: 83126 - protein, 646 aa, Burkholderia sp. 383
MRARLISYNGTTMYDLLKTIDDPADLRRLDRRQLQPLADELRAFVLDSVSKTGGHLSSNLGTVELTIALHYVFNTPNDRIVWDVGHQTYPHKILTGRRDQMHSLRQQDGISGFPRRSESEYDTFGTAHSSTSISAALGMAIGSQLNGDDRFSIAVIGDGAMTAGMAFEAMNNAGVSEDAKVLVILNDNDMSISPPVGALNRHLARLMSGRFYAAARAGVERVLSVAPPVLELARKLEEHAKGMVVPATLFEEFGFNYIGPIDGHDLDSLIPTLQNIRELRGPQFLHVVTKKGQGYKLAEADPVLYHGPGKFNPAEGIKPSTTPAKKTYTQVFGEWLCDEAERDTRVVGITPAMREGSGMVEFEKRFKDRYYDVGIAEQHAVTFAGGMATEGLKPVVAIYSTFLQRAYDQLIHDVALQNLPVVFAIDRAGLVGADGATHAGAYDLAFMRCIPNMTIMAASDENECRQMLHTALQQPNPTAVRYPRGAGTGVPTVKEFTEIPLGKGEVRRQTSQPEGKRVAILAFGTMVAPSLAAAEELDATVANMRFVKPVDAALVRELAETHDYLVTVEEGCVMGGAGSACVEALMESGVIRPVLQLGLPDLFIDHGDPAKLLSQCGLDGAGIAKSIRERFLNPAADVAGQAKRVA

SEQ ID NO: 83127 - protein, 253 aa, Caulobacter crescentus CB15
MTLSSTTPRPLIAGNWKMNGLSVALDEARAVAAALEAKPPAARVAIFPPATLLHRLSQAVEGAHLLTGGQDCHGKSSGAHTGDVSAEMVADAGGSLVICGHSERRTDHGETSAQVAGKAEAAAAAGLEPIVCVGETLETREAGQAVSFVVSQVRDSLPTSLAGKAFSVAYEPLWAIGTGRTASVDNIVEMHAAIRAELVSRFCEQGRTVLILYGGSVKPENAREILAAPEVGGALVGGASLKAKDFLAIIQAL

SEQ ID NO: 83128 - protein, 193 aa, Picea sitchensis
MASAIMSSAAAMAAVAAPPKTSNGSGSSNGNVVSAFTGLKSTAQFPSSMKISNAGAEWERKTTSNGGRVRCMQVWPPYNNPKFETLSYLPRLTQEQLLKEVEYLLRNKWVPCLEFDEDGIIKRKYGSTPGYYDGRYWVMWKLPMFGCTEASQVLNEVNECAKAYPKAFIRVIGFDNVRQVQCISFIVHKPEYN

SEQ ID NO: 83129 - protein, 545 aa, Synechococcus elongatus PCC 7942
MLANWIGILLGGFLAGQIARRLGAPALIGMILWGIVLGPQVSQWLSPAVLDQAGIWRTLAVMVILVKAGLGLERDKLVQQGSVALRLGILPAACEAVVIAIAAHYLLNFDWLTGLLLGCVIGAESPAVIVPGMLRLKQLGLGVRKGIPDAILTGSALSDVLLLLVFSLLLALLTQGNAHIWTLPGLGPVNPWLLLPLQVLLQVSLGAVLGFVVARLLVRMLGPQNWTQTLTQDTLVTAAIALGLVLAAEQLPIFSGYLAVMVLGYFVVELDAPLARRLRQGFDSLWAIAQIALFVLLGAGLPLTALASLWLPGLLILVLGTLLGRSIGWALSTWGSNWNWQERSFLLAGNSAKATVQAAIGGVPLAAGLPEGQSILAIAVLSIVITAPLGAWAIPTFAPRLLSRDPVDPSQVSRDRPVRLLAAVDSSPVAIAVLLKTAELARRSDAEVAVLHVAQVSDTQSLQTLQRQIEQSLADIRYQFWLREGAIPETINRCAQEWQADEIILGKHEQSHRPEMRLGSVSQALLDVSTVPMILVETAAELQTS

SEQ ID NO: 83130 - protein, 386 aa, Escherichia coli O157:H7 EDL933
MTNNPLIPQSKLPQLGTTIFTQMSALAQQHQAINLSQGFPDFDGPRYLQERLAYHVAQGANQYAPMTGVQALREAIAQKTERLYGYQPDADSDITVTAGATEALYAAITALVRNGDEVICFDPSYDSYAPAIALSGGIVKRMALQPPHFRVDWQEFAALLSERTRLVILNTPHNPSATVWQQADFAALWQAIAGHEIFVISDEVYEHINFSQQGHASVLAHPQLRERAVAVSSFGKTYHMTGWKVGYCVAPAPISAEIRKVHQYLTFSVNTPAQLAIADMLRAEPEHYLALPDFYRQKRDILVNALNESRLEILPCEGTYFLLVDYSAVSTLDDVEFCQWLTREHGVAAIPLSVFCADPFPHKLIRLCFAKKESTLLAAAERLRQL

SEQ ID NO: 83131 - protein, 365 aa, Enterococcus faecalis
MAKRIVGSTPKQDGFRMPGEFEPQEKVWMIWPERPDNWRDGGKPVQEAFTNVAKAISQFTPMNVVVSQQQFQNCRRQLPPEITVYEMSNNDAWVRDCGPSFVINDHGEIRGVDWTFNAWGGLVDGLYFPWDQDDLVAQKICEIEHVDSYRTDDFVLEGGSFHVDGQGTVLTTEMCLLSEGRNPQLSKEAIEQKLCDYLNVEKVLWLGDGIDPEETNGHVDDVACFIAPGEVACIYTEDQNSPFYEAAQDAYQRLLKMTDAKGRQLKVHKLCCPVKNVTIKGSFKIDFVEGTMPREDGDICIASYMNFLITNDGVIVPQYGDENDHLALEQVQTMFPDKKIVGVNTVEVVYGGGNIHCITQQEPKR

SEQ ID NO: 83132 - protein, 215 aa, Brassica napus
EMLKPMIRSFFGENPKESGCLSRIVTKKHFQRLARLLNDPGVQASIVCGGSVDEEKLYIEPTILLDPPLDSEIMNEEIFGPILPIITLRDIQESIGFIKSKPKPLAIYAFTKDENLKTRILSETSSGSVTFNDVMIQYMCDALPFGGVGESGMGRYHGKYSFECFSHEKAIMEGSLAIDLEPRYPPWNNFKLTFIRLAFCEAYFKLVLLMLGLKR

SEQ ID NO: 83133 - protein, 365 aa, Lactobacillus sakei subsp. sakei 23K
MKTLQTSPKKDGYRMPGEFEAHKDVYLLWPERPDNWREGAKPAQATFAKVAETIAQFESVTVGVSDRQYTNARHMLADNIQVVEMSNNDSWIRDCGPTFVVNDKGDSRGVDWTFNAWGGLVDGLYFPWDKDDRVAQKVCEIEGRDRYRLDDLVLEGGSTHVDGEGTLLVTEECLLSDGRNPQLSKEQIESILKEYLNVEKIIWLKKGIYLDETNGHVDNIANFVKPGQVVLAWTDDQSDPQYAISKENYDMLINETDAKGRKLQVEKLYLPKPILITEAESQGVDTVDGTLPRLAGDRLAASYVNYYTANGGIVFPLFNDPMDEKAQEILQKLYPDRKIVGVPAREILLGGGNIHCITQQIPAGR

SEQ ID NO: 83134 - protein, 591 aa, Cucumis melo
MATKVANQPLFPMPFPAIFFIFSIFFGFGITLSQAASQTRHFKWEVEYMFRSPDCKENLVMGINHQFPGPTIRANVGDTVVVELINKLSTEDVVIHWHGILQKGTPWADGTASISQCAINPGESFTYQFVVDKPGTYFYHGHLGMQRAAGLYGSLIVDLEEGKKEPFHYDEEINLLLSDWWHESVLKQEVGLSSSPMRWIGEPQSILINGRGQSNCSIGAKYMKNMEQCKLSGSEECAPFILKVKPNKTYRIRIISTTSLSALNFAIGNHKLLVVEADGNYVQPFLTSDIDIYSGESYSVLINTDQNPSQNYWVSLGVRGREPKTPPGLTLLNYLPNSFSKLPISPPPETPKWNDYDRSKNFTYRILAAMGSPKPPVKSTRRIFLLNTQNKMNGGYTKWAINNVSLTLPSTPYLGAIKIGINDTFDQNPPPETYPENYDIHKPPPNGNTITGNGVYRFQLGEIVDVVLQNANTLNDKHSEIHPWHLHGHDFWVLGYGEGKFSAAVDETKLNLKDPPLRNTVVIFPFGWTVLRFVADNPGVWAFHCHIEPHLHMGMGVVFAEGVDKVGRIPTHAMACGGTAKALIQNPTQKP

SEQ ID NO: 83135 - protein, 543 aa, Arabidopsis thaliana
MAVSSAFVGCPKLETLLNHHNLSPSSSSSSSVSQTPLGLNGVRVLPKNNRTRRGLIQKARCELSASSDSASNAASISALEQLKNSAADRYTKERSSIVVIGLSIHTAPVEMREKLAIPEAEWPRAIAELCGLNHIEEAAVLSTCNRMEIYVLALSQHRGVKEVTEWMSKTSGIPVSEICQHRFLLYNKDATQHIFEVSAGLDSLVLGEGQILAQVKQVVKVGQGVNGFGRNISGLFKHAITVGKRVRTETNIASGAVSVSSAAVELALMKLPQSSNVSARMCVIGAGKMGKLVIKHLMAKGCTKVVVVNRSEERVSAIREEMPGIEIIYRPLDEMLACASEADVVFTSTASETPLFLKEHVENLPQASPEVGGLRHFVDISVPRNVGSCVGEVETARVYNVDDLKEVVAANKEDRMRKAMEAQTIITEESTQFEAWRDSLETGPTIKKLRAYAERIRVAELEKCMSKMGDDINKKTTRAVDDLSRGIVNRFLHGPMQHLRCDGSDSRTLSETLENMHALNRMYGLEKDILEEKLKAMAEQQQK

SEQ ID NO: 83136 - protein, 637 aa, Arabidopsis thaliana
MMMMSNLPNDLVEEILSRVTVTFMRTVRSICKKWNALTKDRSFTNKYIRNIAALGEREFLMIKEFSIYLVGVNLHGIQNNNFDLSIELKGLWFGTRIVRNQDGSNPVIIIGQLTEEKLAMLLKRWDTCEVEIWVTDKIEPDVSWSKFLKVGIKPRFDFANFVVIDVVKKVALVFDKNKAEKFQYSYNIAYIIGEKASPEELSSHRERKKRVESCLKHEKASPQGFVIGFLPKRPHTSCRDCIQSQPYGQASKAHACGNLRSCQDRLYPTISPSNQRPRTWASFLRHILISNLPDELVEEILCRAPVTSLKAMRSTCKKWYVLTKDQRFAKKRGKEFLMIMNRRVYLIGVNLHNNIDLSIKCRGRLISRDETAQGFYVSQVFHCNGLLLSVSGKTIDDTRLVVCNPYGVKPKWINPKDNYGRLDIFSLGFDKLCGSYKILRIYDFDNKLQIYDLSSNSWMIPRDTLGRDIEYMQNGVSSKENTYWCARDKQSQYCFLFCFDFTRERFGPRLPLPFNGAYVSLSAVKEEQLAVLFQPSDKSEIEIWVTNKIEPEEVSWSVFLKVEMKLRVLSWNFLIDKEKKFAVVFDKDKAKGFKTNYDIAYVIGENGYYRRVDLRESPNKPLCRIVSCYVPSCVQIE

SEQ ID NO: 83137 - protein, 472 aa, Haemophilus somnus 129PT
MSNTTAITNVFKLIEENDIKFVLLRFTDVKGKEHGVSLPVSLVDEDLFEDGKMFDGSSVEGWKAINKADMLLMPIAETAVVDPFAQIPTLSIRCSIFEPTTMQSYDRDPRSIAMRAENYMRSTGVADDVFFGPEPEFFLFDDVRFDVSMNGNSYTVDDIEAAWNTNKHYEGGNKAYRPLKKGGYCAVAPNDVAHDIRSEMCLLMEEMGLVIEAHHHEVATAGQNEIATKFNTLTLKADETQIYKYIVQNVAYEHGKTACFMPKPIINDNGSGMHCNMSLSKDGKNIFQGDKYAGLSETALYFIGGIIKHAKALNAFTNPSTNSYKRLVPGFEAPVLLAYSASNRSASIRIPAVTNPKAIRIEARFPDPLANPYLAFSALLMAGLDGIQNKLYPGDAMDKNLYDLPPEELKDIPAVASSLSEALDNLEKDYEFLTHGKVFSKEFIDTFIAMKRKEVERLNMTPHPVEFEMYYA

SEQ ID NO: 83138 - protein, 363 aa, Photobacterium profundum
MTKQLSTSPKQDGFRMPAEHEPQSAIWMAWPERTDNWRYGAKPAQATFVEVAKAIAKTTPVTMVVSAEQFENARVVLPSYIQVLEMSTDDSWMRDIGPSYVVNDHGKRRGVDWHFNALGQIGDGLYSPWDKDDAVARKVCETLGDDSYRAPIVLEGGSIHVDGEGTLYTTEECLLHPSRNPDLTREEIEDVLKVTLSIEKVIWIPQGLYNDETNGHVDNLIHVVRPGEIALTWCDDETDPQYLISRKAMDVLLTETDAKGRQIKIHKLPMPGPLYISEDEANGVDVSEGMERVPGERLAGSYANYLISNEHIIYPLLDEKHDKDVAMLLAKLYPNYEVTGVNAREILLGGGNIHCITQQIPKV

SEQ ID NO: 83139 - protein, 523 aa, Haemophilus somnus 129PT
MTNIHHHKILILDFGSQYTQLIARRVREIGVYCELWAWDVTEEQIREFNPTGIILSGGPESTTEANSPRAPEYVFNAGVPVLGICYGMQTMAMQLGGLTETSTHREFGYAEVSLRNPTALFDHLNDDATTSQTTLDVWMSHGDKVTRLPDNFQITGMTSTCPIAAMSDESRRFYGVQFHPEVTHTKCGQKLLQNFVVDICGCETNWTAENIIEDAVARIKAQVGGDEVILGLSGGVDSSVTALLLHRAIGKNLHCVFVDNGLLRLNEGDQVMEMFGDKFGLNIIRVEAEDRFLEALKGIDEPEAKRKTIGKVFVDVFDDEAKKLTDVKWLAQGTIYPDVIESAASKTGKAHVIKSHHNVGGLPDYMKLGLVEPLRELFKDEVRKIGLALGLPAEMLNRHPFPGPGLGVRVLGEIKKEYCDLLRKADAIFIEELHKADWYYKVSQAFSVFLPVKSVGVMGDGRKYDWVISLRAVETIDFMTAHWANLPYDLLGKISNRIINEVNSISRVVYDISGKPPATIEWE

SEQ ID NO: 83140 - protein, 389 aa, Sinorhizobium meliloti 1021
MFDALARQADDPLLALIGLFRKDERPGKVDLGVGVYRDETGRTPIFRAVKAAEKRLLETQDSKAYIGPEGDLVFLDRLWELVGGDTIERSHVAGVQTPGGSGALRLAADLIARMGGRGIWLGLPSWPNHAPIFKAAGLDIATYDFFDIPSQSVIFDNLVSALEGAASGDAVLLHASCHNPTGGVLSEAQWMEIAALVAERGLLPLVDLAYQGFGRGLDQDVAGLRHLLGVVPEALVAVSCSKSFGLYRERAGAIFARTSSTASADRVRSNLAGLARTSYSMPPDHGAAVVRTILDDPELRRDWTEELETMRLRMTGLRRSLAEGLRTRWQSLGAVADQEGMFSMLPLSEAEVMRLRTEHGIYMPASGRINIAGLKTAEAAEIAGKFTSL

SEQ ID NO: 83141 - protein, 291 aa, Brassica napus
MAENGSLDQFLAAAVDAAQKAGQVIRKGFYETKHVEHKGQVDLVTETDKGCEELVFNHLKQLFPSHKFIGEETTAANGVTELTDEPTWIVDPLDGTTNFVHGFPFVCVSIGLTIGKVPVVGVVYNPIMDELFTGVQGKGAFLNGKPIKVSTQSELVTALLLAEAGTKRDKATLDDATNRINSLLTKVRSLRMGGSCALDLCGVACGRGDIFYEIEFGGPWDVASGVVIVREAGGLIFDPSGKDLDITSQRVAVSNASLKELLSEGVAAYKCVKSSLLLLWSHLMNSFNNHI

SEQ ID NO: 83142 - protein, 357 aa, Oceanicola granulosus HTCC2516
MIGVLALAGALWGVATLAGAPRAARVAMVGLLLVAVLALQVVLPEGHVLREATGGSAARWLVLLGVLALGAGYWRFVALLKGRARSGTAEAEVAAAAAPGTFGETELRRYARHMVLREIGGPGQKALARARVLVVGAGGLGAPALQYLAAAGIGTIGVIDDDVVEGSNLQRQVIHGDDDIGRAKVFSAADAMTRLNPFITVRPYNRRLTEEIAAELIGEYDLVLDGSDNFATRYLVNAAAAAAKVPLVGGALSQWEGQLSVWDPARGAPCYACVFPEAPAAGLAPSCAEAGVLGPLPGVVGAMMSVEAVKLLAQAGESLRGRLMIYDALYAETRTIAVAPRPGCAVCAPLQGQADGS

SEQ ID NO: 83143 - protein, 290 aa, Glycine max
  misc_feature (138)..(138): Xaa can be any naturally occurring amino acid
  misc_feature (167)..(167): Xaa can be any naturally occurring amino acid
TLHHDIISSPWFDLRVFYVRVCGIQVDESTPEFLSLNHIPLSPDTLLEVNGVRRSIYSDGEESSVLRRDRVDKKSEEATFVNTDSIRFTGSMKFEVYDKEHCILSGVLETSNSNGFVGESRSGVKRWSMNCQTEMSPXCGFFKGKHVAVPELPCPEIEVYVAGCFSXTPIILTKTLQLNCRKKHNRKCALDSIPEYETTECQKDVSDHGLDLQVVDCRSFKLEQEEDYNSMYWPRTVYVDGEDGELSWFNAGVRVGVGIGLGIFVGVGIGVSLLGRSYQATIRNFKRRFI

SEQ ID NO: 83144 - protein, 337 aa, Phanerochaete sordida
MPVKAGINGFGRIGRIVLRNALLHGDIDVVAVNDPFIDLDYMVYMFKFDSVHGRYKGSVEAKDGKLWVEGKPITVFSEKDPSNIPWGSVGAEYIVESTGVFTTTEKASAHLKGGAKKVIISAPSADAPMFVCGVNLESYDSKYTVISNASCTTNCLAPLAKVVHDKFGIVEGLMTTVHSTTATQKTVDGPSNKDWRGGRSVGNNIIPSSTGAAKAVGKVIPSLNGKLTGLSFRVPTVDVSVVDLVVRLEKSASYDEIKAALKEASETTHKGIIGYTDDKVVSTDFLGNDNSSIFDAEAGIALNKNFVKLISWYDNEWGYSRRVCDLLAYAAKVDGAL

SEQ ID NO: 83145 - protein, 496 aa, Burkholderia xenovorans LB400
MAGVKELQAFPMVIGGERVPSASGVWLESIDPYTGEPWAKVPRGDATDAEAAVSAARKALTTGAWHQLSATQRGALLRRLADLISRDWERLAEIEIRDNGKVISEVGPQIRYLAQYFHYYAGLADKIEGAVIPVDRPGMLNYTRHEPVGVVVAITPWNSPLMLASWKIAPALAAGCTVILKPSEHTSVSSLVFSDLFDEAGFPPGVVNVVTGFGAEIGNALVSHPDVAKVAFTGGDVAGQAVYERAAAGLKRVTLELGGKSPHIVFDDADLDGALAAAMDGVFSSSGQMCVAGSRLMLHDRIHDEFVARLLDRVRTLKLGAPMNPATSIGPVTTQAQFERILSYIDVAKQEGARCLVGGVASPEAEGGSGWFVAPTVFGDVKNDMRIAREEVFGPVLSIIRFSTDDEAVHLANDSRYGLASGIWTRDVGRAISVADRIQAGTVWVNTYRAVSAASPFGGMKRSGIGRENGQEAIMGFLQTKSIWISTTSRPVAAWS

SEQ ID NO: 83146 - protein, 236 aa, Trichodesmium erythraeum IMS101
MTTTEKKPIVISPSILSADFSRLGDEVRAVDQAGADWIHIDVMDGRFVPNITIGPLIVKALRPVTKKPLDVHLMIVEPEKYVEDFAKAGADIISVHAEHNASPHLHRTLGQIKELGKQAGVVLNPSTPLELIEYVLDLCDLVLIMSVNPGFGGQSFIPTVISKIRKLREMCDARGLNPWIEVDGGLKTDNTWQVLEAGANAIVAGSAVFKANDYAEAINGIRNSKRPVPQPQLATV

SEQ ID NO: 83147 - protein, 520 aa, Sinorhizobium meliloti 1021
MTQTAHPDTVLIVDFGSQVTQLIARRVRESGVYCEIVPFQSAEEGFHRLKPKAVILSGSPASTLDTGSPRAPSVIFDSGLPVFGICYGQQTMCAQLGGKVESGHHREFGRAFLEVEKDCPLFDGLWSLGSRHQVWMSHGDRVTALPEGFEVVATSSNAPFAFIADEKRKYYAVQFHPEVVHTPDGAKLIANFVHKIAGITGDWTMSAYRAKAVEAIRKQVGDKKVICALSGGVDSSVAALLIHEAVGDQLTCILVDHGLMRKDEAANVVAMFKEHYNLHLLHIDASDRFIGELEGVSDPETKRKIIGRLFIEVFEEEAKKLGGADFLAQGTLYPDVIESVSFTGGPSVTIKSHHNVGGLPERMNMQLVEPLRELFKDEVRVLGRELGLPESFIGRHPFPGPGLAIRCPGGITREKLEILREADAIYLDEIRKAGLYDAIWQAFAVLLPVQTVGVMGDGRTYEFVCALRAVTSVDGMTADFYHYDMEFLGRAATRIINEVRGINRVVYDVTSKPPGTIEWE

SEQ ID NO: 83148 - protein, 402 aa, Streptomyces avermitilis MA-4680
MEFRQSSKLSEVCYEIRGPVIEHANALEEAGHSVLRLNTGNPALFGFEAPEEILQDMIRMLPRAHGYTDSRGVLSARRAVAQRYQDRGLEVDVDDVFLGNGVSELVSMAVQALIEDGDEVLIPAPDFPLWTAVTTLAGGKAVHYLCDEQADWYPDLADMAAKITDRTRAVVIINPNNPTGAVYPKEIVEGILDLARRHGLMVFADEIYDQILYDDAVHHSAAALAPDLVVLTFCGLSKTYRVAGFRSGWLVVTGPKQHARSYLEGLTMLASMRLCANAPAQYAIQAALGGRQSIQELTAPGGRLYEQRDRAWQKLNEIPGVSCVKPKGALYAFPRIDPTVHKIHDDEKFVLDLLLREKIQVVQGTGFNWPRPDHFRILTLPHADDLDAAISRIGRFLSGYRQ

SEQ ID NO: 83149 - protein, 212 aa, Oryza sativa
MKFVVSCRENGLSKGYKVEEEHKWGQVIDLKIGAEFDGEKILGEAYKGYVLRVSGGSDENGFAMKNGVLKKGRARLLIPPNTCGLRFGRDGERKRRSVRGCIIDRDIGAVHCTIVSKGAAEIAGLTDVKTPRRLGPKRANKIRKLFGLPKHSDKIGSRTRPRLLLTASIPGKTVGDKQYYKAPKIQRLITSQRLKRKREHKKDKKQNVAHNA

SEQ ID NO: 83150 - protein, 297 aa, Antirrhinum majus
MAHGLTHFNTKSGLFPSITKSKTTRPSTRPVILAMTRTQTYRATIESDIESYLKKAIPIRAPESVFEPMHHLTFAAPRTSASALCVAACELVGGDRSDAMAAAAAVHLMHVAAYTHENLPLTDGPMSKSEIQHKFDPNIELLTGDGIIPFGLELMARSMDPTRNNPDRILRAIIELTRVMGSEGIVEGQYHELGLNQLNDLELIEYVCKKKEGTLHACGAACGAILGGCDEDKIEKLRRFGLYVGTVQGLLGKNRSGFEGRIKELKELAVKELESFGGEKIELIRGVFELEHSLAGV

SEQ ID NO: 83151 - protein, 198 aa, Caulobacter crescentus CB15
MILVIDNYDSFTYNLVHYLNELGADTAVYRNDALSVTEALGLKPAAVLLSPGPKAPDQAGICLPLLEAAPADLPILGVCLGHQAIGQAFGGEVIRAKAVMHGKVSKVRHNDKGIFKGLPNPFTATRYHSLAVRREDLPADLEVTAWTDDGEIMGVQHKTRPIFGVQFHPESIATEGGHQMLANFMDLAGVKRDAAIWV

SEQ ID NO: 83152 - protein, 333 aa, Vitis vinifera
  misc_feature (133)..(133): Xaa can be any naturally occurring amino acid
MVKAIRVYELGGPEVLKWEDVQIGEPNEGEIRVKIQAIGLNFVDVYIRKGVYKIATMPFTPGVEAAGVVTAVGPGITGWKVGDVVAYAGGSMGSYSEEQILPANKVVPLPPSINPTVGASIMVKGMTVHYLVXCCFKVEPGHIVLVHAAAGGVGSLLCQWANALGATVIGTVSTNEKAVQAKEDGCHHVIIYKEEDFVARVNEITSGNGVHVVYDSVGKDTFQGSLACLRPRGFMVNFGQSSGTPDPVPLPSLGAKALFLTRPSLMHYSATRDDLLEAAGEVFANVASGVLRVRVNHKYPLSQAAQAHADLESRKTSGSVVLIPDCLWQDILN

SEQ ID NO: 83153 - protein, 372 aa, Antirrhinum majus
MSLVNPITTWSTTTTSKSPKNVQTTTRSRSIILPHKISLFPSNPKSKSKTHLRFSISSILTKNPQESSQKTSKDPTFTLDFKTYMLEKASSVNKALEQAVLLKEPLKIHESMRYSLLAGGKRVRPMLCIAACELVGGLESTAMPSACAVEMIHTMSLIHDDLPCMDNDDLRRGKPTNHKIYGEDVAVLAGDALLAFSFEHVAKSTKGVSSDRIVRVIGELAKCIGSEGLVAGQVVDISSEGMTEVGLEHLEFIHVHKTAALLEASVVLGAIVGGADDEDVEKLRKFARCIGLLFQVVDDILDVTKSSQELGKTAGKDLVADKTTYPKLLGIEKSREFAEKLNREAQEQLEGFDSVKAAPLIALANYIAYRDN

SEQ ID NO: 83154 - protein, 187 aa, Escherichia coli O157:H7 EDL933
MSLINTKIKPFKNQAFKNGEFIEITEKDTEGRWSVFFFYPADFTFVCPTELGDVADHYEELQKLGVDVYAVSTDTHFTHKAWHSSSETIAKIKYAMIGDPTGALTRNFDNMREDEGLADRATFVVDPQGIIQAIEVTAEGIGRDASDLLRKIKAAQYVASHPGEVCPAKWKEGEATLAPSLDLVGKI

SEQ ID NO: 83155 - protein, 380 aa, Picea sitchensis
MASPLSPQTITCKAAVAWGPGEPMSIEEVQVAPPQPMEVRIKVVATTICRSDITLWESRGHIPIFPRIFGHEATGIVESVGEGVTDLREGDHVLTVFQGECKKCRHCKSDKSNACETLGVEGNGLMHSDQKTRFSINGKPIYHFVGVSSFSEYTVVHSECVVKLSPDVPLGKISVLGCSVATGFGAAWKIANVGKGSTVVIFGLGAVGLAVAQGAKLRGASRIIGVDINPDKFERGKIFGVTEFINPNDYKQPTQEVVKEITTGGADYCFECVGNVELMRTALESCCDGWGMAVLIGVPSGKMELSAHYGPLLNGRTLKGTLLGGWKTRSELPMLVEMYMKKEIQIDEYVTHELPFADINKGYQLMKEGKCLRCVLHVGI

SEQ ID NO: 83156 - protein, 712 aa, Actinobacillus pleuropneumoniae serovar 1 str. 4074
MSRTIILIPTTTGVGLTSVSLGLVHALEQKGSKVGFLKPIAQPISGEDTLDRSTSIIRSAQTTEVGEPFMLSEAEALIGQNQSDVLLEKVVERHQQLSKNNEIVVVEGLIPTRKNSYANSVNYDIAQALDAEIILVAAPGSDKPTQLKERVEAAASEFGGRHNPNLLGVIINKFNAPVDESGRTRPDLTEIFDSFQHSTQNIAEVEALFAKSPIKLLACVEWKSDLIATRAIDLAKHLRAAIINEGELQTRRIRGVTFCARSLPHMVDHFKAGSLLVTSADRPEVLVAASLAVMNGVEIGAILLTGGYKIETPIAKLCQQAFESGVPVFRVEGNTWQTALNLQSFSLEVPADDKERISSIKEYVASQFNHGFIDEISKAATRARRLSPAAFRYQLTEYARQAKKRIVLPEGDEPRTVKAAALCAERGIAECVLLANPTDVQRVAESQGVVLGKGITIINPEEVRENYVARLVELRKNKGMTEVVAREQLTDTVVLGTMMLEAGEVDGLVSGAVHTTANTIRPPMQIIKTAPGSSIVSSIFFMLLPDQVLVYGDCAVNPDPTAEQLAEIAIQSAESAKAFGIDPRVAMISYSTGTSGSGADVEKVKEATRIAQEKRPDLIIDGPLQYDAAVMEDVARSKAPNSPVAGKATVFVFPDLNTGNTTYKAVQRSADLVSIGPMLQGMRKPVNDLSRGALVDDIVYTIALTAIQATQG

SEQ ID NO: 83157 - protein, 412 aa, Escherichia coli O157:H7 EDL933
MKALTYHGPHHVQVENVPDPGIEQADDIILRITATAICGSDLHLYRGKIPQVKHGDIFGHEFMGEVVETGKDVKNLQKGDRVVIPFVIACGDCFFCRLQQYAACENTNAGKGAALNKKQIPAPAALFGYSHLYGGVPGGQAEYVRVPKGNVGPFKVPPLLSDDKALFLSDILPTAWQAAKNAQIQQGSSVAVYGAGPVGLLTIACARLLGAEQIFVVDHHPYRLRFAADRYGAIPINFDEDSDPAQSIIEQTAGHRGVDAVIDAVGFEAKGSTTETVLTNLKLEGSSGKALRQCIAAVRRGGIVSVPGVYAGFIHGFLFGDAFDKGLTFKMGQTHVHAWLGELLPLIEKGLLKPEEIVTHYMPFEEAARGYEIFEKREEECRKVILVPGAQSAEAAQKAVSGLVNAMPGGTI

SEQ ID NO: 83158 - protein, 601 aa, Arabidopsis thaliana
SVLAEEILKRLDLENLCSVACVSTTLRSAVVSGVLPSLTSLDLSVFSPDDETLNHVLRGCIGLSSLTLNCLRLNAASVRGVLGPHLRELHLLRCSLLSSTVLTYIGTLCPNLRVLTLEMADLDSPDVFQSNLTQMLNGCPYLESLQLNIRGILVDATAFQSVRFSLPETLKALRLQPLLESEAILLMNRFKVTGTYLSQPDYNSALLSPSPSFTLQSLSLVLDLISDRLIIAITGSLPQLVKLDLEDRPEKEPFPDNDLTYTGLQALGFCQQLTSLSLVRTCYNRKISFKRINDMGIFLLSEACKGLESVRLGGFPKVSDAGFASLLHSCRNLKKFEVRGAFLLSDLAFHDVTGSSCSLQEVRLSTCPLITSEAVKKLGLCGNLEVLDLGSCKSISDSCLNSVSALRKLTSLNLAGADVTDSGMLALGKSDVPITQLSLRGCRRVSDRGISYLLNNEGTISKTLSTLDLGHMPGISDRAIHTITHCCKALTELSIRSCFHVTDSSIESLATWERQAEGGSKQLRKLNVHNCVSLTTGALRWLSKPSFAGLHWLGMGQTRFAGRKETVTAMICGQRPWLTLCFDGCELGCSDGWEFHTPQRH

SEQ ID NO: 83159 - protein, 307 aa, Mycobacterium avium 104
MSLEPQIAAIIEQLDSGFPPVQQMSGAEARALIRSRLVPPAQPEPVAEVADRLVEGPGGPLRIRVYRPEAAAPLPALVYAHGGGFVFCDLDSHDGLCRNLANLVPAVVVSVDYRLAPENAWPAAAEDVYAATCWARDHADALGADPARLVVGGDSAGGNLAAVTTVMCRDRGGPAPAAQLLIYPVIAADFDTESYRLFGQGYYNPAPALRWYWDCYVPSTRDRAHPYATPLNADLRGLPPAVVVVAGHDPLRDEGLAFGAALEAAGVPTVQLRYEGGIHGFMTMPMLDIAHRARNEAAAALADLLRR

SEQ ID NO: 83160 - protein, 487 aa, Escherichia coli O157:H7 EDL933
  misc_feature (415)..(415): Xaa can be any naturally occurring amino acid
MSLAKDNIWKLLAPLVVMGVMFLIPVPDGMPPQAWHYFAVFVAMIVGMILEPIPATAISFIAVTICVIGSNYLLFDAKELADPAFNAQKQALKWGLAGFSSTTVWLVFGAFIFALGYEVSGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGIQISWLQWFLCFLPVGVILLIIAPWLSYVLYKPEITHSEEVATWAGDELKTMGALTRREWTLIGLVLLSLGLWVFGSEVINATAVGLLAVSLMLALHVVPWKDITRYNSAWNTLVNLATLVVMANGLTRSGFIDWFAGTMSTHLEGFSPNATVIVLVLVFYFAHYLFASLSAHTATMLPVILAVGKXIPGVPMEQLCILLVLSIGIMGCLTPYATGPGVIIYGCGYVKSKDYWRLGAIFGVIYISMLLLVGWPILAMWN

SEQ ID NO: 83161 - protein, 438 aa, Mycobacterium avium 104
MPAAKAGLTPEQISAIDAAHLWHPYSTIGAESVAPVVAVGARGAWLTLIRDGAEVRALDAMSSWWTAIHGHGHPVLDAALSDQLAAMNHVMFGGLTHEPAARLAQLLVSITPAGLDTVFFSDSGSVSVEVAVKMALQYWRSRHRPAKHRLMTWRGGYHGDTFTPMSVCDPEGGMHSLWTDILARQVFAPQVPRDYDPAYSAAFEAQLARHADELAAVIVEPVVQGAGGMRFHDPRYLRDLREACTRHDVLLIFDEIATGFGRTGELFAADHARVSPDIMCVGKALTGGYLSLAATLCSTDIAQAISAGEAGALMHGPTFMANALACAVSVASVEVLLGQDWRSRVAEISAGLAAGLEPARELPGVTDVRVRGAIGVIECDRPVDLAVATPAALDHGVWLRPFRNLIYAMPPYICPPDEIARIASAMVQVAARLGSRRL

SEQ ID NO: 83162 - protein, 430 aa, Zea mays
MDQYEVLEQIGKGAFGSALLVRHKLERKKYVLKKIRLARQTDRTRRSAHQEGCYVCIVIGYCEGGDMAEAIKRANDTHFSEEKLCQWLVQLLMALDYLHAHHILHRDVKCSNIFLTRDQNIRLGDFGLAKILTADDLASSIVGTPSYMCPELLADIPYGTKSDIWSLGCCMYEMAALKPAFRAFDMQNLINKITKSIVSPLPTRYSGAFRRLVRSMLRRSPEHRPSAAELLKHPHLEPYVLQLHLKSHLSRSIVPVHQSPSEKRMTFAAEPVCRSKGRRNSLGSERMIAAFSKPSPDRSSVSSIRSVKDEYTATQSVRELSVDDSMVEVASKPVASRTSDVMRTPKATPWKMMTTLRNRLEAPQASYDHTEQFSRTPVDKRNSRVARRASLPLPVFETPILPGSPCHQINPVLVVAPRFILLLCYQFLVS

SEQ ID NO: 83163 - protein, 473 aa, Opitutaceae bacterium TAV2
MLTSITRAKSAACTSQSGTMALNTPALLSNRSGAPSVARSVSAHTSTLLGSDTSSTSKRCGAPCAKRRSSTPSAERPQPTTMCPSRMNSSANALPSPRVTPVMMIFFVFSVLLMRGTITPFARRVNPKGRLPKANFALVAPRAAPYAWSLPFMKHFLKETDFTPQEAAEVFALARDLKQKRGTSATPAVLQYQTWALIFSKSSTRTRVSFEVGVHELGGNPLFLNKGDIQLGRGESVEDTARVLSRFVHGLIVRTYAHSEVERLAASGTIPVINALTDFLHPCQIYTDAFTMAERWASANGDLFASLKGRKIAFLGDTACNMANSWILGANLFGMDISLAGPKGFEPSAEFNTLLAAESKRLGLAGRYQFTHDPCEAVKNADVVYTDVWVSMGKEDEAKERIAQMSPYSVTAKLFAAAKSDALFMHCLPAYVGKEVTQEVLDNPRSIIFDQAENRLHTQKAIMTVLARHARHP

SEQ ID NO: 83164 - protein, 300 aa, Nicotiana tabacum
LCGPISGMIVQPVVGYYSDNCSSRFGRRRPFIAAGAALVTIAVFLIGFAADLGHASGDPLGKGSKPRAIAVFVVGFWILDVANNMLQGPCRALLADLSGGKAGRMRTSNAFFSFFMAVGNVLGYAAGSYSRLYKIFPFSKTPACDIYCANLKSCFFIAVFLLLSLTILALTVVRENELPEKDEHEIDEKAGGGGKSKVPFFGEIFGALKDLPRPMWILLLVTCLNWIAWFPFFLYVTDWMAKEVYGGKVGDGRLYDLGVHAGALGLLLNSVVLGFMSLSVEFLGKKIGGVKRLWGILNFV

SEQ ID NO: 83165 - protein, 1435 aa, Oryza sativa
  misc_feature (12)..(12): Xaa can be any naturally occurring amino acid
  misc_feature (35)..(35): Xaa can be any naturally occurring amino acid
  misc_feature (75)..(75): Xaa can be any naturally occurring amino acid
WTRGSCCLTESXALPASLHKNSRKSRPLPKSHHRXKSIHESLPHSNCLPPPSKSNLSSPLRRFRHALSTPRSILXPPIRSNPQLGSTNCKGLGVDWSMALRSPNSMLWLALLVWAALLCGSCHGRFVVEKNSLKVTSPSDMKGTYECAIGNFGVPQYGGTMVGVVAYPKANKKACKSFDDFDISYKAKPGSLPTFLLVDRGDCFFTKKAWNAQNAGAAAILVADDKTEPLITMDTPEESGNTDYLENITIPSALITKSFGDKLKKAIDNGDMVNVNLDWRESLPHPDERVEYEFWTNSNDECGPKCDSQIEFVKSFKGAAQVLEKKGYTQFTPHYITWYCPDSFILSKQCKSQCINHGRYCAPDPEQDFSKGYDGKDVVVQNLRQVCVYKVAKEHGKPWLWWDYVTDFAIRCPMKEKKYTKECADGVIKSLGLDHKAIDKCIGDPDADKENPVLKAEQDAQIGKGSRGDVTILPTLVINNRQYRGKLDKGAVLKAICAGFRETTEPAVCLSEDIQTNECLENNGGCWQDKAANISACKDTFRGRVCECPVVKGVKFVGDGYTHCEASGSGRCEINNGGCWKDSRHGRTYSACTNDGCKCPDGFKGDGVHKCEDIDECKERTACQCKECKCKNTWGSYECGCSGGLLYMKEHDTCISKNAATEVGWNFLWVIFFGLVVAGIAGYAVYKYRIRFCLVLAEKEKSGIPNINWLRDRLFRSIRRRRRRGALAPLAPTLTTAIAMPSCFTLDSASDDGRSTAQGQGWPAGVGGFLSGFFSAGAARADGGKPSPDWDAHGLAASALPVPLSRLDGKKRYKGAVRDELDALATSGMFDHVTLQTKPKPDGTLGLTVSYAETEWPAVEHFKCINVGGPMARPDGDELELDDDMTARERMEHLRRQEREYQQLVRRAKPCVLPEKLQRELQGMVKRQRKVSSGLLKRMAGRIERWYHDEGFHCAQVVSYHGNLDAGEVVCEVVEGDITKVEYQFLDKLGNVVDGNTSIPLIDRELPQQLRPGHIYNNGAGKQALKNIDSLGLFSTIEVQPRPDETNQGGVIVAIKLKEHDPKSAQVITDWSIVPGSQGRPTLASIQPGGTVSFEHRNICGLKRSLIGSVTSSNLLNPEDDLSFKLEYAHPYLDGIDNLSRNRTFKISCFNSRKLSPIFVAGPNMYEAPPIWVDRIGFKANITESFTKQSKFTYGLIVEEITTRDENNNICTHGSRQLPSGALSMIGPPTTLSGTGVDRMAFLQANITRDNTEFVNGATIGDRCIFQMDQGLGIGSKNPFFNRHQLTVTKFINLNKQEKGSRKPPPAVLALHGRYAGCVGDLPSYDAFALGGPHSVRGYGMGELGASRNLLEVATELSVPITVKNRHTQVYAFAEHGTDLGSSKDVEGNPTEFFRRVGHGSSYGVGVKLGAVRAEYAVDHNAGTGAFFLRFGERF

SEQ ID NO: 83166 - protein, 168 aa, Zea mays
  misc_feature (105)..(105): Xaa can be any naturally occurring amino acid
DWDRTSLARLGSTWVRHDTVLAGSAGMVLVLTELATLSYTPSGSAKWMKHPLSLPSKPRSPILASDAVFALCDVGTLWRSQWKLFSCPLAMLTGGWAPVERAAWXDVFEVLKRPRLLAGASGRRVLMIGGLRSSFAMDAPCSTVLILHLDLATIEWEEARRMPPNMYR

SEQ ID NO: 83167 - protein, 421 aa, Symbiodinium muscatinei
MPSAVENVALLFGGAVATTALSSAFVASGPVAQEAKTGLRAAGYAKSSQSSSQSMGAMAGVGAVAGLAVAGVAGRRAGKNRTSMEAVGVGINGFGRIGRQVARIAMKDPETELKLINASYDSDYLAYMMKYDTIHGKYDGTVEADGDSLIVDGEKIALSHTRDPAEIPFGEHGAEYVCESTGVFLTTEKVQGHLKAGAKKVIFSAPAKDDSHTIVMGVNEDTYDPSMECVSCASCTTNGLAPAVRVLQEKWGIKRGLMTTCHAMTASQPTVDGTSKKDWRGGRAGPGNIIPSSTGAAKAVAKVIPDVKGKLTGMALRVPTIDVSVVDLTVELEKETTYEEICAEMKKRSEGDMKGFLGYTDEALVSTDFETCPISCTFDAKAGIMLDPTFVKVVCWYDNEWGYSSRVVDLIKHMAAEDAKA

SEQ ID NO: 83168 - protein, 347 aa, Symbiodinium muscatinei
MATKIGINGFGRIGRMVFQAICDQNLLGTKLDVVGVVDMSTDAEYFAYQMKYDTVHGRFKHEVKIGEKDELIVNGHKIKCIQASREGPKALPWKDMGVEYVIESTGLFVEAEKAAGHIEAGAKKVIISAPGKGDLKTLVCGVNHTEYDKANHNVVSNASCTTNCLAPIVHVLLKEGVGIEKGLMTTIHSFTATQKTVDGVSAKDWRGGRGAACNIIPSATGAAKAVGEVLPTTKGKLTGMAFRVPTPDVSVVDLTFTAEKDTSIEEIDALFKKASETYMKGVLSFTDEELVSSDFIHNVNSSIYDSKATLQNNLKGEKRFFKIVSWYDNEWGYSNRVVDLLMHMISA

SEQ ID NO: 83169 - protein, 371 aa, Selenomonas ruminantium
MMIKDSTPKADGFYMPAEFSPHAGTFLIWPVRPGSWTNAGADVQPVFVELIREISAVEELYLLVDEAHRPQAENMLKDLPQQHIHYLAIPTDDAWARDMGPTYVIDGQGRRRGINWRFNAWGGDFDGLYPDYGQDDAAAEKMCAALGDELYDAGDFVLEGGSIHVDGEGTVVVTEACLLSQGRNPDLSKEQIEAMLLKYLGAEKVIWLPRGIHNDETNEHVDNVFAFVRPGEVLLAWTDDKDDPQYELSQADLEVLESATDARGRKFVIHKLPIPQEPVCITAEEADSFTFEEGEDRREPGERLAASYVNFYLCNGKVILPQFGDEMDIEAQRILGKCFPERKVVPLPAKAVIVGGGNFHCLTQQIPAIER

SEQ ID NO: 83170 - protein, 408 aa, Arabidopsis thaliana
MEPLISPQPRFRLQPIPENPSSSSSSASITIPRSISNTSFFHEISQERLLLHHQDLEQSVQDDKEDQDSDSDETNRFLSQTRPLHRSRTAPAMVIIKDLRTKPPETKKPSPVSKSIIRQAIFLLIVYLTLGVSIYSFNRDHYSGIETHPVVDALYFCIVTMCTIGYGDIAPLTPWTKIFAVVFVLFGFGFLDILLSGVVNYVLDLQESMILTGIQTRQHHQHHHHHRFSAKDYIIDFEKGRMRIRMKVCLALCVVVLCIGVGALVLHFVEELGFVDSVYLSVMSVTTVGYGDRAFKTLQGRLFAAVWLLVSTLAVARAFLYLAEARIDRRHRKAVKLALNREITVDDLLKADTYQHGFISKSEYIVLKLKEMGKITQKDIDQVVIQFEKLDPNQIGKITLPDLLGDPL

SEQ ID NO: 83171 - protein, 370 aa, Shewanella oneidensis
MTNVNVDVTPLTTKPSQDGFYMPAEWAAQQAVWMIWPYRPDNWRAAGAYAQATFAKVVDAIGAATPVYMGVPKAFLAKAKTVMPSHVTLVEMDSNDCWARDTGPTVVVNAEGECRGVDWGFNAWGGHNGGLYFPWDKDEQVAQQMLAQHGFARYRAPLILEGGSIHVDGEGTCMTSAECLLNANRNPELTKEQIEGLLRDYLNVKQFIWLQDGVYMDETDGHIDNMCCFARPGEVILHWTDDESDPQYPRSKAALEVLQNTVDAQGRKLKIHLLPQPGPLYCSEEESKGVTEGTGVPRTAGERLAGSYVNFLITNHRIVFPLLDPATDDIAAQKLQEIFPEHEIVGVPAREILLGGGNIHCITQQIPAGK

SEQ ID NO: 83172 - protein, 776 aa, Alkalilimnicola ehrlichei MLHE-1
MSDNFRDNALEYHEFPRPGKLQVVPTKPLANQRDLALAYSPGVAAACEEIVNDPQAASKYTARGNMVAVITNGTAVLGLGNIGPLASKPVMEGKGVLFKKFAGIDVFDIEINEQDPDKLTEIIASLEPTFGGINLEDIKAPECFQVESALRKRMNIPVFHDDQHGTAIITAAAVLNGLRVVDKKIEDVKLCCSGAGAAAIACLDILVSMGMNKENIFVADSKGIVYKGRKEYMDERKEGYARETSARTMKEVIEGADIFLGLSAPGVLSQAMVKQMADSPIIMALANPVPEILPELAKEARPDAIIATGRSDYPNQVNNVLCFPFIFRGALDVGATTINEEMKLAAVYAIADLAMAESSDVVTAAYGGKSLRFGPEYLIPRPFDPRLILKIAPAVARAATESGVATRPIEDFDAYHMELSQFVFQSGLVMKPIFERARTNPKRVVYTDGEEERVLRAVQVVVDDGLAKPILVGRRKVVEMRIKRLGLRLEIGKNVDLADPEDDPRYREYWQLYHSIMERRGVTPARARTIVRTRTTVIGALMVRRGEADALVGGSVGRYHRQIGHIENVIGRRAGVRNMAAMNVLILPKGTFFIVDTYVNHDPNAHQIAEMTTLAADEVRRFGITPKVALLSHSSFGTSNAESARKMRDALQLIRDADPGLDVEGEMHGDAAVSEEIRKRIFPNNELKGQANLLVMPTLDAANIAFNLLKVTTDGVSVGPILLGSARPAHILTPSSTVRAIVNMSALAAVEATMAEPEATHDEERDYSGYEDEEDV

SEQ ID NO: 83173 - protein, 527 aa, Arabidopsis thaliana
MGQAPSSTAESNGRELDLRLWSPVIVAGGESMAVGNVVDRDFTGDLPDECLAHVFQFLGAGDRKRCSLVCKRWLLVDGQSRHRLSLDAKDEISSFLTSMFNRFDSVTKLALRCDRKSVSLSDEALAMISVRCLNLTRVKLRGCREITDLGMEDFAKNCKNLKKLSVGSCNFGAKGVNAMLEHCKLLEELSVKRLRGIHEAAELIHLPDDASSSSLRSICLKELVNGQVFEPLLATTRTLKTLKIIRCLGDWDKVLQMIANGKSSLSEIHLERLQVSDIGLSAISKCSNVETLHIVKTPECSNFGLIYVAERCKLLRKLHIDGWRTNRIGDEGLLSVAKHCLNLQELVLIGVNATHMSLAAIASNCEKLERLALCGSGTIGDTEIACIARKCGALRKFCIKGCPVSDRGIEALAVGCPNLVKLKVKKCKVVTGEIGDWLREQRRTLVVSMDGDETEAVVVVDGEVETIVEEPRVAQAGGIVAEIGSSNGGGGSRLAMIRSKLGFLAGRNLVTCTFRRWSHNDNASSST

SEQ ID NO: 83174 - protein, 295 aa, Triticum aestivum
EDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPTMPVLSVVIPRLKTNQLKWSFTGAFEARQSLIVRGLFPMLADPRHPAESTSTTNESVLKVALDHGKASGVIKSHDRVVVCQKVGDSSVVKIIELDD

SEQ ID NO: 83175 - protein, 500 aa, Vibrio sp. Ex25
MFSLLILLVTINLRGVLVGVSLMMQQIKNETLKSVFKQWSSEEGIVVINPATEQELVRLKPSSLEELDTLIGQCKTEQVRWAKLSAKERSRRLKKWYQLLLDNAEDIATIITLEQGKPLTESKGEVMYGASFVEWFSEEAKRAYGEVIPAPTTDRRLSAIRQPVGVCAAITPWNFPIAMITRKAAPALAAGCGMLIKPSELTPLTAIAVVELAYQAGIPKELLPVVVSEQAAEFGQVLSTDPRIKKVSFTGSTRVGKILMKQASDSVKAVSMELGGNAPFIVFDDADLDAAAEGLVASKFRNAGQTCVCTNRLYVHEDVKQAFIEKVLSKLNKLQLGNGLEKGVTLGPVITMASKHRLEAVIDQAVQEGASIANSPQRRSGRFMEPVLLDSVKQYMSIVQQELFGPVLPIITFENDEQVLGMANDTEYGLACYFYTNNFKRIVAFSEGLEYGMVGVNEGIISTEVAPFGGVKESGVGREGAKQGLDEYLETKYICLGGLS

SEQ ID NO: 83176 - protein, 472 aa, Arabidopsis thaliana
MAMEKDLSPNSPRIRKLRDTSYPTTPTSRMNTNNQRDNHYPNIPNSPRDYNYTPSSPTARIRHRRRSSENLAEVNRSNVSRVSNLLLGDKNKYRSMWIRTCSSLWMLGGVVFIIYMGHLYIWAMVVVIQIFMAKELFFLRRRAHEERRLPGFWLLNWHFFFTAMLFVYGRIIQQQLVNTVSSDRFIYKLVSGLIKYQMVICYFLYIAGLIWFILTLKNKMYKYQFGQYAWTHMILIVVFTQSSFTVANIFEGIFWFLLPAALIAMNDVAAYFFGFYFGKTPLIKLSPKKTWEGFIGASVATIISAFIFANVLGQFQWLTCPRKDLSTGWLHCDPGPLFRPEYYPFPSWITPFSPWKGISTLPVQWHAFSLGLFASIMAPFGGFFASGFKRAFKIKDFGDSIPGHGGFTDRMDCQMVMAVFAYIYIQSFIVNRDYSVEMILDQISRSLGHEEQKMLYEKLGDILQHKLQGRFG

SEQ ID NO: 83177 - protein, 82 aa, Triticum aestivum
  misc_feature (66)..(66): Xaa can be any naturally occurring amino acid
TAAYPIRIDRWIRRSSYSPCSSRRTPPTSPQQRRRNLNNKRISQEVVGDLMGEEFKGYIFKIMGGXDKQGFPMKQGVLTSGR

SEQ ID NO: 83178 - protein, 386 aa, Microcystis aeruginosa PCC 7806
MKAMILAAGKGTRVRPITHTIPKPLIPILQKPVMEFLLELLRQHGFDQIMVNVSHLAEEIESYFRDGQRFGVHIGYSFEGRIEEGELIGDALGSAGGLRRIQDFNPFFDDTFVVLCGDALIDLDLTAAVKWHREKGAIATIVTKTVPKEEVSSYGVVVSDEEGRILSFQEKPAIDEALSTCINTGIYIFEPEIIDFIPPNSKYDIGGELFPQLVAKGAPFYALNMDFEWVDIGKVPDYWQAIRGVLSRKIKNVAIPGIEVKPGIYTGLNVGVNWNRVDITGPVYIGAMTRIEDGAKIVGPSMIGPNCWICGGATVDNSVIFEYSRLGSGARLVDKLVFGRYCVDKTGAAIDVEAAALDWLITDTRKVLPEFDHPKHQAIRSLFNSK

SEQ ID NO: 83179 - protein, 291 aa, Sinorhizobium meliloti 1021
MNVLILGAGYSGTAIASALAPLAMSVSGTTRAAEKLGRLQAAGIRPILFDGAEISDELKDVMRETTHLVQSIAPGRDGDPMFRAGTPPLAELLPRLEWVGYLSTVGVYGDHGGAWVTEDTPLNPVSQRSLERVEAENAWLEHGAQRGIPVAVLRLAGIYGPGRNAFRNLSEGTARRVIKPNQVFNRIRVEDIGAATALLAKRGVGGVFNVTDDEPAPPQDVVQEAARLMGVEPPPEIPFETADMSPMARSFYGENKRVSNARLRQAGFDPDFPNYRVSLAQLWTSGTWDRK

SEQ ID NO: 83180 - protein, 456 aa, Bordetella petrii
MLMTTLNDTQLRDVQYQLHPYTNAVVHQRTGPIVIERGEGVYVYDDQGRRYLEGMAGLWSVAVGFGEQRLVEAATRQLQKLPYYHTFTHKSHAPAIELAERLIGYTEGRMAKAFFTNSGSEANDTVIKLVWYYNNALGRPDKKKIIARQRGYHGVTVASASLTGLAGNHKDFDLPLPRMLHTACPHHYRNAPPGESEEDYATRLAAELEALILREGPDTIAAFIGEPVMGAGGVIVPPRTYWQKIQAVCRKYDVLVIADEVITGFGRLGQRFGSDVLGIEPDIMVLSKQITSSYQPLGAVLMNAKVTDAVAAHSGQLGTFGHGYTASGHPVATAVALENLNIIDERGLIEHAAEMGELLQQELRALADHPLVGEVRGLGLIAGVELVADKASRRPFDPLGKAGAHAYERAHAHGLIVRGIQDTVAFCPPLIIEAAQVRDMVQRFAATLEDVSAFVA

SEQ ID NO: 83181 - protein, 480 aa, Desulfovibrio vulgaris subsp. vulgaris str. Hildenborough
MDYDADLLVIGGGAAGLTVAAGAARLGARVVLADRGPTLGGDCLHHGCVPSKTLIASARARRTMRDAPRFGLPEVALPPVDFKAVAAHIAGVQSVIQKHDSVERFSGLGVEVRFGDAVFVDEHTVAVEGRRISARRIVVATGSSPQIPAFPGLADTPYLTNRDIFTLETLPASLIVLGGGPIAVEMAQAFARLGSRVVLVQRGGHILSREDADMAAVVHEALEQDGVRIMTGATVEVARRQDAGVVVTVRVGDEHVDVHGERLLVALGRTPNVEGLHLGNAGVVFSERGVPVDARMRTSQSHILAAGDVTGAWQFTHAAGYEGSVVVANAVLRLPRKAKYDRMPWCTFTDPELASVGLNEREAHRQGIGVDVHTESFSSNDRALAEGTACGLLKLVLARGTQRVLGVQIAGPHAGELINGWCMALGGGVRLTTLAGGVMPYPTLGEISRRVAGNIVSEALFSDKVRNVLCTLFRYRGKGC

SEQ ID NO: 83182 - protein, 292 aa, Bacillus megaterium
MATETKLDNTQAENKENKNAENGSKEKNGSKASKTTSSGPIKRAVAGGIIGATIGYVSTPENRKSLLDRIDTDELKSKASDLGTKVKEKSKSSVASLKTSAGSLFKKDEDKSKDDEENVNSSSSETEDDDVQEYDELKEENQTLQDRLSQLEEKMNMLVELSLNKNQDEEAEDTDSDEEENDENDENDENEQDDENEEETSKPRKKDKKEAEEEESESDEDSEEEEEDSRSNKKNKKVKTEEEDEDESEEEKKEAKPKKSTAKKSKNTKAKKNTDEEDDEATSLSSEDDTTA

SEQ ID NO: 83183 - protein, 295 aa, Actinobacillus pleuropneumoniae serovar 1 str. 4074
MKVIIPVAGLGTRMLPATKAIPKEMLTIADKPLIQYIVNECVAAGIKEIVLVTHSSKNAIENHFDTSFELETMLEKRVKRQLLEEVHSIVPKDVTLMHVRQGQAKGLGHAVLCGRAVVGNEPFAVVLPDVILADFTANQKTENLAAMIKRFNETQHSQIMVAPVPREDVSSYGVADCAGVEIPAGETAKIVKMVEKPSVEEAPSNLAVVGRYVFSAGIWDLLEKTPVGVGDEIQLTDAIDMLIEQETVEAFHMTGRTFDCGDKLGYMQAFTEYSLRHDKFGNDFKEFIKKLAKTL

SEQ ID NO: 83184 - protein, 209 aa, Brassica napus
SGSQFAVVYGFMPACVTIFDKKCKPLMELGEGPYNTLRWNPKGRILCVAGFGNLPGDMTFWDVVSKKQLGSNKAEWSVTSEWSPDGRYFLTASTAPRRQIDNGIKIFNYDGKRYFKKMFERLYQVEWKPESPDRFDEISELLKSVESLKLEEGKSQGQGSSQKKPVASIPTIQRPAAYRPPHAKQAAAIQAELLGVNPEGEMSKNALRN

SEQ ID NO: 83185 - protein, 515 aa, Desulfovibrio vulgaris subsp. vulgaris str. Hildenborough
MDAQTKVIIIDYGSQVTQLIARRVREAGVYSEIHPCIVTAEQVRAMKPAAIILSGGPASVGEKDAPALEKGLLDLGVPVLGICYGMQLLGQDLGGELATSETREYGPADLTLTAPCPLWDGLDLGTTSRVWMSHGDKVKTPPPGFKVVGRTATLEVAAMADEARRIYAVQFHPEVHHSEDGARIINNFLFHVAKLKADWTMSSFVERAVKEMAEVVGDRHVVCALSGGIDSTVVAVLLHKAIGKQLHCIFVDNGVLRLNEGQEVVDYLREHFDLNLKYVQAQERFLSKLHGVDDPEQKRKIIGYTFIEVFDEEAKALGHVDFLAQGTLYPDVIESVSHKGPSAVIKSHHNVGGLPEKMNLKLIEPLRELFKDEVRKVAAELGLPDFIIWRHPFPGPGLAIRVIGEITEERLDILRRADKVVQQELMSSGWYRKVWQGFAVLLPLKTVGVMGDGRTYEHVIALRIVDSVDAMTADWARLPSELLERISSRIINEVKGVNRVVYDISSKPPSTIEWE

SEQ ID NO: 83186 - protein, 230 aa, Dehalococcoides sp. VS
MIKDIRNVFSKDPAARSVAEVLFCYPGLHALWFHRVANWLWRHKLHFWARWLSHCGRFCTGIEIHPGAKIGQRFFIDHGMGVVIGETSEIGDDVLMYQGVVLGGTSLSKGKRHPTICSNAVIGTGAIVLGGITVGEGAKIGAGSVVTKDVPAGATVVGIPGRVVEESRRMVLDLEHGKLPDPVADALKVVLAEQQKLMDRLAQLEKNSGLKVPQDELRGQIREIMKEFNL

SEQ ID NO: 83187 - protein, 371 aa, Pseudomonas fluorescens PfO-1
MARLLDTTPKQDGFRLPGEFEAKAGCWLGWPERTDVWRNGAKPAQKVWVQIVTAISQSEPVTVCASASQFATARRQLPPQVRVVEMTCNDTWFRDSGPCFVVNDQSGEVRGVDFEFNAYGGLDGGLYYPWDKDDQIASKILEIERFDRYRAPLIAELGGIQSDGQGSILTTEQCLLNRNRNQHLGKDEVTRRLTDYLGAEQVIWLPRGCKFDETDGHVDDLACFVRPGEVVLQWTDNRDDPQWEIYQEAYDILRSTRDSRGRELIVHKLPQPDVLEWTAEEAEGLDQQDSTHTRQAGTKICASYINYYAGNSSIVVPLFGDRNDQVALATLAELFPQHKIVGIENSREILLGGGNVACITMPQYAGQKKGA

SEQ ID NO: 83188 - protein, 478 aa, Coprinopsis cinerea okayama7#130
MIIPVRCFSCGKVIGDKWNPYLELLAKDMSEGDALDELQLKRYCCRRMVLTHVDLIEKLLHYNHQFLSYVSLGIDYPRGFSALPMATGSLGPNLSHGVDIYGPQLTGYILAPTLILVSLFFYMSLDQNLFTLVFTQNKDYPDVVDLVDPSGTVHYHKRRVAGPEYKIEVYDPLSQAHLITASAPSASSKAKTLELHNPTILVDLKYTGTLSFRWSFKWEEHEFEWKRSECFLIRKPDPPVLVAITKEPTGRLRSHQVQILDYNINRFDVEDRKGLEIVLLTALMTFHDANEAYHEPSSQQPSVSRKSSAPMPVDADEPPPPPPPPKPAPKTGLDRIAELQAQGGDYNEVIVTDEGSVQDYAAYCNGLLEDDAMLFISVKSSSAQTVPKVLQVVEETKRIRYKAGLDEDNELHQYVLYDVEKKKGPRRINLDDDADQKAKYTPPDSLIVHLSKIDMPELQPKTQPPSNDKGKKNDKKGW

SEQ ID NO: 83189 - protein, 412 aa, Triticum aestivum
  misc_feature (135)..(135): Xaa can be any naturally occurring amino acid
  misc_feature (215)..(215): Xaa can be any naturally occurring amino acid
MSATTAEAVRRLCAAGELRSALAQLARGAKAGDGALDVAACTALVHACCRTGDLAEARRVFGAMPRLGLAPNEVTFTALIHGHFVRGRREEGFALFDEMRRGGVEPNIYTYNVLIGEWCRTGEFEGARRLFDEMXRRGVARNAVSYNTLIAGLCRHGRMKDAAWLLETMRKEGIRPSIVTFNLLVDGYGKAGQMSNALHFSNQIRAPWGTSPTLXTHNAAHCRGSGRARDIARANRAFSDMKERGLTPTNGTYTILIDALARGGDMDKAFEMFADMGKAGLEVDVRAYGVLVHALCMEGNMKDARKLFQSMEEKGVKANGVIYDMMIFGYGREGNSYKAMKLITEMRKNGLVPNFASYGLTIRSLCNDGKCPEAEALIKDMVRAGLQPNESVSQALLNAKARQGSSTSNFFT

SEQ ID NO: 83190 - protein, 249 aa, Coprinopsis cinerea okayama7#130
MSSSALNGTQKPNGVNGHHSSQPVWSPKEVLDGPKRTSFAFDSMEDALAAFKAGEFLVVMDDENRENEGDLIIAASQCSTEKMAWMIKHTSGYICVALPGDRLEELNIPMMVPENEDRHRTAYTVTVDYKHGTTTGISAHDRALTVRALASPTSRAEDFSRPGHMVPLRARTGGVLTRKGHTESAVDLCLLTDQPLAGVLCEIVNDDAQGTMARRDDCRAFADRWGVKMISVEMLAEWKRNKLAGEGRK

SEQ ID NO: 83191 - protein, 205 aa, Zea mays
MEARPSRIECSEPNEQPEPKDPGRVFHAERVAPRDATESVTEKLAHGGCGHDGVIDETYDTRIKIAEALEASARAIGDKHVEPSDAAAIRVAEASAAGRGAIPGGVSERAQAAVAANARAARDEDKVTMADVLTWEATVKLPTGKAVTGEVAAAAAEAEAEAANDPRAKTNPRGVSAALGMAAKHNCGHESARTGTAFPDEAKQD

SEQ ID NO: 83192 - protein, 505 aa, Aspergillus oryzae
MDPNGPPSTSGLPSPGDLILQQRKDAIQAAAQPTGDGGLFAQLSSNPFFTAGFGLAGLGAGLSFAQKGIRHGAALLRRRMLVDVEISVKDDSYPWFLHWMTLYQRSQLSSAQSAASRSGYMETLLQKMTPGMRHLSIQTQKVEHSNGAIHTHFSLVPGPGRHVLRYKNAFIFVNRMRESKSLDLQTGRPWETITLTTLYSHRHVFEDLFREAHAYAAKSHEGKTSIYNSWGAEWKLFGQPRRKRPLESVILDEGVKERIVDDVKDFLSSGKWYHDRGIPYRRGYLLYGPPGTGKSSFIQALAGELDYDIAILNLSERGLTDDRLNHLLTIVPNRTLVLLEDVDAAFSNRRVQSDADGYRGANVTFSGLLNAMDGVASAEERVIFLTTNHVERLDPALVRPGRVDMTVRLGEVTRYQVACLWDRFYSELDTNGKYRKIFLDRLHEFGLIEDENGREPDQPKATSAAALQGLFLYNKGNMDGAIAMAEALTYSVHEEAMEHDRPNGN

SEQ ID NO: 83193 - protein, 383 aa, Enterococcus hirae
MEFIGILCLILVATTIGSHISRRFGIPAVIGQLLVGVLLGQAGLGWVHPNILVHDFSEIGVILLMFLAGLESDLSLLKKYFKPGMFVALLGILFPVFFGWLTGEAFQVANNEAIFFGIILAATSVSISVEVLKELNVVNTKEGSTILGASVVDDILVVLVLSFSLSFLTGKSTSNLPLPLLLLEQLFYFLFIFLLVKWIAPFLMSLAEKIYANSAIIIMSLVICLGMSYLADLIGLSSVIGAFFAGIAVSQTKVKHEVYNNVEALGYAVFIPVFFVSVGLEVDFSKFSEQILFILILTLVAILTKLIGGYIGAKFSSFSSNSALMVGAGMISRGEMALIILQIGQQSNLIENHYYSPLVIVVLLSTLISPLILKYFTKKVYAN

SEQ ID NO: 83194 - protein, 495 aa, Chlamydomonas reinhardtii
MGNVFSCFETGPWDPHPEINTSYTPARTDVYQDMKQPLSHYFVSSGHNSYLTGNQLTSASGTATIIACLQGSCRVIELDVYNGPECKHGGTLTKAISFKECIEAIGEYAFKASPYPVIITMENHANTENQGLMAQILREVLGDKLFVPHPDDPMEAWKSPEELKHKVVCRTSLKPNAHEEFKKLIYIKNSKFTGLAEMIKKGGVVVLRGDVKELGADDADEERETQREMEKLQAQQAKAKAAGHEGNSADETPEDAVVGGGMVTGSIQELYTYTGKHLMRVYPAGWRITSGNYNPMTAWIRGASFAALNWQVWDKPLWCNAGKFLDNGRSGYVLKPDWMRNPPSELPARPGRKLLVHVYSAHMHQGKNVSVFKDDLFVKMEVYGMPTDRESKYTKTVNNSGRLLVNEEYDFVVRFPEMAVLCVQLMDEDAGGAKTNHADADTLGYYTLPLSTLKEGTYKLQLNHPDSGKALPVDEAWVKVSFKWAAENPMYAGPK

SEQ ID NO: 83195 - protein, 817 aa, Chlamydomonas reinhardtii
MADASTSADASKKDANKKDFSTAIMDRKKSPNRLIVEEAVNDDNSVVALHPKTMEKLQLFRGDTVLLKGKKRKDTVCIVLSDDTVDENKIRMNKVVRKNLRVRLADIVSVHQCTDVKYGKRIHVLPIDDTIEGISGNLFDAYLKPYFLEAYRPVRKGDTFLARGGMRSVEFKVVETDPAEYCIVAPDTEIFCEGEPIKREDEEKLDEVGYDDIGGVRKQLAQIRELVELPLRHPQLFKTIGVKPPKGILLYGPPGSGKTLIARAVANETGAFFVVVNGPEIMSKLAGESESNLRKVFQEAEKNAPSIIFIDEVDSIAPKREKTQGEVERRIVSQLLTLMDGLKSRAHVIVIAATNRPNSIDPALRRFGRFDREIDIGVPDETGRLEVMRIHTKNMKLDEDVNLEAISRDTHGYVGADLAALCTEAALQCIREKMDVIDLEDEQIDAEVLNSMAVTQDHFKTALGMSNPSALRETVVEVPNVSWDAIGGLENVKRELQELIQYPVEHPEKFEKFGMSPSKGVLFYGPPGCGKTLLAKAIANECQANFISVKGPELLTMWFGESEANVREIFDKARGSAPCVLFFDELDSIAVQRGSSAGDAGGAADRVLNQLLTEMDGMNSKKTVFIIGATNRPDIIDPALLRPGRLDQLIYIPLPDEGSRRQIFKACLRKSPIAPDVDFDTLVKFTHGFSGADMTEICQRACKSAIREDIEKNIERERRRAENPDAMMEDEPDPVPCITKAHFEEAMKYARRSVSDADIRKYQAFAQTLQQSRGFGTDFRFPDGPGGAPAAAGAAPAAAAPAFAQSAAAADDDDLYN

SEQ ID NO: 83196 - protein, 340 aa, Triticum aestivum
MVDLQAAALVISVVAAEVGRLVFRAAVESGKVDVVAINEPFMSVDYMVYNLKYDSVHGAFKGDAHEKDKSTLVVNGKEIKVFAERDPANIPWGSAGADYIVESSGVFTDADKAGLHLKGGAKKVIISAPSNNAPTFVMGCNESSYKPEYNVISNASCTTNCLAPLAKVIHDTFGIEEALMTTIHAITATQKTVDAPAAKDWRSGRAGLTNIIPASTGAAKAVGLVLPELNGKLTGMAFRVPTIDVSVVDLTARLKKEASYDEIKAAVKAAAEGPLKGILAYTEDEVVSSDFIHSSVSSTFDAKAGIALSKTFVKLVSWYDNEWGYSNRVIDLIVYINDKQ

SEQ ID NO: 83197 - protein, 426 aa, Cryptococcus neoformans var. neoformans JEC21
MDNTPRHLFQTPNNVYILQQPWQFVKELGQGAYGCVSSARNSSTGETCAVKKVTNVFQKKILTKRCLRELRLLHHFRGHKNITCLYDMDIVFDPPGSGQFREVYLYEELMEADLHAIIRSGQPLSDAHFQSFLYQTLCGLKYIHSANVLHRDLKPGNLLVNADCELKICDFGLARGFQPGAVQTDQGQAGFMTEYVATRWYRAPEIMLSFANYTSSIDMWSVGCILAELLGGKPIFKGEDYVDQLNKILNLLGTPTEDTLRRVGSPRAQDYIRSLPIKPRVKFETLYPNASPLALDLLSKLLTFDPAKRYGCEEALEHQYLAVWHDPADEPLCEVPFDFSFEEEDSVSGMRDLILEEVRSFRYLVRQQSMPPARKDSHELPPAPPAPQHPGAGVGPAFHERANSEGDMEEHPGSALEKQLERQKLS

SEQ ID NO: 83198 - protein, 583 aa, Triticum aestivum
  misc_feature (390)..(390): Xaa can be any naturally occurring amino acid
  misc_feature (392)..(392): Xaa can be any naturally occurring amino acid
  misc_feature (397)..(397): Xaa can be any naturally occurring amino acid
  misc_feature (412)..(412): Xaa can be any naturally occurring amino acid
  misc_feature (463)..(463): Xaa can be any naturally occurring amino acid
  misc_feature (472)..(472): Xaa can be any naturally occurring amino acid
  misc_feature (476)..(476): Xaa can be any naturally occurring amino acid
NKFVQKSRLVPVRNSRDIVDPRVRVAYPKSNRKACKSFDDFDISYKAKPGSLPTFLLVDRGDCFFTKKAWNAQNAGVAAILVADDKDEPLITMDTPEESGRADYLENITIPSALITKSFGDRLRKAVDGGHMVNVNLDWRESLPHPDERVEYEFWTNSNDECGPKCDSQIDFVKSFKGPAQILEKKGYTQFTPHYITWYCPEAFTLSKQCKSQCINHGRYCAPDPEQDFSKGYDGKDVVVQNLRQVCVYKVAKENKKPWLWWDYVTDFAIRCPMKEKKYTKECADGVIKSLGLDHKAIDKCIGDPNADEENPVLKAEQDAQIGKGARGDVTILPTLVINNRQYRGKLDKGAVLKALCAGFQETTEPAVCLSEDIQTNECLENNGGCWHEXAXYISAXQDTFRGRVCECPVVXGVKIVGDGYPHCESSGSGRCENYNGGCWKETRNGRTHSGCTGCGCKCPNGXQGDGVHKCXNVDXCKERTAFPCQECNFKTPWGSYECGCSGGLLYMKEHDTCISKSTAAQVGWNFLWVVFFGLAATGIAGYAVYKYRIRRYMDSEIRAIMAQYMPLESQGEIPSNAHHIEM

SEQ ID NO: 83199 - protein, 524 aa, Oryza sativa Japonica Group
MASRDLAESLLPVGGGAATATATATAHDEYDERAYDSDDKVSIAVSDSDSEDGGGGGGDAMRPAFSWRKLWRFTGPGFLMCIAFLDPGNLEGDLQAGAAAGYQLLWLLLWATVMGALVQLLSARLGVATGKHLAELCREEYPPWATRALWAMTELALVGADIQEVIGSAIAIKILSAGTVPLWGGVVITAFDCFIFLFLENYGVRKLEAFFGVLIAVMAVSFAIMFGETKPSGKELLIGLVVPKLSSRTIKQAVGIVGCIIMPHNVFLHSALVQSRKIDTNKKSRVQEAVFYYNIESILALIVSFFINICVTTVFAKGFYGSEQADGIGLENAGQYLQQKYGTAFFPILYIWAIGLLASGQSSTITGTYAGQFVMGGFLNLRLKKWLRAMITRSFAIIPTMIVALFFDTEDPTMDILNEALNVLQSIQIPFALIPLITLVSKEQVMGSFVVGPITKVISWIVTVFLMLINGYLILSFYATEVRGALVRSSLCVVLAVYLAFIVYLIMRNTSLYSRLRSAMTKST

SEQ ID NO: 83200 - protein, 147 aa, Rhizobium sp. NGR234
MTYRKTDEAVSKLTPEQYRVTQQNGTERPFTGEYTDNKRPGIYVDIVSGEPLFASADKFDSGCGWPSFTKPIVPANVNELRDASHGMIRTEVRSKHGDSHLGHVFPDGPEDRGGLRYCINSAALRFIPREEMEAEGYGAYINQVEDI

SEQ ID NO: 83201 - protein, 186 aa, Oryza sativa Japonica Group
MNIERLKQLVDLVGKHRLVLDLSCRKKDGRYAIVTDRWQKFSDVFVDEPTLKHLAAYADEFLVHGVDVEGKRLGIDEELVELLGRYSPIPVTYAGGVSTMDDLERIKRAGNSRVDVTVGSALDIFGGDLPYKDVVLWHKEQNMYFHKESHFQCVSRTRLQVQNWRFLAPSVLPLAAIVYSWVPKFA

SEQ ID NO: 83202 - protein, 110 aa, Streptomyces coelicolor A3(2)
MAGTLKHVTDDSFEQDVLKNDKPVLVDFWAAWCGPCRQIAPSLEAIAAEYGDKIEIVKLNIDENPGTAAKYGVMSIPTLNVYQGGEVAKTIVGANAKAAIVRDLEDFIAD

SEQ ID NO: 83203 - protein, 464 aa, Aneurinibacillus thermoaerophilus
MKLILLSGGSGKRLWPLSNDSRSKQFLKVLKNDNNEFESMVQRVWNQLHTVGLAEDSYVATSKSQVDMLHAQLGTEVPLIIEPERRDTFPAIALAATYLYSMEGVREDDVISVLPVDPYVESRFFDRVKDLETALVQSSAELALIGVKPTFPSEKYGYIVPKKGEHDVVANVLAVDYFVEKPSTSRAQELMKQQAFWNCGIFAFKLGYLISLLKEKKLPTDYEEMLHTYNQLPKISFDYEVVEKAQNIIMLPYEGEWKDLGTWNTLTEEMNTNLLGKGIISEGCENTHLINELDIPVTILGISNAVIAASPDGILVTDKEASPRIKDIMKNFNQRPMYEERRWGWYRVLDHTKVENGNEVLTKRIGVHAGKNLSYQIHHKRSEVWTIISGEGQFVLNDQLYHVKPGDVLQIPVGAKHAIRAITDLQFVEVQTGSELIEEDIIRLCMTWEETLDCCKDCIVKVIR

SEQ ID NO: 83204 - protein, 471 aa, Triticum aestivum
  misc_feature (383)..(383): Xaa can be any naturally occurring amino acid
  misc_feature (412)..(412): Xaa can be any naturally occurring amino acid
  misc_feature (457)..(457): Xaa can be any naturally occurring amino acid
RDDKVEDLSRMYRLFSRITRGLEPVSQIFKQHVTNEGTALVKQAEDAASNKKPEKKDIVGLQEQVFVRKIIELHDKYVAYVTDCFQGHTLFHKALKEAFEVFCNKGVSGSSSAELLATFCDNILKKGGSEKLSDEAIEDTLEKVVRLLAYISDKDLFAEFYRKKLARRLLFDKSANDEHERSILTKLKQQCGGQFTSKMEGMVTDLTVARDHQTKFEEFISTHPELNPGIDLAVTVLTTGFWPTYKSFDINLPAEMVRCVEVFKEFYQTRTKHRKLTWIYSLGICHITAKFEAKTIELIVTTYQAALLLLFNGADKLSYSEIVTQLNLSDDDVVRLLHSLSCAKYKILTKEPSNRSISPNDVFEFNSKFTDKMRRIKIPLPPXVDEKKKVVEDVDKDRRYAIDASIVRIMKXARKVLGHQTLVMGVCVEQLGRMFKPDLSKQLRSALEDLITRDYLXRRDKENPNVYRYLA

SEQ ID NO: 83205 - protein, 501 aa, Mycobacterium avium 104
MTDTTISNGVTEQLVHFDLVIGGESVAAESGRTYDSIDPYTALPWARVPDCGPADVDRAVAAARAALRGPWGQLTGTARGKLLWRLGELIAREAESLAELEVRDGGKLVREMIGQMKALPDYYIYYAGLADKLQGEVVPVDKPNFFVYTRHEPVGVVGAITPWNSPLLLLTWKLAAGLAAGCTFVVKPSDHTPASTLAFAKLFAEAGFPPGVINVVTGWGPQTGAALAAHPDVDKIAFTGSTATGISVGKAAIDNMTRFTLELGGKSAQVVFDDADLDAAANGVIAGVFAATGQTCLAGSRLLVHESVADALVERIVARASTIKLGDPKDPATEMGPVSNQPQYEKVLSHFASAREQGATVAYGGEPAGELGGFFVKPTVLTGVDRSMRAVAEEVFGPVLAVMTFTDEDEAIAAANDTEFGLAAGVWTKDVHRAHRVAARLNAGTVWVNAYRVVSPHVPFGGMGHSGIGRENGIDAVKDFTETKAVWVELSGATRDPFTLG

SEQ ID NO: 83206 - protein, 469 aa, Photorhabdus luminescens subsp. laumondii TTO1
MSVEHVLTMIEEHQVKFIDLRFTDTKGKEQHMTIPAHQVNADFFEDGKMFDGSSISGWKGINESDMVLMPDPSTAMLDPFFDDATLTLRCDILEPGTMQGYDRDPRSISKRAENFLRSSGIADTVLCGPEPEFFLFDDVRFSSAMSHSYYHIDDIEAAWNSGTQYEGGNKGHRPAVKGGYAPLPPVDSSQDLRSAMCLTMEEMGLVVEAHHHEVGTAGQNEIATRFNTMTKKADETQIYKYVVHNVAHNFGKTATFMPKPLVGDNGSGMHCHMSLSKNGTNLFAGDKYGGLSELALFYIGGIIKHARALNAFTNPTTNSYKRLVPGYEAPVMLAYSARNRSASIRIPVVASTKARRIEVRFPDPAANPYLAFAAQLMAGLDGIINKIHPGDAMDKNLYDLPPEEAKEIPTVASSLDEALAALDADREFLTRGGVFTDDAIDAYIDLKNSEIERVRLTPHPLEFELYYSV

SEQ ID NO: 83207 - protein, 586 aa, Alkalilimnicola ehrlichei MLHE-1
MSQHIQYPESGEKITIKDGKLSVPDNPIIGCVEGDGIGPDITRACLRIWDAAVEHAYKGKRKIHWAELFMGEKAAAKYDGNYFPDETKEALKDLLISIKGPLTTPVGGGFRSLNVSLRQELDLYACVRPVRHYAGVPSPLKKPEDVDVVIFRENTEDVYAGLEYQSGSDENKKLAKFLREEMGADFFEDAGLGIKPISAYGSKRLVRKAIQYAIDNNRESVTLVHKGNIMKFTEGAFRTWGYEVAREEFGDQTITEEELYSTYGGKRPEGKVVIKDRIADIIFQLLQLRPADFDVLATMNLNGDYLSDAAAAEVGGIGIAPGANMADHVAVFEATHGTAPKYAGQDKVNPGSLLFSGVMLLEHIGWQEAADLITAAYQDVVTARIVTYDFARQLEGATEVKTSQFADAIIDQMRGKIDVAKIRREREEAVERERKAREQRRVVAPLEEMIASGRTPHTVGDLMNPNPVTVPAETSVEDAMHLMREKRISSVITEPGTEGEWGIMTQRDVLSRIVSKNRTPSTVQVEEIASRPLVTTPVDTSLHDCAEIMSESNIRRMVVMDNNNKPVGIISDTDIFASVEQFGLPE

SEQ ID NO: 83208 - protein, 131 aa, Zea mays
CALIWGIAHVPIAIIWGIAIGTCALCYNNTHVFRGVVKMRRGLTARIIDETNSMTDVYTAFYEFSSLIESKIDDSDPNAALTQRRVDSIKQTCKSFGLVKQRGYHLEKSPYRPMLIMIVLLLVAILFGVMF

SEQ ID NO: 83209 - protein, 109 aa, Arabidopsis thaliana
  misc_feature (29)..(29): Xaa can be any naturally occurring amino acid
GFLLCFSSAAGVTSRAKATRVVQLTGWKXIGGIPGHGKTKKEIISMESKGGRVSGMKVWPQMGKKKLETLFYLPDLRDVEWAKEVDYLLRNKWIPGVEFELEQGLVYRE

SEQ ID NO: 83210 - protein, 476 aa, Cryptococcus neoformans var. neoformans JEC21
MPSFEPAVSSHIAPLPSASKPLPLTTSTEGLQALADKHITKGLGRLRDHVFKEGKGLRVLTTENQKLLDFTSGIGVTSLGHAHPDVTAAIISQAQSIIHVQCAIGLSEPYVQLVESLLTMMPDPSLDSFFFWNSGSEAIEAAIKVSRTKTKRNNIVVMQGGYHGRTSGAAALTRSKTSFFRGTGPLMPCVYTTPFPYWHAMGLPKDTPEEVLIEQAILGIENLLQQQTAPEDTAAIFLEPVIGEGGYIPAPTAYVKHLRKLCDKYGIMLVIDEIQTGFGRTGKTFAIEHTGVTPDIMVYAKGFANGMPISGIVTRKEIMDVMAPGSLGGTYSGNVVACAAALATTRYMRTHDILGNVQARSEQLFKGLREIQEDEANGGWMIEEVRGKGLMIAIEFKDPNSKLTSSHNRGDISLPGNLNKLVQDACYDRGLLVLTTSIYPVLRLIPALVLSEEEVDEALKIIKESVKEVASVIEGN

SEQ ID NO: 83211 - protein, 305 aa, Oryza sativa
MATATASSLSLLFAHPHSSNPRPFAGGPHLRRPLRAAPHRISLQQLIQPIANGATVLSLDTDFDGCMRLIREVTAELPIYLANSLNSLRLEGQKTAAIEILQQFDWQVPDWVIVPGGNLGNIYAFYKGFEMCRVLGLVDRVPRLVCAQAANANPLYRFYKSGWTDFQPRVAETTFASAIQIGDPVSVDRAVVALKATDGIVEEATEEELMDAMSLADRTGMFACPHTGVALAALFKLRDQRIIGPNDRTVVVSTAHGLKFTQSKIDYHDRNIKDMLCQYANPPINVKADFASVMDVLQNKLNGKI

SEQ ID NO: 83212 - protein, 628 aa, Oryza sativa
  misc_feature (109)..(109): Xaa can be any naturally occurring amino acid
MAAAAISHLRRGAPRHARALLYLSTRRFSSSSAAGVAPLAAVAASARRLLSTSVDSGASSTGESYKPPLFDPFRAASLASSAPPLESPPIEELPDDATPPPEEEPGLPXPEKDPVATACQHELEGLKAWVETVRSRKESTEEKEAWSLLGRSVVSYCGTAVGTVAANDPSTANQMLNYDQVFIRDFVPSAIAFLLKGEGDIVKNFLLHTLQLQSWEKTVDCYSPGQGLMPASFKVRSIPLDGNSEAFEEVLDPDFGESAIGRVAPVDSGLWWIILLRAYGKITGDYALQERVDVQTGIRLILNLCLSDGFDMFPTLLVTDGSCMIDRRMGIHGHPLEIQSLFYSALRCAREMVSVNDGSNSLIRAINYRLSALSFHIREYYWVDMKKINEIYRYKTVEYSHDAINKFNIYPEQIPSWLADWIPEKGGYLIGNLQPAHMDFRFFSLGNLWAIISSLATQRQAEGILNLIEAKWEDIIANMPLKICYPALEYEEWRIITGSDPKNTPWSYHNGGSWPTLLWQFTLACIKMGRRDLAQRAIEVAEKRLSEDKWPEYYDTRTGRFIGKQSRLYQTWTIAGYLSSKMLLDCPELASILICEEDLELLEGCACSVNKSARTKCSRRAARSQVLV

SEQ ID NO: 83213 - protein, 322 aa, Sinorhizobium meliloti 1021
MPEARKPGRGRVFSSITETIGDTPIVRLDKLAKEKGVKANLLAKLEFFNPIGSVKDRIGVAMIESLEAQGKITPGRTTLVEPTSGNTGIALAFVAAAKGYRLILTMPETMSVERRKMLTLLGAELVLTEGAKGMKGAIAKAQELTETLPDAIIPQQFENPANPEIHRTTTAEEIWNDTEGAVDILVSGIGTGGTITGAGQVLKARKPSVRVIAVEPEESPILSGGAPGPHKIQGIGAGFAPAILDTSVYDEVVTVNAGEAIEAARLVARLEGVPVGISAGAALQAAIEVGQREENAGRNIVVIIPSFAERYLSTVLFEGLGA

SEQ ID NO: 83214 - protein, 307 aa, Campylobacter jejuni
MHNILFGNILNRSATMKGIILAGGSGTRLYPSTLTLCKQLLPIYDKPMIYYPISVLMLAKIKEVLIISTPKDIDRFKELFKNGSFLGMQIQYKIQERPEGLAQGLILAQDFIQNDDIALILGDNIFYGQGFSDILENAKDDLKKGFASIFSYHVKDPERFGVVEMDQNGNVLSLEEKPKNPKSNHVATGLYFYNNDAIDIAKNIKPSARGELEITDVNIEYLRLNKLKSQHLGRGFAWIDTGTHDSLIEASSFVQTIELRQGYKIACLEEIAYNNNWIDNETLEKRALLLSKSNYGQYLYKILSQGK

SEQ ID NO: 83215 - protein, 528 aa, Trichodesmium erythraeum IMS101
MRNFHKPERSEVFSQNGMIATSHPLAAKIGLDTMSHGGNAIDAAISAALMLTLCEPQSTGLYGDAFVILKSQKSDKLIGINGSGNSPKAISSDLLLQKGLNKIPINSVHSITLPGAVALFEELALKFSNLGLAELCKASIKYAEEGVVVSPRVAFDWRLNNLKFSQTTKKFYLVDGKVPETGSIFRAPKQAEVLRKIQKNGSKGFYQSEVTEDLVKSLQNLGGVHTLDDFANVTFEYVEPIFSNFQDGSKLFELPPNGQGITAIMIRKLMEICNIQEHSPYSANRVHLEAEIAKLAYTARNAFIGDPKFSQIKEHFFLDSAFLEKIAQQISLNKLIDGSGIQYFDEKPKDTVLISAADKDGNAISLIFSNFDSFGTGKCSEKYGLIFHNRGASFVLEKNHPNELEGNKRPLHTIIPAIFKGKNDMIMAFGVMGGDYQPYGHARILSNLFDYSMDPQSAINFPRSFFFNGVLKLEEGYDENVAEALTSIGHKIVRPIAPIGGAQLVICDPSGVLIGASDPRKDGCALGI

SEQ ID NO: 83216 - protein, 500 aa, Cryptococcus neoformans var. neoformans JEC21
MPSLTQTKDLASLLSDASHFKQKGYINGEWVSASDGATFPLYNPATGAKLADMPHMPRSQVAEAINAAKAAFPAWAALTAYQRQNYLLKLFKEMEEHSEDLAIILCTENGKPLAESRVEISYGASFLTWNAAEALRTYGQTIPSPFPGTRNTVIKQPIGVCGLITPWNFPNAMITRKMAPALAAGCTVVIKAPAETPLSALAMCVLCERVGIPPGVVNVVTMDKGQREMAAGLELCENVKVSKISFTGSTPVGRLLMKQSSGTLKKLSFELGGNAAFIIFDDADLDLAVNGVILSKFRAAGQTCICANRIFVHSKIYDDFARRLVERVKAFKVGNGIEEGVTIGPLVSQRGVEKVERHVQDAVGLGAKVLVGGKRIDKGEGSCFYEPTVLVDVPRQCAVSNEETFGPLAPLFKFDDEDDVVERANSSEVGLAAYFFTKDLARTHRVAEKLEVGMVAVNTGAIAQSCVPFGGVKQSGFGREGGPSGIDEFMVEKLITIGGL

SEQ ID NO: 83217 - protein, 367 aa, Silicibacter sp. TM1040
MSNPSILILPGDGIGPEVMAEVRKVISWFGAKRDIQFDVSEDLVGGSAYDAHGTPLHDDTMAKAQEVDAVLLGAVGGPKYDALDFSVKPERGLLRLRKEMDLYSNLRPAQCFDALADFSSLKKDVVAGLDIMIVRELTSGIYFGEPRGIIEEGNERVGINTQRYTESEIERVARSAFELAMRRGKKLCSMEKANVMESGILWREVVTEVSKDYPEVELSHMYADAGAMQLCRWPKQFDVIVTDNLFGDLLSDAAAMLTGSLGMLPSASLGAPMANGRPKALYEPVHGSAPDIAGQGKANPIACILSFAMALRYSFDMGTEADRLEAAVEKVLADGVRTADLLGEEGVTPVSTSEMGDAVVEALNASL

SEQ ID NO: 83218 - protein, 689 aa, Pachysolen tannophilus
MSYILVTGGAGYIGSHTVVELVNNGYNVVVVDNLVNSSYDVIVRIEVLTRKQIPFFKIDLNDHDALDQVFKLYPIQAVLHFAALKAVGESTKFPLNYYSNNVGGAISLLKVMEENNVKNIVFSSSATVYGDATRFENMIPIPEHCPTGPTNPYGETKITIENIIRDVYANDKSWKCAILRYFNPIGAHPSGLIGEDPLGIPNNLLPFLAQVAIGRREKLSVFGSDYNSKDGTPIRDYIHVIDLAKGHIAALNYLFNHKDNGLCREWNLGTGNGSTVFEVFNAFCEAVGKKLPFEVVGRRDGDVLNLTANPKRANTELKWKAQLSINDACKDLWNWTTKNPFGFQINNYSWTKFDSESLTNYDRLNTVRTFNGKFEVSISNHGATIVAAKLNGIKLNLGFDNLKGYLREDNPFFGATIGRVANRISKGDLLINGTHYQVGLNELHRTSLHGGTYGYNKRTFLGPIVKTNEKEKETTMEFVLIDLDGTEGYPGDVETKVIYTVRDTGVGGELGIEYEAKLLEESGRDSTAVSLTNHSYWNIGNQPSIEGTHIKLVSNKHLESNPLDSTPTGKIVTSTDLDSQNSAKLGPDGPVFDYCFVTKQQDKLDTRNDELRVVATATHPKTRIAFTTLTTEPAFQFYTGDGVDVAGVFTKRSGFCLEASRYIYNPKWFIPLNKGEVYGSYTIYRFENF

SEQ ID NO: 83219 - protein, 489 aa, Elatine triandra
GPGVSALEKNNLGRITQIIGPVLDVTFPRGKMPNIYNALVVKGRDTAGQQINVTCEVQQLLGNNRVRAVAMSATDGLTRGMEVIDTGSPLSVPVGGATLGRIFNVLGEPVDELGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVIDEENLAESKVALVYGQMNEPPGARMRVGLTALTMAEYFRDVNKQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILTGELDSLPEQAFYLVGNIDEATAKATNLEMENNLK

SEQ ID NO: 83220 - protein, 319 aa, Caulobacter crescentus CB15
MRLIIDTDTAGDDVFSLMLALTRTGVELEAITIAHGNVGFEQHAENALVTLDRCGRAGEVPVYLGAQFPLMRAPLDAAYVFGRDGMSDSGFARTSQRPAEGHAVDELVRRIMAAPGEITLIAQAPLTNIALAYQREPRIAKALKHLWVMGGTDNGVGNVTPAAEYNFYADPEAAKIVVNAGFNLSIATWTLTLKDGLWTTEKLDALDALGTEKARFFTDVNRASLAFARETEGLDGSLHPDALTCAIALDEGLILEAETCVVDVETVGELTRGYLSVSHSILPDIEIADPALKRRPPNARVIKAIDREGFFAAMRTALL

SEQ ID NO: 83221 - protein, 339 aa, Rhizobium gallicum
MSLLEKFERYPLTFGPTPIEHLPRLTAALGGKVDIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVIGIDASGTLQQTRNQVRKIVDATSELVNLGRSVREDEIVINPDYAYPAYGVPSEETNEAIRLAARTEAMITDPVYEGKSMQGMIDLARKGFLPEGSKVLYAHLGGAPALNGYSYYYKDG

SEQ ID NO: 83222 - protein, 141 aa, Zea mays
MGIGEHFEGLKQHWASNLAFLDYFKKVYGRAEPLPKWTDADVDEFIASDPVYGPQLKALRESRKFALAGGFIGAAHLGGVALKFSKAPHGVLLATGFGAITGAVLGSEVAEHWYQLYKMDRQGANLRFIYWWEDKVSGQKS

SEQ ID NO: 83223 - protein, 364 aa, Zea mays
MGSSEPSSRSVQNLVLYAASAALSCLVLLAGLRHLDPNRAASQKAQQQKKEIAKRLGRPLVSTTPYEDVIACDVINPDSIDVEFDSIGGLDKVKQALYELVILPLRRPELFASGKLLSPQKGVLLYGPPGTGKTMLAKAIARESGAVFINVRISNLMSKWFGDAQKLVSAVFSLAHKLQPAIIFIDEVDSFLGQRRTTDHEAMTNMKTEFMSLWDGFTTDQNARVMVLAATNRPSELDEAILRRFTQIFEIGIPVQSERNKILQVVLKGENVEPNVDYDHIARLCEGFTGSDILEVCKQAAFYPIRELLDNERNGRKLDKPRPLRQSDLERALSTSRKCKKAASSGLQSPLWVRPTDSEDDQIA

SEQ ID NO: 83224 - protein, 339 aa, Rhizobium leguminosarum
MSLLEKFERYPLTFGPTPIEHLPRLTAALGGKVDIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVIGIDASGTLQQTRNQVRKIVDATSELVNLGRSVREDEIVINPDYAYPAYGVPSEETNEAIRLAARTEAMITDPVYEGKSMQGMIDLARKGFFPEGSKVLYAHLGGAPALNGYSYYYKDG

SEQ ID NO: 83225 - protein, 565 aa, Alkalilimnicola ehrlichei MLHE-1
MADVKEVRVPDIGDFAEVDVIEVLVAPGDRIEKEQSLITLESDKASMEVPSSEAGVVKEVKIKVGDKVSEGDVVVLVEAEEGGDSPAEAPTGSDAGASAPAAGGSDAPAAGGGEAVQVKVPDIGDFAEVDVIEVLVSPGDTVEQEQSLITLESDKASMEVPSSHAGVVKEVKVKVGDKVSEGDTVAVLESQGAGGGATASAPAKEAGEAAKPSQEPAETYAADSQREAAAPESYKANAYLLTDSRPPQAPPPIDREAHRRAHASPAVRRFARELGVDLGQLQGRGSGRKGRILKEDVQAYVKQALAGGGAAAAPAGQAGGAGIPPIPEVDFSKFGEVERQPLSRIQKLSGPHLQRSWLNVPHVTQFDEADITELEAFRKSMKTEAEKAGVKLTPLAFMVKASAAALRAFPRFNSSLAPAGDELILKKYVNIGVAVDTPNGLVVPVIRDADRKSVYQIAEDLGTLSAKARDGKLGPSDMQGGCFTISSLGGIGGTAFTPIVNAPEVAILGVSRSSMKPVWNGSEFEPRLMLPLSLSYDHRVIDGAAGARFTAWLAQALGDIRRLLL

SEQ ID NO: 83226 - protein, 94 aa, Zea mays
QNCWGKKGGAFTGEVNAGGRVNRGGPWVILGHSERRALLGETKESGGDKGAYALAQGLKGIAWGGETHEQREAGATMEGGAAQTKAIAEKIKDR

SEQ ID NO: 83227 - protein, 593 aa, Alkalilimnicola ehrlichei MLHE-1
MADLVEVKVPDIGDFDAVDVIEVLVSPGDEIEVEQSLITLESDKASMEVPSSHAGVVKEVKVKVGDKVSEGDVVCTLEAAEATAGGEAPATGGGRAEKPAEPEPPAAATRPAPAAAPQGDAPVDADCDVLVLGAGPGGYTAAFRAADLGLKTVLVERYPTLGGVCLNVGCIPSKALLHAAKVIDEAEQFADHGITFGKPKIDIRKLADWKSSVVKKLTGGLAGLAKQRKVEVVTGKGAFKDAYHLEVDGKEGKRTISFRHCIIAAGSRPVVPPPLAVDDPRVMDSTGALELEEVPERLLVVGGGIIGLEMACVYDALGSKVTVVELADRLMPGADADLVKVLRKRIDKRYDAIHLNTLVKELKPNKKSITVKFEGKDAPESDRFDRVLLSVGRRPNTDLIGLEATGLKPNDQGYIDVDEYMRTGVSHIHAIGDIVGQPMLAHKASHEGKVAAEVIAGEKSAWDARAIPSVAYTDPEVAWVGITEEEAKAQGIAYEKGAFPWAANGRSLSLNYQDGISKLLFDEQSGQLIGAGIVGPNAGDLIAEAALALEMGAEAADIGLTVHPHPTLSETVAMAAEAAEGTLTDLYIPKKKK

SEQ ID NO: 83228 - protein, 339 aa, Rhizobium leguminosarum
MSLLEKFERYPLTFGPTPIEHLPRLTAALGGKVDIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVIGIDASGTLQQTRNQVRKIVDATSELVNLGRPVREDEIVINPDYAYPAYGVPSEETNEAIRLAARTEAMITDPVYEGKSMQGMIDLARKGFFPEGSKVLYAHLGGAPALNGYSYYYKDG

SEQ ID NO: 83229 - protein, 575 aa, Haemophilus influenzae 86-028NP
MISGILASPGIAFGKALVLKEEKIVLDTQKITDDQIDEEVARFYEGRAAAVEQLNSIRERALISLGEEKAAIFEGHLMILEDEELEEEILDYLRSNKVNAGVAASKILDQQVTMLSEIDDEYLKERAGDIRDIANRLVKNILGMHIVDLGDIQEESILVAYDLTPSETAQLNLEKVLGVVTDIGGRTSHTSIMARSLELPAIVGTNKVTKLVNTGDYLILDAINNQVYINPTASQIDELKALEAKISEEKAELAKLKDLPAITLDGHKVDIVANIGTIRDCDGAERNGAEGIGLYRTEFLFMDREQLPTEEEQFIAYKQVVEAMNGRLTVLRTMDIGGDKELSYLDLPKEMNPFLGWRAIRIALDRREILNAQLRAVLRASAFGKLAVMFPMIISVEEIRELKAVIETLKAELREEGRVFDNNIQVGVMVETPSAAVNAKFLAKEVDFFSIGTNDLTQYTLAVDRGNEFISHLYNPMHPSVLGLIKQVIDASHTEGKWTGMCGELAGDERATLLLLGMGLDEFSMSAISVPRIKKLIRNVNFQDAKALADAALQKPTAAEIDQLIEEFLLENSLN

SEQ ID NO: 83230 - protein, 339 aa, Rhizobium leguminosarum
MSLLEKFERYPLTFGPTPIEHLPRLTAALGGKVDIYAKRDDCNSGLAMGGNKLRKLEYNVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVIGIDASGTLQQTRDQVRKIVDATSELVNLGRSVREDEIVINPDYAYPAYGVPSEETNEAIRLAARTEAMIIDPVYEGKSMQGMIDLARKGFFPEGSKVLYAHLGGAPALNGYSYYYKDG

SEQ ID NO: 83231 - protein, 671 aa, Triticum aestivum
MSSLVRLILTISLGLNLAALITTANDQFIYSGFSGSNLAVDDTATITPDGLLELTNGTAYQKGHAFHPAPFRLRDSTANGVGDGKVRSFSVAFVFGIVSAYPDFSAHGMAFVIAPRRNFSDALPAKYLGLTNVQNDGNASNSIFAVELDTIQSVEFKDINANHVGIDINGLQSLRSYNAGYYDDESGDFRGMKLISREAMQVWIDYHGERKEINVTLAPFDMAKPARPLLSASYDLSTVLTELVYLGFSAATGRVNSRHFVLGWSLGVSRQAPAIDMAKLPKLPRVGPKPRSKVLDIVLPIVTATFVLGLGGILVLVMRRRSRYAELREDWEVEFGPHRFLYKDLFRATDGFKDKHLLGAGGFGRVYRGVLETSKLEVAVKRVSHESRQGMREFIAEITSIGRIRHRNLVELLGYCRRKGELLLVYAYMPNGSLDKHLYNTREDQPTLNWALRFQTVKDVASGLLYLHERWEKVVIHRDIKASNVLLDKDMNAQLGDFGLARLYDHGADSQTTHVVGTMGYLAPELIRTGRASPLTDMFAFGIFLLEVACGQKPIKENAQGGQIALVDWVLEHWRDGTLMETVDARLQGEFDIDQAGLVLTLALMCSHLLASARPGIGQVMRYLTGVTPLPELTPTDVLTLMQNKGFDESAMSYPDLVSSFGTISTLSGGR

SEQ ID NO: 83232 - protein, 157 aa, Triticum aestivum
MQEFYVRFKGPAETPFEGGTWKVHVELPDTYPYKSPSIGFVNRIFHPNIDELSGSVCLDVINQTWSPMFDMINIFEVFLPQLLRYPNPTDPLNGEAAALLIREPKSYDAKVKEYVQKYASKEAADEAGAESEDDDELSSVASFGDDDDEPAGQMDDV

SEQ ID NO: 83233 - protein, 91 aa, Triticum aestivum
MALRALYNEIRSMKVRDVPAYLKPRLTWDNVKKSADQAVDRYIEKYIDTSSPDPLYHVCIGGMIFSYFVNLPWERAHLAHLEEMERTGGKH

SEQ ID NO: 83234 - protein, 713 aa, Cryptococcus neoformans var. neoformans JEC21
MTSSKPLHQLPFAARTLQSSVPQLPLSSQPSAQRRSTIFKSSTPGIWARVNPMWAPWPIRVSKEEAEDLGINVEKGEKIDAEDIMKSWEPCEVLEQGAENGLDVKSSKRRVKLDPVILGISPSALKDSLPHLDVGDLLEICKTGEQPTSGDPAREIFIDVLSGRKILASDSYGPWATRYSGHQFGGWAGQLGDGRAVSVLETESEQGGRQEIQLKGAGRTPFSRADDGLAHLRSGVREFLGCEAVAALGIPTTRALTLLTIPLPYLPVFREGTIHPSSLLTRVAPSFIRVGHFEALNPPSSAAGGKQFFVGGGGWVDDQTDEEGEDEGNGNFEGLRDLGEWMKEIMEVKEGWKSWVDEVIKKNAEMVAKWQVYGYMNGVINTDNVTLMGITIDYGPYAFMDVFDQKHISNQSDPTGMYAYRNQVSRVQFALSKFIDSVSPLLGYESIHGDIPKGWSEGKTKEDIKEWSEKGKEVMKGWEKSFEEYEEESEMNGWYQRFGLKTKQQFDQRDIKYDFLNYLQLHNLDFHTAFRGLCEFSPTKASQESGDKYIKEFVPHWVKSAVDESASDDSLKLVEGDFVQWFGMYAKRANLEDEKFAWGTTDDWEPARAANMRKKNPTFVLRQWILEELLGKMEEALTDPYKAAQSKDDVDKQKVEEGVRTARRELWKILEMATKPFENWGQGEGSREELEAQRRLCGVGAKEMFGYQCGCSS

SEQ ID NO: 83235 - protein, 372 aa, Azoarcus sp. EbN1
MLRHPDPDGLLEYSVVYTDRSLNHMSRAFQGVMNDISRMLKEVYNAKSAIVVPGSGTFGMEAVARQFATGRKCLVIRNGWFSYRWTQIFDMGNIPAESIVLKARPVEDGPQAAFAPAPVEEVVRTIREQKPDVVFAPHVETSSGMMLPDAYLRAVADAVHSVGGLFVLDCIASGTIWVDMQALGIDVLISAPQKGWSGSPCCALVMLGEGARAKIETTTSTSFACDLRKWLQIMEAYENGGHMYHATMPTDALTTLRDVMKETRDYGFDKVRGEQQELGDSVRALLTRKGFKSVAAEGFQAPGVVVSYTSNPEIQSGRALSVQGLQIAAGVPLQCDEPADFRTFRIGLFGLDKLHDVERTVRYLDAALNRAG

SEQ ID NO: 83236 - protein, 428 aa, Azoarcus sp. EbN1
MGTSADELNALRVATGAAGGSVPPLDVARLRADFPILTREVNGRPLVYLDNAATSQKPRCVIDAQAHYYAALNANVHRGVHRLSQEATDAFEAVRDTVQRFVNATHREEIVFVRGTTEAINLVANSFGGRFRPGDEILVTAMEHHSNIVPWQLACERSGAVLKVAPVNDEGELLVAEFEHLLGNRTRIVALAHVSNALGTINPVREFIDMAHARGVPVLLDGAQAVPHGAVDVQALDCDFYAFSAHKLYGPTGIGVLYGKAALLDAMPPWQGGGDMIRQVSFAGTTYNELPYKFEAGTPDIAGAVALGAAIRYVEETGIAAIAAHEDALLEHATRQAHATPGLRLVGTARNKAAILSFVFDDIHAHDVGTILDHEGVAVRAGHHCAMPLMERFGLPSTVRASFAMYNTHDEVDALFAALRRVREVFDG

SEQ ID NO: 83237 - protein, 194 aa, Zea mays
APAFCELSLPLTKEKAAFSPSDPAMQRHVASGRPSGTDGSDFSYRMVVESRYQRVAEGRSRLARLILVQALHLVAGGLLLLLSLSKGAAVNKFAVLSMAAGFLAIVVGELGRMRTMSVLLRLYTSLSSIAVAFSVTCIIRSELFLKVMKQNTEAITSYEMLDAVRVALGILLQMVVIATTTRLLQNMSPPKRAS

SEQ ID NO: 83238 - protein, 423 aa, Trichodesmium erythraeum IMS101
MSPETIVQQSLETSNAYTTFSADNFNTYVMNTYGRFPIAIERGEGCRVWDTEGKEYLDFVAGIATCTLGHAHPVMMATVSEQIKRLHHVSNLYYIPVQGELAQWLIQHSCADKAFFCNSGAEANEGAIKLARKYAHEKLNIENPTILTAHASFHGRTLATMTATGQPKYHKGFSPLMPGFYYVPYNDIAAIESAIEELDKDKRQVAAIMLEALQGEGGIRPGDMTYFKRIREICNEKGILLILDEVQAGMGRSGKIWGYENLGIEPDIFTSAKGLGGGIPIGAMLCKSHCDVFEPGSHASTFGGNPFACAVALAVCHTLEQENLLANVQQRGDELRIELKAIADKYPNLFSEVRGWGLINGLELNATATLTSIDIVKAAMNEGLLIVPAGPKVLRFVPPLIVTETEVKEAMDLLAKAIANTVN

SEQ ID NO: 83239 - protein, 410 aa, Candidatus Protochlamydia amoebophila UWE25
MNPLEKSAVNRLRQDFPMLNKMMHGHPLIYFDSAATTQKPSAVIDCMSDFYRNHYGTVHRAVYELAIHSTENYQDTRLKVQRFINAANTEEIVFTRGATDSINMVAYSFGKVFVKPGDEILISAMEHHANIVPWQILCEDRGAVLKVIPMNKKGELLFDEYVKLLSPKTRLVAITHVANSLGTINPIKEIIKKAHEAGAKVLVDGAQSAPHLKIDVQDLDADFFVFSGHKLMGPTGIGILYGKAEILDQMPPYQGGGDMIEKVTFVKTTYNQLPLKFEAGTPMIAEVMGLGAALDYLNQIGIERIQTYEHTLLEYATKKLMQIPDLHIIGQAVNKTSLISFVIEEIHPLDIGTFLDLKGIAIRTGHHCAQPVMQFFNIPATARVSFAFYNTADEIDRLHLALSDIIKRLK

SEQ ID NO: 83240 - protein, 571 aa, Acidobacteria bacterium Ellin345
MHADILLQISLAILVATGLALLAKLLRQPLILAYIAGGIIVGAVQGFGWVQTDVIEPISELGLILLLFMIGLEIDLKKLKSAGAPVLATGIVQFFACVGLGFAFFPLIGFSLRTGGLSVLYLSVACALSSTMIVVKLLYDKFEIDTVPGRITLGVLVFQDIWAILFLAIQHDLSHPRPLLLLLSLAKGIAVVAVAFAASRYLLPILFRSIAKSPELVLISALAWCFGVAMVASYVGLSREMGALIAGVAISTFPYNMDIVAKIITLRDFFVTLFFVTLGTKVPRPTFGLLLIAVGVSIFLNLSRFLTVFPVLHRFKEGNRASFLPALNLGQISEFSLVICALGVSVGHISDRILSVVLYTLVITSVTSTYAIMASHRIFTFVNRGLIAVGIHDLGDPAGEMEKPEPRPIVFLGFSRASSSMLVELLEMEPERKDEIAIIDFNPEAKAELDRRGLHVIYGDISHRDVLHHAGVEEAKLVISTIPDSLLKGTSNLKLLRMIRGLAPEADVIVTAEFFSHARELYAAGATFVFIPRLMSAVDLAGAVFAIMADQGEQLRERAQEALRDRDEVLP

SEQ ID NO: 83241 - protein, 459 aa, Trichodesmium erythraeum IMS101
MLLDQSSISNLLNKQRKFFATGKTKNIDFRIEQLKGLKQAVSDYQNKIVAAVKADLNRAEFEAYFELTFFPEINDGIKKLKSWAKPRRVSTPIEQFPAGAKIYQEPLGVVLIIGAWNYPFQLVIHPLLGAIAAGNCAIIKPSEIAVNTSEVVADLIAHTFDSSYIAAVTGGVEKSQQLLAEKFDHIFFTGGTRVGKIVMEAAAKSLTPVTLELGGKSPCIVDDDIQLEYTAKRITWGKFINAGQTCVAPDYLLVNKSVKSDLLEKIKQSIDKFYGKNPANSPDYGRIINEKQFNRLNHLLEEGKIFIGGETKSEELYISPTVIEGVNWDSGIMEEEIFGPILPVLEYENLDEAIALVNSRPKPLSLYFFSRNKQKQEQVLRETSSGNVCINDTVMQFVVRFLPFGGVGNSGIGSYHGKASFDTFSHYKSVLNKGLWFDLKFRYAPYKNKVGLIKKIIFW

SEQ ID NO: 83242 - protein, 371 aa, Bifidobacterium longum DJO10A
MSDARQIEADIYERLSKVIDPELGRSVTDLGMIAAIEAAPASSDAGTYDVTVHVELTVPGCPLSETITSQINGAVSSYPGAQLLPHIEVGSMSRGKLADLVADLKAERKQNPFSKPGVKTRIFAIASGKGGVGKSSVTANLAATFAALGFDTAAIDADIYGFSLPRLFGVHTQPTNLNGMLMPVTAWGVKLISIGMFAGADRAILWRGPRLQRSLEQFLSDVWWGEPDVLLLDLAPGTGDMAISVAQALPNAELVVVTTPQPSASDIAVRSGLVALQVPMKVRGVVENMSYYEHKGEKLEIFGAGGGQRVSEQLTQALGYDVPLMAQLPLEPEVRETGEAGRPAVLDADGALRTDGIGQTFRGLAERLLAV

SEQ ID NO: 83243 - protein, 186 aa, Zea mays
  misc_feature (148)..(148): Xaa can be any naturally occurring amino acid
YICFMQIGPLFRQLMPMMEASPVYSVARNASGDAWKALFDLAGGLLREYDQEATVSLSKFIDQLPSVMNQVTEGVSEFKPTPPENREFCKNSYSVPNTLLVKFTVDAIDDTDIVEDVLRPRVDSIGGQIKKVILSGTHLTPCIQDVKXQVGSEYTPADAIAQGLKSLALSETRVLSRTIADWFTSL

SEQ ID NO: 83244 - protein, 152 aa, Glycine max
  misc_feature (72)..(73): Xaa can be any naturally occurring amino acid
GLITKTWERCKSIGRSRKEASSNSLNTNTNTMRSKSWPNRNRAENKNKNKNSTIVAPEGCFSVYVGPQMQRXXIKTEYANHPLFKMLLEEAESEYGYNSQGPLALPCHVDVFYKVLMEMDSDETHGSCACVKRSPSAYQLLRTSPMLSINHF

SEQ ID NO: 83245 - protein, 341 aa, Beta vulgaris
MDHAADATRTDLMTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 83246 - protein, 311 aa, Escherichia coli O157:H7 EDL933
MALPILLDCDPGHDDAIAIVLALASPELDVKAITSSAGNQTPEKTLRNVLRMLTLLNRTDIPVAGGAVKPLMRELIIADNVHGESGLDGPALPEPTFAPQNCTAVELMAKTLRESAEPVTIVSTGPQTNVALLLNSHPELHSKIARIVIMGGAMGLGNWTPAAEFNIYVDPEAAEIVFQSGIPVVMAGLDVTHKAQIHVEDTERFRAIGNPVSTIVAELLDFFLEYHKDEKWGFVGAPLHDPCTIAWLLKPELFTTVERWVGVETQGKYTQGMTVVDYYYLTGNKPNATVMVDVDRQGFVDLLADRLKFYA

SEQ ID NO: 83247 - protein, 528 aa, Triticum aestivum
  misc_feature (318)..(318): Xaa can be any naturally occurring amino acid
MADTAAAPLLTSHKTRPAKAPSIDDTIETYMGATGALQLLKAVLLAFAWAFDAQQVFISVFTDAEPQWHCTGADASCSAAVASPCALPPGAWAWDRPAVTSVVSEWSLKCAGPALVSLPASSFFAGCLAGGFLLTTLADSLLGRRKMLLVSIVSMSVAGVLTAFSPNVWVYAALRFMSGFGRSMVGTCTLVLSTELVGKRWRDTVCVAGFFCFTLGFLSLPALAYTFREESWRNMYLWTSVPSLCYSILFYFLVQESPRWLLVRGRKQDAIETLQQIASLNGNSITSSFSMLHACTMNNDTAEESSGDSVFATLHSMXWERPWALRRLAAIMTASFGVGMVYYGMPLNVGNLGSNLYLSVTYNALAELPSSILSWLLMGRINRRSSVIALTGAAGVWSLACVIIPQGAARMAAELLSFFATCTAFNVIMMYSIELFPTSVRNSAVGLVRQALVLGGVAAPVLVALGRERSFLSFGVFGLVVGCFGMFAACLPETRGKGMSDTMDEEEHKEAAVAACTVDDADCNSDLV

SEQ ID NO: 83248 - protein, 339 aa, Rhizobium leguminosarum
MSLLEKFERYPLTFGPTPIEHLPRLTAALGGKVDIYAKRDDCNSGLAMGGNKLRKLEYIVPDAIASGADTLVSIGGVQSNHTRMVAATAAKIGMKCVVIQEKWVPHYDAVYDRVGNILMTELMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVIGIDASGTLQQARDQVRKIVDATSELVNLGRSVREDEIVINPDYAYPAYGVPSEETNEAIRLAARTEAMITDPVYEGKSMQGMIDLARKGFFPEGSKVLYAHLGGAPALNGYSYYYKDG

SEQ ID NO: 83249 - protein, 139 aa, Zea mays
  misc_feature (54)..(54): Xaa can be any naturally occurring amino acid
  misc_feature (83)..(83): Xaa can be any naturally occurring amino acid
  misc_feature (99)..(99): Xaa can be any naturally occurring amino acid
  misc_feature (112)..(112): Xaa can be any naturally occurring amino acid
MKFNIANPSTGCQKKLEIDDDHKLRAFYDRRISQEVCGDALTDDVKAYVFKILXGCDKHGFPMNQGCLTSARVRLLIHTGTPXFRGYGSSNVEQPEQDXLAGCIASQDLSVXNLMIVKNAENDLSALTDSENIRMRGPN

SEQ ID NO: 83250 - protein, 339 aa, Rhizobium leguminosarum
MSLLEKFERYPLTFGPTPIEHLPRLTAALGGKVDIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVTGIDASGTLQQTRDQVRKIVDATSELVNLGRSVREDEIVINPDYAYPAYGVPSEETNEAIRLAARTEAMITDPVYEGKSMQGMIDLARKGFFPEGSKVLYAHLGGAPALNGYSYYYKDG

SEQ ID NO: 83251 - protein, 183 aa, Glycine max
  misc_feature (164)..(164): Xaa can be any naturally occurring amino acid
MFLNIANPSTGAQKLIDIEDEKRVRVFYDKRISQEVAGDTIGDEYKGYVFKITGGVDKDGFAMKQGVLTNNRVKILLDGSTGHYRPLRDGERRRKAVRGCICAADLAVVNLAIGKKGDAELPGVTDTTVPRRLGPKRASRIRKLFNLSKEDDVRQFVIRRTIPXKKDGKKAQINAPRIQRLAT

SEQ ID NO: 83252 - protein, 446 aa, Alkalilimnicola ehrlichei MLHE-1
MSLFALGLNHKSAPVNIREQIVFAPDAVTAALQHLRAHTTAREAAILSTCNRTELYVRMDDRAPEMLGEWLARYHRLDPEWLRDYLYLHEGAGAVRHLMRVSAGLDSLVLGEPQILGQAKIAYQGAIDAGTMGRVLDRLFQHAFSVAKQVRTDTGIGANPVSVAFAAVTLARQIFDDFQNRTALLIGAGETIELVARHLREQGLKNLIVANRNLERARQLVELEGGEAIPLSEIPTRLPEADVLVASTASPLPILGKGTVERAVRKRRHRPMFMLDLAVPRDIEPEAGNLDDVYLYTVDDLREVIAENRRSREEAAHQAEEIVQRQVDQFLSWRRAQQAVASICDFRERGHAHARELLQRANRRLRCGEPPERVLAWLSHTLTNRLLHAPTVGLREAAEAGDRERIELARTLLQIENANEDTRESVDKEQTGTTQGAARGDQRSTG

SEQ ID NO: 83253 - protein, 501 aa, Opitutaceae bacterium TAV2
MSKTHSDIGLIGLAVMGQNLALNIADHGFQISVYNRTTEKTDKFVADNPSTPGGLVGTKTLEEFVQSLSRPRKMIILVQAGKATDAVIDGLIPLLEKDDIIIDGGNALWTDTIRREKALKEKGLRFIGSGVSGGEEGARFGPALMPGGDKAAYKELEKIWNAVAAKVDRKTGRPLLGAAPGKPVKGGVPCATYIGENGAGHYVKMVHNGIEYGDMQMICEAYAVLKGLLGLKAPQIGDIFATWNKGALDSFLVEITADILKQKDPVTKKPFVDIVLDTAGQKGTGKWTSVNALDMGVPAPTIAESVFARCLSAVKEERVAASKILKGPKAKKFTGSQKALIEAVHDALYSSKICSYAQGFQLMREAQKEYNWKLNFGQIAQIWRGGCIIRAAFLQKITEAYARNPKLANLLLDPYFNKTIQKAQANWRKVVALAVENGISIPTFSSALAYYDGYRADRLPANLLQAQRDYFGAHTYERTDVKRGKFFHIDWPKPNRPQYEA

SEQ ID NO: 83254 - protein, 318 aa, Alkalilimnicola ehrlichei MLHE-1
MNDNGRMMVFAGNSNPQLAESIAEHLKTRLGHAVVGRFSDGEIMVEVNEHVRGKDVFVVQSTCAPSNDNLMELLVIIDALRRSSAARITAVIPYFGYARQDRRPRSQRVPISARLVANMLEAAGVNRVLTVDLHADQIQGFFNIPVDNVYASPMLLGDIWRQLYPRKIVVSPDVGGVVRARAIAKRLDDADLAIIDKRRPRANESKVMNIIGDVQDKTCIIVDDMVDTAGTLCEAAKVLKDKGAFKVVAYITHPVLSGNAINRISESHLDELVVSNTIPLSSEAQSCDKIRQLSIADILAETMRRVSQDESVSELFVE

SEQ ID NO: 83255 - protein, 339 aa, Rhizobium leguminosarum
MSLLEKFERYPLTFGPTPIEHLPRLTAALGGKVDIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVIGIDASGTLQQTRNQVRKIVDATSELVNLGRSVREDEIVINPDHAYPAYGVPSEETNEAIRLAARTEAMITDPVYEGKSMQGMIDLARKGFFPEGSKVLYAHLGGAPALNGYSYYYKDG

SEQ ID NO: 83256 - protein, 192 aa, Triticum aestivum
EPRLACHLVFSNPKGPPLMGSSATSFAPFQGFKLAAGLPVNPRSNRAGLNSVRNGGRIRCIQVWPIEGIKKFETLFYLPPLSTEALLKQVDYLIRSKWVPCLEFSKVGFVFREHNSSPGYYDGRYWTMWKPPMFGCTDATQVLNEVEEVKKEYPDAYVRVIGFDNLRQVQCVSFIAFRPPGCEEFGKASTSS

SEQ ID NO: 83257 - protein, 363 aa, Alkalilimnicola ehrlichei MLHE-1
MGFKCGIVGLPNVGKSTLFNALTQAEIPAENYPFCTIDPNVGVVPVPDPRLDRLAEIVKPEKVIPTTMEFVDIAGLVAGASKGEGLGNQFLAHIRETDAVAQVLRCFEDDDVHHVDGRVDPISDAETINTELALADLETVEKALSRVERQTKSGDKEAVAKRDVLLRVRDGLGEGHSVRSLALDEAARALIADLHLITIKPLMYIANVAEDGFEDNPLLDQVRELARAEAAEVVPVCAAIEAELAALDDEDKAEFLAEYGLEEPGLNRVIRCGYRLLGLQTFFTAGKKEVRAWTVRRGATAPEGAGRIHTDFQRGFIRAEVVSYDDFVACNGEQGAKEAGKLRLEGKDYVLAEGDVVHFRFNV

SEQ ID NO: 83258 - protein, 243 aa, Synechococcus sp. WH 7805
MRKPVIAGNWKMHMTCAQTRDWMGTFLPLIAETPDDRHLVVAPPFTAISTLATVGAGSRVEISSQNVHWEGHGAYTGEISPAMLQEHGVSYAIVGHSEPRKYFSESDEQINHRARSAQAHDLIPIVCVGESDEQRSRGEAERVIRRQVEQGLEGLDPARLVVAYEPIWAIGTGKTCESAEANRICGLIRSWVGSPDLIIQYGGSVKPANIDELMGMSDIDGVLVGGASLDPEGFARIANYQKA

SEQ ID NO: 83259 - protein, 290 aa, Azoarcus sp. EbN1
MKKVTKAVFPVAGMGTRFLPATKASPKEMLPIVDKPLIQYAVEEAVAAGITDMIFITGRTKRSIEDHFDKAYELETELEARGKKEMLALVQRTVPKGVNCIYIRQSEALGLGHAVLCAAPVIGDEAFAVILADDLLDNPDSASIMEQMVGVYNYNRCSVLGTMNVPREETRQYGIVSTEAQQGDVQRVTGIIEKPKPEDAPTTQAVVGRYILTPRIFDHIRALQPGAGGEYQLTDAIAALLKDEAVLSYQFKGVRYDCGSKLGYLKATIELGLRHPEIGEEFAAYLAERS

SEQ ID NO: 83260 - protein, 387 aa, Oceanicola granulosus HTCC2516
MPRAEARAIRHGFPWVYANELVLDRRTKALAPGTLAVLEDAERRPMGLVAVNPLSKIAARMLDRAPDATIDEAWFEARLTRALAHRARLYEAPFYRLVHAEADGLPGVVIDRFGGAAVIQPNAAWADRRLPELVAALQRVTGVTTVLKSATGRTRALEGLDAEGGVLAGERPGGPVAVPMNGARYMADLAGGQKTGLFYDQRPNHAFAAGLARGGRVLDVFAHVGGFGLAALAAGAESALAVDGSAAALGLARAGAEESGLAARFETREGDAFEVMAALGEEGETFDLVVCDPPAFAPAKPALEAGLRAYERVARLAAGLVAEGGYLVLCSCSHAADLARFRNASARGIGKAGRRGPLVHTGFAGPDHPLLPQLAESGYLKALVFRL

SEQ ID NO: 83261 - protein, 462 aa, Streptomyces seoulensis
MANDASTVFDLVILGGGSGGYAAALRGAQLGLDVALIEKDKVGGTCLHKGCIPTKALLHAGEIADQARESEQFGVKATFEGIDVPAVQKYKDDVISGLYKGLQGLIASRKVTYIEGEGRLSSPTSVDVNGQRIEGRHVLLATGSVPKSLPGLQIDGDRIISSDHALVLDRVPKSAIILGGGVIGVEFASAWKSFGADVTVIEGLKHLVPVEDENSSKLLERAFRKRGIKFSLGTFFEKAEYTQDGVKVTLADGKEFEAEVLLVAVGRGPVSQNLGYEEQGVNIDRGYVLVDEYMRTNVPTISAVGDLVPTLQLAHVGFAEGILVAERLAGLKTVPIDYDGVPRVTYCHPEVASVGITEAKAKEIYGADKVVALKYSLAGNGKSKILKTAGEIKLVQVKDGAVVGVHMVGDRMGEQVGEAQLIYNWEALPAEVAQLIHAHPTQNEALGEAHLALAGKPLHAHD

SEQ ID NO: 83262 - protein, 522 aa, Pseudomonas syringae pv. tomato str. DC3000
MRWLNRHKFLPFLAWLPQQSRASVGRDALVGLSGAILALPQSIAYALIAGLPPEYGLYAAIVPVLIACLWGSSWHLICGPTAAISIVLYVSVSPLAVPASQDYIMLILLLTFIAGVFQLLLGMMRFGALVNFVSHSVVLGFTLGAAVVIALGQMPNLLGIDLPSQTTALKSLSAVLEHRGELDKPSLMLGLLTLTLGIGLKAWVPRWPTLLIALVSSSLLVWLWPAMFGHVRVVSAFVGHLPPFSPLPLDLELILKLLPTAVAVGMLGLVNSLSIARSLSARSQQMLNANQEVRAQGLSNMVGSLFSGYLSAGSFTRAALSYEAGARSPLAGVFSALWVALFAVAGASLVSHIPIPAMAASILLICWGLVDRRGIRALLRVSRAEFFVMALTCLATLLLELQTAIYAGVLASLFFYLKRTSQPRVQQWREGDEDVLRVGGSIFFGASHYLQTRLQRTEGLRVVIDAQQINFIDYSGVEMLHQEARRLGQQGRVLVLRNARPLVIEELHKLEGPENCPILFED

SEQ ID NO: 83263 - protein, 137 aa, Brassica napus
  misc_feature (109)..(109): Xaa can be any naturally occurring amino acid
MQSSVHREKASSIAMILETRRNVEFPHRNVDKRPRKRPRLAWDAPPPPLPPPSTVFHPPLYYGPEFASGVVPSFGYPNMFYTGLPRQGSPPWRPDDKDGHFSFVVGDTXTPRYQILSKMGEVDGSEGDDDEEDEDDD

SEQ ID NO: 83264 - protein, 398 aa, Azoarcus sp. EbN1
MNPNLDRLQSYPFEKLRKLFEGLTPPAGLDTIRLSIGEPRHATPAFITQALVDNLDGLSAYPATQGSDALRGAIAGWLERRYGLPAVDVATQVLPVNGSREALFAFAQCVVDSRGGAAKVLCPNPFYQIYEGAALLAGAEPVFLNNLPENRFGSDFDSLPESVWRDVQLAFVCSPGNPTGRVLSLQEWARLFELSDRHGFVIAADECYSEIYFDENAPPVGALQAAHQLGRGDFRNLVTFSSLSKRSNVPGMRSGFVAGDAAVLKAFLRYRTYHGCAMNPAVQAASVAAWNDEAHVVDNRRLYREKFDRVTALVARHLKVERPDAGFYLWAQTPIPDTEFARRLQGEYNVTVLPGSFLAREANGVNPGAGFVRIALVAPTAECVEAAERIAAFCQSLP

SEQ ID NO: 83265 - protein, 2706 aa, Vitis vinifera
  misc_feature (130)..(130): Xaa can be any naturally occurring amino acid
  misc_feature (181)..(181): Xaa can be any naturally occurring amino acid
  misc_feature (263)..(263): Xaa can be any naturally occurring amino acid
  misc_feature (276)..(277): Xaa can be any naturally occurring amino acid
  misc_feature (282)..(283): Xaa can be any naturally occurring amino acid
  misc_feature (292)..(292): Xaa can be any naturally occurring amino acid
  misc_feature (680)..(680): Xaa can be any naturally occurring amino acid
  misc_feature (693)..(693): Xaa can be any naturally occurring amino acid
  misc_feature (711)..(712): Xaa can be any naturally occurring amino acid
  misc_feature (906)..(906): Xaa can be any naturally occurring amino acid
  misc_feature (916)..(916): Xaa can be any naturally occurring amino acid
  misc_feature (918)..(918): Xaa can be any naturally occurring amino acid
  misc_feature (931)..(931): Xaa can be any naturally occurring amino acid
  misc_feature (950)..(950): Xaa can be any naturally occurring amino acid
  misc_feature (961)..(961): Xaa can be any naturally occurring amino acid
  misc_feature (967)..(967): Xaa can be any naturally occurring amino acid
  misc_feature (974)..(974): Xaa can be any naturally occurring amino acid
  misc_feature (979)..(979): Xaa can be any naturally occurring amino acid
  misc_feature (999)..(999): Xaa can be any naturally occurring amino acid
  misc_feature (1007)..(1007): Xaa can be any naturally occurring amino acid
  misc_feature (1037)..(1037): Xaa can be any naturally occurring amino acid
  misc_feature (1068)..(1068): Xaa can be any naturally occurring amino acid
  misc_feature (1071)..(1071): Xaa can be any naturally occurring amino acid
  misc_feature (1089)..(1089): Xaa can be any naturally occurring amino acid
  misc_feature (1105)..(1105): Xaa can be any naturally occurring amino acid
  misc_feature (1161)..(1161): Xaa can be any naturally occurring amino acid
  misc_feature (1311)..(1311): Xaa can be any naturally occurring amino acid
  misc_feature (1525)..(1525): Xaa can be any naturally occurring amino acid
  misc_feature (1613)..(1613): Xaa can be any naturally occurring amino acid
  misc_feature (1876)..(1876): Xaa can be any naturally occurring amino acid
  misc_feature (1880)..(1880): Xaa can be any naturally occurring amino acid
MESRKGNGIKVSRGSRKSSSSRLEREIQKLECPVNYNCSLLSVREKGESNGGFSHFETLIQVTVPSLASVFNEYALKSQFETSIYLQVSVGLRINLAKSEIIPVGEVEEILEMAVELGCKMSLFRMPRVXARRLEKLQRDFLWGGGSMERKAHLVNWERVCMGKEKGGLGLRKLIPLNKAXLGKWVWRFANAKEEMWKRVLVAKYGQEEFGWRTKKANGAFGVGVWKEVMKEADWCWDKMNFKVGKGTKVRFWKDPWCGEVEXARRFPQLFNMAAXXSATVXXLWDHNTDLXSWNLRFLRGFNDWELVMVAELLQILRNQRITMEEDLALWKGGKNGKFEVKEAYELLISHSTLIFPKKGIWVENVPSKLAFFAWEATWGGGVLTLDRLQKRGWQLPNRCYLCGMDEENVNHLLIHCTVARVLWGIVLGLVGAQWVFPESVKEWRGVSLPYRFPGVDSLQLRVDWFFVVFLNLFLYGYGAIFNFLGIIGTAILKAKYISGLWEIKMSERERSRESASEGVREIDSDGKMHRAENRRKRKTNSFGVESKAFELEMVEKGGTTLTIMESKKGVSSWVRMGLNSVGLLMEGLQQCIKDRRDGNWEKRWKEKGRSFSMVRVYNRAGCFLRVGVVDEVSKRYNICIPKGKGSKGGWTAMVEALCQLGIIADRKVQQEGTRISGRXSPEKVKGRSFADXVKAWGEKEPSPIRVEVGXXEISRNISRLEHCLIGNWNPNNEIGEDLENLGWKMAKAWGLKGKMGIASMGKGRALLEFELAEEARKVHLSGNKVVGGVRLGLERWNPRSGCMEEGEISKEVWVRILGLPVSLWVPSVLRRVGDACGGFLDVDPKTERMEELEWARILIKSDGANTPGSLVIGIEEISYSLSLWWESVPVLRQEEGRKCCLSDRXRGEVSGDVTXRXGSRVKEKVGVGIXVQRQMGDGTCRLLQREGTXERVFSHVGQLXGPDSWXGSAGPSXLKNQXVGPSLNPMGDQLGLRQVSNXGRATVDGXGHLQKGKSILNQAHVVDNGPLLKIFSPGLXDKNRNAFMEHEFINYRVEEIGRRQQSVPPSXDTXRMLEEEAARYGLDVNLGXLRVQGASSSNSFCFGXSPEKEGYDHSGMQREGAVIGSGSRNPNVEDRIEKRNGCWDLVEINSVEPLGRKLGXMADQTEPQEGSKEDQLNWEESSLVRFSQFLGFSTEGLEVEILNFLDKIRKRKEKIIETKVQVMSDEMVRSLGPGRFLDWKVLNAKGTAGGVIICWDKRSLEILGVEEGQFSISCRFRNEGDGAIWVFTGVYGPFSREBREGLWEELGAIXGLWEEPWCLGGDFNITLYLDDRNRTGRITSAMRRFAQIIDELGLVDIPLQGGIEVSGRPSYRLAIKLKGLKQNLKTWNKEVFGRLEKNKADALQQVESWDSVEEVRSLTEVELNQKKEAKESYEKWVSMEEVHWRQLSRELWLREGDRNTGFFHRMANAHRRINAMSKIMINGVRFTEDQDMREGIANAYQQLLSENPGWKADIGGLLMNQISXSEADGIEVPFSETEIFTALKGMNGDKAPGPDGFTLAFWQNSWETVKEDLLGLFKEFHDQNSFIKSLNHTFLVLIPKKGGVEDLGDYRXISLLGGLYKLLAKVLANRIKKVIGKVISPDQNAFIKGRQILDGSLIANEVIDSWQKRGEKGIVCKLDIEKAYDSINWQFLLKVMQKMGFGSKWIGWMWYCISTVKYSVLVNGVPAGFFSSTKGLRQGDPLSPYLFIMGMEVLSVLITRATEGGFIKGCRIWRDREQAVKVTHLLFADDTIIFCEAKKEALLHLGWVLFWFEAASGLKINLDKSMVIPVGEVDGVLDMAAEIGCRVGQLPTVYLGLPLGAPNRDVSAWDGVEEXTRRXLSLWKRQYLSKGGKLTLIKSTMSSFPLYQMSVFRMPKSVARRIEKLQRDFLWGGANGGTKSHLVKWEAVCVEKEKGGLGLRKITILNKAFLGKWIWRFACAKEELWKKVLEAKYGKEEFGWRTRKANGAFGVGVWKEILKESTWCWENMGFKVGKGSKIRFWTDLWCGNSVLSQDFPNLFSMAAHRNVTVEECWDQNTGQGGWILGLLRDLNDWEVGSVGNILAVLRDYSVTMEDDAVCWKKGEDGLFKIKYAYNVLANSHGLDFPHSNVWVGKVPTKIAFFAWEATWGKVLTLDRLQRRGWHLPNRCFLYGCEEETINHILIHCTVAKGLWNIILALCGVQWVFPNSVKEGWAKVYINMESKSLIGFLEWLLTLELSYWDLPEVFNRNLVQMLTGCSYLESLCLKIRGAEFDATFFWSIEHFLPNTVKILKLQPVLEQDVIRFIRELRVNRNILETAEFGIPFSPASPGFKLQSLSLVLDIISDELISSITNSLPFLIELHLEDRPSKEPSPFHDLTNSGLQSLRFCHHLTDISLIRSRHNLPVYFKRINDMGMFLLSEGCRLLESVRLGGFCRVSDAGFASILHSCWHLKKFEVRNALLLSDLAFHDLTGAPCSLVEVKLSSCNLITSETVHKMASFQKVGGADVTDRGLSVLSQGYSPISHLCLRGCKRVTDKGVSLLFHGCGVISKTLTALDLGHMPGISDKAILTIAAVGTGITELCIRYCFYVTDSSVEALATKRRLQDGRKPLRKLDLFHCTGLSIKSLESLKRPFFQALKWIGLGRTCLSGKGNEICNERPWLTLCLDGCEMGCHDGWHFHRPETRDH

SEQ ID NO: 83266 - protein, 363 aa, Zea mays
MGIYLSTPKTEKASEDGENDKLRFGLSSMQGWRATMEDAHAAHPCLDESTSYFGVYDGHGGKAVSKFCAKYLHLQVLKSEAYLAGDLGTSLQKSFLRMDEMMRGQRGWRELAILGDKIEKLSGMLEGFIWSPRSSEANDRVDDWAFEEGPHSDFTGPNSGSTACVAVVRGNKLVVANAGDSRCVLSRKGQAHNLSKDHKPELEAEKDRILKAGGFIQVGRVNGSLNLARAIGDMEFKQNKYLPAEKQIVTADPDITSVELCDDDEFLVIACDGIWDCMSSQQLVDFIHQQLKTENKLSAVCERVFDRCLAPTAGGEGCDNMTMILIQFKKPSSSPDASSVMNQPQSSAQSSEADRSSETVESK

SEQ ID NO: 83267 - protein, 420 aa, Agrobacterium tumefaciens
MSEKRVQPLARDAMAYVLAGGRGSRLKELTDRRAKPAVYFGGKARIIDFALSNALNSGIRRIGVATQYKAHSLIRHLQRGWDFFRPERNESFDILPASQRVSETQWYEGTADAVYQNIDIIEPYAPEYMVILAGDHIYKMDYEYMLQQHVDSGADVTIGCLEVPRMEATGFGVMHVNEKDEIIDFIEKPADPPGIPGNEGFALASMGIYVFHTKFLMEAVRRDAADPTSSRDFGKDIIPYIVEHGKAVAHRFADSCVRSDFEHEPYWRDVGTIDAYWQANIDLTDVVPDLDIYDKSWPIWTYAEITPPAKFVHDDEDRRGSAVSSVVSGDCIISGAALNRSLLFTGVRANSYSRLENAVVLPSVKIGRHAQLSNVVIDHGVVIPEGLIVGEDPELDAKRFRRTESGICLITQSMIDKLDL

SEQ ID NO: 83268 - protein, 553 aa, Plantago maritima
MVFDSETMKGTVDMLATSDHSSVVSITLFVTLLCACIVIGHLLEENRWMNESITALIIGVGTGVVILLISQGKSSHLLVFSEDLFFIYLLPPIIFNAGFQVKKKQFFRNFMTIMMFGAFGTMISFTIISLGAIVFFGKMDVGLAIGDYLAIGAIFAATDSVCTLQVLNQDETPLLYSLVFGEGVVNDATSVVLFNAVQNFDLSHISTAVAFQLIGNFFYLFISSTVLGVVTGLLSAYVIKTLYFGRHSTDREVAIMMLMAYLSYILAELFSLSGILTVFFCGIVMSHYTWHNVTENPRITTKHTFATLSFVAEIFIFLYVGMDALDIEKWRVASNSPKTSVAVSATLLGLVMAGRAAFVFPLSFLSNLTKKAQHEKIGLKQQVTIWWAGLMRGAVSMALAYNQFTKGGHTQERGSAIMITSTITVVLFSTVVFGLMTKPLVRFLMPPHSLLRMISTDSLTPKSFAVPLLGESLDSEADLFLGNGITSESREIIRPNSLRMLLRTPTRTVHYYWRKFDNAFMRPVFGGRGFVPFVPGSPTEQSVHNNWPEEPKQ

SEQ ID NO: 83269 - protein, 459 aa, Rubrobacter xylanophilus DSM 9941
MSAGNGTMTVQEAIDRIGFGRFQKRLLAVCGVTWVADSAEILMLGFALPSIIAEFAISPAQAGLIATATFAGMLVGAWFWGTVSDYIGRRTGFQLTVLTFAVFGLLSAFAPSWEWLAVLRFITGFGLGGALPLDFSVYAEFLPSENRGRNLVILESFWAVGTILAAGLAWLLVPSFGWRPLLAASALAALLVLWIRKSIPESPRFLAISGRADEAKEILTGIAAENGRPAPEQTLVAGERQGGVTVTRLWVPGIRRSTLMLWIAWFCVALAYYGIFTWLPSTFAEQGFSPLRTYQSTFILALAQLPGYFSAAYLIERIGRRNTLGLYLLASGVFTFLFATASGFGWILTASILMSFFSLGAWGALYAWTPELYPTEIRATGMGWASGMSRIAGVFAPILGGILFGLATTAGGSLLYVLSLWSASFIVGGIVVFLLGVETKRRALSDTVSDSSEEVAKEV

SEQ ID NO: 83270 - protein, 76 aa, Magnetospirillum magnetotacticum MS-1
MLLPVRTVGVMGDSRSYDYACALRAVTSTDGMTADFYPFDMAFIGRVANRIINEVKGINRVTYDITSKPPGTIEWE

SEQ ID NO: 83271 - protein, 339 aa, Rhizobium leguminosarum
MSLLEKFERYPLTFGPTPIEHLPRLTAALGGKVDIYAKRDDCNSGLAMGGNKLRKLEYIVPDAIASGADTLVSIGGVQSNHTRMVAATAAKIGMKCVVIQEKWVPHYDAVYDCVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVIGIDASGTLQQTRDQVRKIVDATSELVNLGRSVREDEIVINPDYAYPAYGVPSEETNEAIRLAARTEAMITDPVYEGKSMQGMIDLARKGFFPEGSKVLYAHLGGAPALNGYSYYYKDG

SEQ ID NO: 83272 - protein, 339 aa, Rhizobium leguminosarum
MSLLEKFERYPLTFGPTPIEHLPRLTAALGGKVDIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFISDYIIVCVVTGSTQGGMIVGFVALDRADRVIGIDASGTLQQTRDQVRKIVDATSELVNLGRSVREDEIVINPDYAYPAYGVPSEETNEAIRLAARAEAMITDPVYEGKSMQGMIDLARKGFFPEGSKVLYAHLGGAPALNGYSYYYKDG

SEQ ID NO: 83273 - protein, 545 aa, Flavobacteria bacterium BBFL7
MITVENIAVEFSGTTLFKDVSFVINPTDKIALMGKNGAGKSTMMKIIAGEQKATRGHVRTPGDTVIAYLPQHLLTSDDCTVFEETAKAFKHVTSMKKEMDELNEALTTRTDYESAEYMAIIERVTDLGEKFYALEEVNYDAEVEKALKGLGFKQEDFTRPTSEFSGGWRMRIELAKILLQKPDLILLDEPTNHIDIESVIWLEDFLVNKADAVMVISHDKAFIDNITNRTIEVTMGQIHDYKATYSHYLVLRADRRSHQIKAYQEQQKFIADTKAFIERFKGTYSKTNQVNSREKMLEKLQLIEIDEVDTSALKLSFPPSPRSGDYPVTVKDVSKSYGNHVVFKDANMSIARGEKVSFVGRNGEGKSTMIKAILNEIEVEGNCQLGHNVKVGYFAQNQAALLDNDLTIWQTVDEVAQGDVRTQLKNILGRFMFSGDDLEKKVGVLSGGEKTRLAMVKLLLEPVNLLILDEPTNHLDIKSKDVLKEALSTYDGTLILVSHDRDFLQGLSEKVFEFKDQRVIEHFETIDAFLERNRIKNIADINLMG

SEQ ID NO: 83274 - protein, 624 aa, Flavobacteria bacterium BBFL7
MEPFIVSARKYRPETFEDVVGQSAITKTLENAIASNHLAQALLFTGPRGVGKTTCARILAKKINQQNAEVDPDEDFAFNIFELDAASNNSVDDIRSLTEQVRIPPQVGNFKVYIIDEVHMLSTAAFNAFLKTLEEPPAHAIFILATTEKHKIIPTILSRCQIFDFKRITVADMRGHLKRIAGIEGITADDEALHIIAQKADGALRDSLSIFDRVVSFSGKDLTVQAVTENLNVLDRETYFNISDLIITSNIPQLLVDYDVIMSKGFDGHHFIAGLASHFRDLMVCKDERTLHLLDVSDSVKVKYAEQSRKVDLVFLREAINLSNEADFKYRSSRNPRLHIELCLMQLASILTDGEKKNDVNYIIPASNFKNQPVAAEATSSYQTPQHTVNKIDAAPPVAQTNQPVEVKELNKSDSDNHNQAVDILKDKKEINTPIGSSIVSNQTSRLDKVPAQPNSNKSIEEARKALLDRNKNKVSGLSIQAINAKKAHVVKNNHDQVDTDALPEEEFTELQAQESWSSYAAHLRERGQLILASIMEADTPKLNGNHLVLRYPNLSMKEDLEKAQGQVLEHIKASLKNYTIELEIHVDKAVQKKYAYTDHEKFLKLVEKNPAIDLLRRNFDLEF

SEQ ID NO: 83275 - protein, 447 aa, Alkalilimnicola ehrlichei MLHE-1
MKITIFGTGYVGLVTGTCFAEAGNDVLCVDIDEERIEQLNDGEVPIYEPGLEDMLACNMDEGRLRFTTDAAEGVAHGQFQFIAVGTPPDEDGSADLSHVLAVARTIGEHIDDYRVVVDKSTVPVGTADRVHAAILEAMEARGVDVAFDVVSNPEFLKEGAAIEDFMKPDRIIVGAENPAAVALMRDLYAPFNRNHDRLIFMDVRSAELTKYASNAMLATKISFMNELSNLAERLGADIEEVRRGMGSDPRIGYHFIYPGCGYGGSCFPKDVQALARTARQAHYEPELLDAVEAVNHRQKRHLVRRIRHYFEDNLERRTFALWGLAFKPNTDDMREAPSRVIMEALWDAGARVRAYDPEAQDEAARLYPDEAGLELCGSPYDALEGADALIICTEWQVFRSPDFDRMRRLLSEPVIFDGRNLYDPEKMLAAGFVYYGIGRGESVDTLI

SEQ ID NO: 83276 - protein, 553 aa, Alkalilimnicola ehrlichei MLHE-1
MSDSAVPRLTESAAWQALGARAGDLRGWRPPLKGTQGEQRFRRFSLQLDGLFFDYARQPVDETTRDLLLELARERRLPERIRALFAGEPVNATEGRPALHTLLRAPEGSAFPVHGADARAAVRTELARMTRFVDRVHRGLVHGWDDRPFTDVVNLGIGGSELGAAMAVQALSRFHQREAPRMHFASGSDGVQLEDLIRRLDPATTLFIVASKSFTTSETLLNARAALHWLEACAPEGAHLARHWVGVSANEEGMARFGIPEEQRFRIWDWVGGRYSVASAMGLPVALAVGMRHFQDFLAGMHAMDRHFEEAPLPVNLPVIAGLLQVWSINFLGAHTHCVLPYHQRLARLPAWLQQLEMESLGKRVDSGGRPVDYHTGAVVFGETGFHAQHSFAQLLFQGSCPVAVDFLISREDASGLAVFHGVAQAQALGQGRALMTGRDRATLAGEMIRAGVDEEQRQALLAHREIPGGRPSNTLVFPRLDPYNLGRLIAFYEHRTFVQASIWDINPFDQWGVELGKQLTRALLPAVTGETDPAADLDASSCGLIRILRGAD

SEQ ID NO: 83277 - protein, 329 aa, Vibrio angustum S14
MGLLVDGKWHTDWYDTKSTGGKFERKASSFRHWVTKDGQAGPSGEAGFKAEPHRYHLYVSLACPWAHRAIIYRKLKGLEPLISMSVVNAFMGEDGWNFLSGDDVIADPIINAEFMHQIYTHADPHYTGRVTVPVLWDKQNQTIVTNESAEIIRMFNSAFDDVGANSLDFYPEALQTEIDALNDFVYVNINNGVYRAGFATTQEAYDEAVVTLFNALDTIEARLTENRYLLGDKITEADWRLFTTLVRFDAVYVGHFKCNLKRLVDYPNIWGYLRDLYQVPSIADTVNIDYIKAHYYGSHETINPTRIIPKGPVLDFSEPHCREKLGAEL

SEQ ID NO: 83278 - protein, 339 aa, Rhizobium leguminosarum
MSLLEKFERYPLTFGPTPIEHLPRLTAALGGKVDIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGRMIVGFAALDRADRVIGIDASGTLQQTRNQVRKIVDATSELVNLGRSVREDEIVINPDYAYPAYGVPSEETNEAIRLAARTEAMITDPVYEGKSMQGMIDLARKGFFPEGSKVLYAHLGGAPALNGYSYYYKDG

SEQ ID NO: 83279 - protein, 486 aa, Vibrio angustum S14
MDMKSLYIDGNYVAASSDIQFTTINPANGQSIATIGQASQADLELAISAAKKGFAIWSAMTATERSRILLRAVALLRERNDELAVLEVTDTGKPLQEAIAVDIETGADVIEYFAGLAPGLQGEQQPLSENQFFYTRREPLGICAGIGAWNYPIQIAMWKSAPALAAGNAMIFKPSEETPLSVLKLAEIFTEAGLPDGVFNVVQGDYRVGQMLTVHPEIAKVSFTGETGTGKAVMADSAQTLKSVTMELGGKSPMIIFDDANVDHAVSAAMVANFYTQGEVCTHGTRVYVHEAIYDTFIEQLKRRTELLIVGDPMNMETQIGALISTSHLSKVLSAIDAAKQSGATLLTGGYQCTDNGLAHGNFVQPTVFIDCDESMSHVQNEIFGPVMSVIKFSDENDVIARANNTHYGLAAGVFTQNLAKAHRVIHQLQAGICWVNTWGDSPAQMPVGGYKQSGIGRENGIETLQHYTQTKSVLIELGDYQSPYA

SEQ ID NO: 83280 - protein, 325 aa, Pseudomonas syringae pv. tomato str. DC3000
MAKRIQFSTVGGPEVLEYVDFEPEAPGPQAVVVRNKAIGLNFIDTYYRSGLYPAPFLPSGLGAEGAGVVEAVGDEVTRFKVGDRVAYGTGPLGAYSEVHVLPEANLVKLADSVSFEQAAALMLKGLTVQYLLRQTYQVKPGEIILFHAAAGGVGSLACQWAKALGAKLIGTVSSPEKAAHAKALGAWETIDYSHEDVAKRVLELTDGKKCPVVYDGVGQDTWLTSLDSVAPRGLVVSFGNASGPVSGVNLGILAQKDSVYVTRPTLGSYANNAQNLQTMADELFDMLASGKLKVDGIEQYALKDAAKAQIELSARRTTGSTILIP

SEQ ID NO: 83281 - protein, 634 aa, Zea mays
  misc_feature (614)..(614): Xaa can be any naturally occurring amino acid
MASTAARRLLLPLLLVALIAAHRAAARFVVEKNSLRVTSPAVLRGVYECAIGNFGMPQYGGTMHGVVVYPKADAKACRPFADSGLSFKPRSGGLPVFLLVDRGDCYFTTKGWNAQNAGAAAVLVADDRVEPLITMDSPESSGTEHIENITIPSALVTKRFGEDLRKALQSGDMVNVLLDWRESLPHPDERVEYELWTNSNDECGAKCDMQMSFVRSFRGIAQALEKRGYTQFTPHYITWYCPEAFVLSKQCRSQCINHGRYCAPDPEQDFSTGYDGRDVVLQNLVQICVFRVANGTRRPWMWWDYVHDFAVRCPMKEKKYTRECANGVINSLGLDIEKINKCVGDPEADKENPVLKAEQDAQIGHGSRGDVTILPTLVVNNRQYRGKLEKTSVLKAVCSGFEETTEPDVCLREDIETNECLENNGGCWLDKATNVSACKDTFRGRVCECPIVNGVKFIGDGYNHCEASGLGRCQINNGGCWNETRNGKSVSACSNQEAKGCKCPAGFKGDGANSCEDVDECKEKLFCQCKDCACENTWGSYECSCGGGNSLYIREHDTCISKHSSSTPGWGFLWVVFLGLALAGAGAYAVYKYRLRSYMDSEIRAIMAQYMPLXESQDMPSQQHHLVPVDRADV

SEQ ID NO: 83282 - protein, 195 aa, Guillardia theta
MIRSLKLATVAALLVLATVGAEAKKKGPKVTTKVFFDITIDGKDAGRIVMGLYGKSVPQTAENFRALSTGEKGFGYEGSIFHRVIKNFMIQGGDFTRGDGTGGKSIYGERFADENFKFKHTKGGLLSMANAGKDTNGSQFFITTVPTPWLDGKHVVFGEVLEGMDLVHKIENSKTDGRDKPEKEVKIAKSGELKE

SEQ ID NO: 83283 - protein, 125 aa, Zea mays
MPSTVNSASLDQNLELAKQCSREAALAGFKAAAVATVASAVPTVSVLHLSQHLVSVRMLPWAKANINPAGQALIVSTVAGMAYFIAADKKILSLARQHSYENAPEHLKDTSFQGTGRPHPGFFRP

SEQ ID NO: 83284 - protein, 403 aa, Zea mays
MASSMLSATTVPLQQGGGLSEFSGLRSSASLPMRRNATSDDFMSAVSFRTHAVGTSGGPRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPTYVVGVNADQYNPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELTGILEVCDVPLVSVDFRCSDVSSTIDASLTMVMGDDMVKVISWYDNEWGYSQRVVDLADICANQWK

SEQ ID NO: 83285 - protein, 415 aa, Zea mays
MMKHSSSLCLLFLLALCTTLLACGLVQAQVLFQGFNWESCKQQGGWYNRLKTQVDDIARAGVTHVWLPPPSHSVSPQGYMPGRLYDLDASKYGTAAELKSLIAAFHGRGVQCVADIVINHRCAEKKDARGVYCIFEGGTPDDRLDWGPGMICSDDTQYSDGTGHRDTGEGSDAVGFDGWRLDFAKGYSPAVARMYVESTGPPSFVVAEIWNSLSYSGDGKPAPNQDQCRQELLDWTRAVGGPAMAFDFPTKGLLQAGVQGELWRLRDSSGNAAGLIGWAPEKAVTFVDNHDTGSTQKLWPFPSDKVMQGYAYILTHPGVPCIFYDHMFDWNLKQEISTLSAIRARNGIRADAWVRILVADADAYVAVVDEKVMVKIGTRYDVSSVVPSDFHPAAHGKDYCVWEKASLRVPAGRHL

SEQ ID NO: 83286 - protein, 126 aa, Azoarcus sp. EbN1
MAYSEKVLDHYENPRNVGAFGKEDEGVGTGMVGAPACGDVMKLQIKVGKDGVIEDAKFKTYGCGSAIASSSLVTEWVKGKTVDQALEIKNTQIAEELALPPVKIHCSILAEDAIKAAVADYKKKQG

SEQ ID NO: 83287 - protein, 673 aa, Cryptococcus neoformans var. neoformans JEC21
MSAETATSPAPAAETPVAPAPATQTTPAEGAPTPAAAAPGGNTVSASLYVGELDPSVTEAMLFEIFNMIGPVASIRVCRDAVTRRSLGYAYVNYLNAADGERALEHLNYSLIKGQSCRIMWSQRDPALRKTGQGNIFIKNLDQSIDNKALHDTFAAFGDILSCKVGTDENGKSRGFAFVHYSTGEAADAAIKAVNGMLLNDKKVYVGHHVGKKERLSKVEELRAQFTNVYIKNVDLEVTDAEFEDLVKPFGPTISVALSRDEKGVSKGFGFVNYENHESARKAVDELNEKEVNGKKLYAGRAQTKSEREAELKKSHEEKRLENEAKSAGVNLYVKNLDDEWDDDRLRAEFEAFGTITSSKVMRDDSGVSRGFGFVCYSSPDEATKAVSEMNGKMIGTKPLYVALAQRKDVRRQALESQIAQRAQQRMQYGAGFPGMQGYMGQPMYGYPPMPGYGQPMPGMPPVRGPMMGYPGAPQNMMQSRPRFNPNGQPLPGGVPAYGMPPQVPYPGAPGYPVRPGGARIPAAPNANGPRNGGPSPVGAPQGLPAGSIPRGGQMPARPHEQAAPAPQAGRLDAQSLARAAPAEQKQMLGEALYPLIHETQPELAGKITGMLLEMDNAELLHLVESQPALQEKVDEALRVLAEWGKDEKPAADEGAEEPKKEEEETKEEEKKE

SEQ ID NO: 83288 - protein, 172 aa, Synechococcus sp. WH 7805
MDLRQYVRDIPDFPKPGILFRDIAPLLREPTGWAEVIRRLIAVCERWQPDLIVGIESRGFIVGTALATQLQKGFVPVRKPGKLPGEVIGIDYTLEYGSDRLEIHADALTDHPRVMLVDDLLATGGTASASAELVTKAGGVLVGCGFVIELAELDGRRKLPAGVPVESLIIYE

SEQ ID NO: 83289 - protein, 446 aa, Listeria monocytogenes str. 1/2a F6854
MAKFTYDVVIIGSGASGTTVAFEAQAAGLKVAIVEERNWGGTCVLRGCDPKKVLIGAREARNLSTRLRGKGIKQAATISWTDLMAFKETFVENVPESRLASFQEAGIETFLGAASFQDSHSLQVGDDLIYAEKIVIATGATPSTLKVEGKEYIQTSDDFLSLEKLPDSVVFIGGGYISFEFASIALAAGRDVHIIHHNSEPLKKFDPDFVAALVANIKDEGIHFHFDTDITKIENDGGKLHIKGKDSFSLQTDLIIGATGRMPNIAHLSLENASIDYTKKGIVVNEKLQTSNNSHIYACGDVAATKGAPLTPVVSLEAALVAKNVIGGNEKITYPAIPSVVFTSPKLASIGISTEEAKANPEKYQIKNHDTTSWYTYKRTNEQIALAKIIEDRESGQIKGAHFLSEEADYMINYIAILMKANLTLADLQSVIFAYPSPASDLTALN

SEQ ID NO: 83290 - protein, 403 aa, Listeria monocytogenes str. 1/2a F6854
MKIIVQKFGGTSVQNEKSRLMAFNHIKQVLKEGYKVVVVVSAIGRYGDPYATDTLLELIGAKNTKLTAREQDTLLSVGETISASVFTNMLKEANIKAEAFSGGQAGIITSDDHLNAKITEVDTARLKDALTNLDVAVVAGFQGITANGDISTLGRGGSDTSAAALGVSLQANYIDIFTDVDGMMTADPRIVEHARSLPRVSYNEVSNMAYQGAKVIHPRAVEIAMTAKIPMRIRSTYLESTGTLVTSLADDSGHFDVKERMVTGVAHVTNLTQISVQTDTVKAQQLAFKILADAGISLDFINISTNSVIFTVPEEKSHVVKQLLEDADLQTTVRQACAKVSIVGAGITGVPGVTAKIVGALSEKNIPILQSADSHTTIWVLVREKDLISAVNALHDVFCLEIK

SEQ ID NO: 83291 - protein, 73 aa, Synechococcus sp. WH 5701
MLLHNDPVNSMEYVMATLRQVVPQLSEQDAMAVMLEAHNTGIGLVIVCDIEPAEFYCETLKSKGLTSTIEPED

SEQ ID NO: 83292 - protein, 323 aa, Rubrobacter xylanophilus DSM 9941
MSSEGRVMSRIASATVCVVASYAVGLSMAVDRFPRPGETRIGHGFVQGPGGKGSNQAIQAARLGARVELVACVGDDAYGREALDLWCREGISTEHVVQVGDHPTGVGFILVDESGQNSIAIDPGANDALGPRMIDAAQGAFDRSAVCLVQLEISLESAAHALRKAKEAGCITVLNPAPARRIPDEVWGYVDVITPNEGEAAVVLGEEGNEENLGKLLLERVNLAAVVTLGEKGALVLEKSGAVQRVPAFPVPTRDTTGAGDAFSGALGLRLAQGSDVVEAARWGAAAGALTCTVPGVVPALPDRKALLRLLSGNEELAVRGGA

SEQ ID NO: 83293 - protein, 807 aa, Oryza sativa Japonica Group
MSVLLGFLLLLSLHPPTSYATTDTVSPGQTLAGGDRLISNNSKFALGFFKMDSKNSSYTSRNSYLCIWYNKLPMITPLWSANGENPVVDPASPELTISGDGNMVIMDQATKSIIWSTRVNTTTNGTVVVLLNDGNLVLQSSSNSSMVFWQSFDYPTDSLFADAKIGWNKVTGLNRRLVSRKNSIDQAAGLYSLEFDINGVGHLVWNSTVTYWSSGDWNGQFFGSAPEMFGATIPNFTFVNNDREVYLTYTLNNEKAITHAAIDVNGQGLAGVWLDSLQDWLINYRMPLLHCDVYAICGPFTVCNDNNDPFCDCMKGFSIRSPKDWEIEDRTGGCMRNTPLNCGSTMNKTGFSDKFYYVQNIILPRNAMHVQEAASKDECSDVCLSNCSCTAYSYGKGGCSVWHDELYNVRQQSDASAVGNGDNFYIRLAANEVHEVQSAERKKKSGVIIGVAIGASTAAFCLMILLLMFWRRKGKLFARGAENDQGSIGITAFRYIDLQRATKNFSEKLGGGSFGSVFKGYLNESTPIAAKRLDGTCQGEKQFRAEVDSIGMIQHINLVKLIGLCCEGDKKLLVYEYMPNGSLDVQLFKDNDKVLDWNLRYQIAIGVARGLAYLHDSCRDCIIHCDIKPENILLNESFVPKIADFGMAKILGREFSHALTTMRGTIGYLAPEWISGTVVTAKVDVYSYGMVLFEILSGRRNSSQEYFKDGDHSAYFPMQVARQLINGGIGNLVDAKLHGDVNLEEAERVCKIACWCIQDSEFDRPTMGEVVQFLEGVLELKMPPLPRLLNAITGGSHSTPLSSLDLP

SEQ ID NO: 83294 - protein, 293 aa, Magnetospirillum magnetotacticum MS-1
MSRKHPVIAVTGSSGAGTSTVKESFEHMFRREGIKPAVIEGDSFHRYNRADMKKCMKDVGGTFSHFGPEANLFPQLEELFSTYGETGRGRRRFYVHNDEEAARFAHLGVGSGEFTPWEDLAEDTDCLFYEGLHGCVATRDNNVAQHVDLKIGVVPVINLEWIQKIHRDTNQRGYSEEAVMETILRRMHDYVHYVVPQFKLTDINFQRVPIVDTSDPIIARDIPTADESLVVIRFRKPDRFRVDFPFLLQMLKDSWMSRRNTIVVPGGKMGLAMELILTPILRRIMEDRRAVLG

SEQ ID NO: 83295 - protein, 133 aa, Zea mays
MASFTASASTVSVARPALLLKPTLAISAPVLGLPPMGKRKGGVRCSMEPKQGNVSAVGAGVSAAATAALTAVMSNPAMALVDDRMSTEGTGLPFGLSNNLLGWILLGVFGLIWTFYFTYTSSLDEDEESGLSL

SEQ ID NO: 83296 - protein, 342 aa, Triticum aestivum
MPPAEGAAAGLGVSEFALPDGVLAVLPRDPYEQLDLARRITALAVAGRVTGLEREAARLREGAAERDRENAELRDRVALLDRALQETNARLRAALEDNIQLSKERDSLAQTSKKQARDLHKLESFKRHLMQSLRDDSTSPQETVDITTCDQSVSSKTSSCGDGSISHTAANLLNGSGDLGSTTREAARTPVQKYALSPHINQRLTPEATPNIMSTSASPRGMSTTATPKLVSGATSPSRTRIEGHMSMTPWYSSKQSSAANSPPRGRPNPGRTPRIDGKEFFRQARSRLSYEQFGAFLANIKELNAHKQSREETLKKAEEIFGPDSKDLYLSFQGLLNLSLP

SEQ ID NO: 83297 - protein, 145 aa, Triticum aestivum
AEKFGPSSGSFAQRNSKAQKKTLNMQPRQPTNDNDINRHPQTLTRRASYPCENYETERKGLGKRTLGDPQVTMGTSMVVDGSFVSSVSSDNSVEESSFRQLQDAVSQLDVQTKLCIRDGLYRLARSAQHRQVFPNMMNNNGDSQD

SEQ ID NO: 83298 - protein, 168 aa, Brassica napus
MSSSDQSPSHNVFVYGSFQEPAVVGLILECTPVIVSAQLHGFHRYRLKGRLHPCIAPLETGVIDGKVLTGLTDAHLENLDMIEGDEYVRKTVEVLLTDTSGKMQVEAFIWANKDDPDMYGEWDFEEWKLLHMEKFIEASEKFIEWKKNPDGRSREEFAKFVEEDPPVA

SEQ ID NO: 83299 - protein, 339 aa, Rhizobium leguminosarum
MSLLASFERYPLTFGPTPIEHLPRLTEVLGGKVQIYAKREDCNSGLAMGGNKLRKLEYIVPDAIATGADTLVSIGGVQSNHTRMVAATAAKIGMKCVVIQEKWVPHYDAVYDRVGNILMTRLMGADSRLVDDGFDIGIRQSWEDAIQSVKDAGGKPYPIPAGASVHKYGALGYVGFAEEVAAQEEELGFIFDYIVVCVVTGSTQGGMIVGFAAQDRAEQVIGIDASGTLQQTRDQVRGIVDSTAELVGLGRAIRESEIVINPDYAYPAYGVPSEETNEAIRLAARTEAMITDPVYEGKSMQGMIDLTRKGFFPEGSKVLYAHLGGGPALNGYSYYYKDG

SEQ ID NO: 83300 - protein, 628 aa, Vibrio angustum S14
MVTINIDGNSFQVDKDQNLLEAAQQCGIEIPSLCDIDTFTDECALCDVEITGKGIVKACKIKPTDGMVVTTSSQLLSNIRKCNLERILQRANTNCSVPPCQIACPASVDIQSYLYFIAHNEHLKAIEVIKKTLPMPLSIGRVCPAFCEAKCQRNLVDEPLAIRQLKRYAADIDLEKINSYTPIKKDDKGKRIAIVGAGPGGLSCGYFLSNEGYNVTVYEAMPQAGGWLRYGIPEYRLPKDILDKEIDIMCRNGMSIETNKKLGEDFTLSSLSEEFDAVCLAIGASQASEMKYTGSDLAGCYLGVDFLKDQTLDKQYTIGKKVAVIGGGNTAIDCARSALRLGADTTLIYRRTRDEMPAEIYEIEEAEHEGVKFHFLTNPAENIADDNGHVCQIKLEKMALGEPDASGRCSPKATGEYFVEDFDTVIAAVSQKTDTSFIANEDIELSFSRWNTINVDETTMHSGVKNIFAIGDFRRGPATAIEAIADGRKAAKGIDEFFGGTMEKLYTESFRSRNVERSHLIQPEHIEKLKRVMASIATGDNAKQTEQMLNHALAKVLRAKMPELTLAQRHLSFNEVETGLSQQAAIDEANRCLSCGCDEGNDCKLRHYATDYKVDRKLFINRAIPLAN

SEQ ID NO: 83301 - protein, 294 aa, Gossypium arboreum
DHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRSVECTGSVQAMISAFECVHDGWGVCVLVGVPKKDDAFKTHPMNLLSERTLKGAFYGNYKPRTDIPMVVDKYLNKELGLDMDKFITHSVPFADINKAFDYMLQGIGLRCMIHLDA

SEQ ID NO: 83302 - protein, 339 aa, Rhizobium leguminosarum
MSLLASFERYPLTFGPTPIEHLPRLTEVLGGKVQIYAKREDCNSGLAMGGNKLRKLEYIVPDAIATGADTLVSIGGVQSNHTRMVAATAAKIGMKCVVIQEKWVPHYDAVYDRVGNILMTRLMGADSRLVDDGFDIGIRQSWEDAIQSVKDAGGKPYPIPAGASVHKYGALGYVGFAEEVAAQEEELGFIFDYIVVCVVTGSTQGGMIVGFAAQDRAEQVIGIDASGTLQQTRDQVRGIVDSTAELVGLGRAIRESEIVINPDYAYPAYGVPSEETNEAIRLAARTEAMITDPVYEGKSMQGMIDLTRKGFFPEGSKVLYAHLGGAPALNGYSYYYKDG

SEQ ID NO: 83303 - protein, 173 aa, Flavobacteria bacterium BBFL7
MATQGKDLSHYDKSKLPDAAAMRIGIVVSEWNDDITENLYKGAVETLMDCGVDQFNVHRMDVPGSFELIYGCKMMQHRSYPVVNRRTKKPLDAIIAIGNVIRGETAHFDFVCQGVTQGIKDLNLNKTRIPVIFCVLTDDTHAQSVARSGGIHGNKGSEAAIAAIKMAAIKNDH

SEQ ID NO: 83304 - protein, 453 aa, Prochlorococcus marinus str. NATL2A
MKSSFDLIVIGAGSGGLAAAKKAASYGASVAIVEGDLVGGTCVIRGCVPKKLLVCGSSLLESFLSATSYGFDFDNIKIKSEVLLANIRKEVQRLNELHENFLNKANVELFKGWGEFRNSNCVEVKDRKNGETLNELYGERILIAVGGRPKRPSIEGASLGWTSDDMFLLKSFPKKITIVGAGYIACEFACILHGLGVEVTQLVRGDRILRGFDFELSSALTEAMKNKGVNISFGEQISSLKGTPGSLIIKTNAGKEFDSNGLLFATGREPFLDGLKLEQVGIEILENKIKVDSEGKTNISNIFAIGDVTDRINLTPVAIDEGRKFADRNYGESDHKVNYNFVPYAVFSQPEIASVGMTEEKAIQSMGKDNIKVYRSIFRPLSKSLPKTGSKCILKLIVDKNNNKVLGCHMIGDNASEIIQMASISLMLGAKKSDFDNTMALHPTIAEEFVTMR

SEQ ID NO: 83305 - protein, 456 aa, Zea mays
RASVGSLGNVTAPTSSAKLNPTVPLKKPSLATSARSVSSSIRGSADKPASIKPAPPVARHGSATQRHNNVPPPKVPTIADVPSRAPALVSCTGLVSPGRSGDSVSSDETMSTCDSMKSPDFEYVDNQDTSMLASLQRRTSEHLRISEDRDVEENKRKKNAVAPMEIDRICDVDSEYEDPQLCATLASDIYMHLREAETKKRPSTDFMEMIQKDVNPSMRAILIDWLVEVAEEYRLVPDTLYLTVNYIDRYLSGNEIRRKRLQLLGVACMLIAAKYEEICAPQVEEFCYITDNTYFRDEVLDMEASVLNYLKFEMTAPTAKCFLRRFARAAQACDEDPALHLEFLANYIAELSLLEYSLLSYPPSLIAASAIFLARFILQPTKYPWNSTLAHYTQYKPSKLSECVKALHRLCSVGSGSNLPAIREKYSQHKYKFVAKKQCPPQIPSLEFFRDATCLD

SEQ ID NO: 83306 - protein, 420 aa, Zea mays
PMNRRAPLGDIGNLVSVRPAEGSLSCRSRSIAPITRSFGAQLVKNVQANAAIKNAAILPARHAPRQERKAPAKQPPPEDVIVLSSDSEQSRTQLESSASSVRSRKKVINTLSSVLSARSKAACGITDKRRQVVVIEDIDKLDVNNELAVVEYIEDIYTFYKIAQHDRRPCDYIDTQVEINPKMRAILADWIIEVHHKFALMPETLYLTMYIIDQYLSLQPVLRRELQLVGVSAMLIACKIEEIWAPEVNDFILISDSAYSREQILSMEKGILNNLEWNLTVPTVYMFLVRFLKAATLGNIVEKEMENMVFFFAELALMQYGLVTRLPSLVAASVVYAARLTLKRAPLWTDTLKHHTGFRESEAELIECTRCWSAHTRRPHADSKLRAVYKKYSSEQFRTRARVRPPAAAVEINETKITCC

SEQ ID NO: 83307 - protein, 131 aa, Triticum aestivum
MATISAPAATTLVARAAIARPQALGLPHLRTRSERVRCSYSKDAKEATPSAAVPGAGASLLSAAGAVTASAGPALALVDERMSTEGTGLSLGLSNNQMGRIPLGVFGLIWSLYTVYTSGLDEDEESGGLSL

SEQ ID NO: 83308 - protein, 415 aa, Aspergillus oryzae
MSAQYLDVPVLPTDVAFGLLADFDADQDPKKVSLIAGAYRDEKGLPWILPSVKQAKERIAADPRSHHEYLDIAGSPVFLNIARSLVFGTELAESWNVASIQAVSGTGANHLGASFLAKHLKPQHVFIPDPTWVNHKTVWAVAAPEVAQREYPYYDPKTRSIKFADMLSTLDIDAQPNDVVILQACAHNPTGLDLTRDQWKQLADLALKKKLFVLFDSAYQGFATGNVEDDAWSVRYFTEHLLSSPDPDQRIPGLCVAQSFSKNFGLYGERVGALHLVAPSDVSIQGAKSQLSLIARAEYSNPPRFGAQIVQTVLTDPRLREQWQQDLNTMSSRIMGMRKQLRTRLEDLATPGDWSHIESQIGMFSYTGLSKEHVNKLKEEYHIYLMPSGRASLCGLNEGNVDYVARCISKVVKEV

SEQ ID NO: 83309 - protein, 329 aa, Arabidopsis thaliana
MMEVEGSMNRAPDQSSFLRSRRSKALYQFKQQKLPACKPVLTPISVITVFMLMGFVFIPIGLITLRASRDAIEIIDRYDVECIPEEYRTNKLLYITDSSIPKNCTRYLKVQKYMKAPIFIYYQLDNYYQNHRRYVKSRSDQQLLHGLEYSHTSSCEPEESSNGLPIVPCGLIAWSMFNDTFTFSRERTKLNVSRNNIAWKSDREHKFGKNVYPINFQNGTLIGGAKLDPKIPLSDQEDFIVWMRAAALLSFRKLYGRIEEDLEPGKVVEVNLMNNYNTYSFSGQKKLILSTSNWLGGRNDFLGITYLVVGSSSIVISIIFMLLHLKNPR

SEQ ID NO: 83310 - protein, 491 aa, Bifidobacterium longum DJO10A
MSTTDAPKKPRETDDVPVPATLRKSLKNRHIQLIALGGAIGTGLFYGSSESIALAGPSILLAYLVGGFAIFMIVRALSEMSVEDPKAGAFSYYATRYWSKRAGFISGWNYWFNYILVSMVELSVVGSFVNYWFPAIPTWVSAAVFLVIICAANLLGVSKFGEFEFWFAIIKIVAVIAMIIGGLAVIIFVLPTASGVRASFANWFTVGNGFFPNGLMGQNSDGSWTGLLMALVVVMFSFGGTELIGITAGETEDPKTTIPRATNDIIWRILVFYIGALGVIMAVVPWNTIDGKSSPFVQIFDSVGIHAAAGILNFVCLTAVMSVYNSGLYANSRMLYSLAKQGNAPAYLGKLNSRGVPVAGVLTSAAITAIAVVVVFVWPEFAFNYLMSIATIAGIINWTMIMLTEMKFRKVVAAGGAPEDSELAGLSGQEALDAIHFKLPFAKVTPWVVLAFLALVVVLMCFSTSYRIAVIAGVIWLAILFAAYQLTQAKK

SEQ ID NO: 83311 - protein, 449 aa, Oryza sativa Japonica Group
MATRSQNVAAAPQPPQNRGNVAALGKQKAVVAGRPDAKNRRALGEIGNVMNVRLPEGKPLQQAPAGRTANFGAQLLKNAQANAAANKQNAVAPAAVARPAQRQARKAPVKPAPPPPEHVIEISSDSDQSMRQQSEGSASSVRKCSRKKVINTLTSVLTARSKVACGITDKPREVIEDIDKLDGDNELAVVDYIEDIYKFYKVAENECRPCDYIDTQVEINSKMRAILADWIIEVHHKFELMPETLYLSMYVIDRYLSMQQVQRRELQLVGVSAMLIACKYEEIWAPEVNDFILISDSAYTREQILAMEKGILNKLQWNLTVPTAYVFIMRYLKAGASADNKSDKEMEHMAFFFAELALMQYGLVASLPSKVAASAVYAARLTLKKSPLWTDTLKHHTGFTESQLLDSAKLLVTSHSTAPESKLRVVYKKYSSEQLGGVALRSPAVELCK

SEQ ID NO: 83312 - protein, 515 aa, Arabidopsis thaliana
MADSLAPLLPTHIEEDEDTSSPLTFDKILEKSLSDFGFSQFLQIVLVGLALTFDSQQIFITVFTDAYPTWHCLDHTICNPATTDICKIPRSAWDWDGGFKGKSVISEFDLECSSSFLRSLPSSTFYVGSIVGGVVLAMIPDGSLGRKQLLFFSSFAMSLTGISIFLSSNIWIYSFLKFVIGFARSQTGTYALVLISERISTKWRPRATMVPFTLFVLGFMSLSGIAYLVRHASWKVLYLCTSIPAGIHSIFIYFFALESPRWLHLEGKNKEAIEVLKRISPANRGYLESVSSRLRPKETLEQTSSYSIKDLFIIKWAFRRVTLVMIIMFGLGMSYYGVPLAVRDIKVNIYMSEALNAMVELPTFVVTPILLEQFSRRSSVLVNCLIGGASGVLCFVMSLYGRTKIAFALELGSFFCARIGFNLMAIYLVELFPTCVRNSATMMLRQALVVGGACCPLIASLGRNVPSLSFAVFGFAMSGLGLFALLLPETKGLSLCDTMEEQEQRDQALKTSHSC

SEQ ID NO: 83313 - protein, 314 aa, Vibrio parahaemolyticus RIMD 2210633
MPDMKLFAGNATPELAQRIADRLYISLGDASVSRFSDGEVAVQINENVRGSDVFIIQSTCAPTNDNLMELVVMIDAMRRASAGRITAVIPYFGYARQDRRVRSARVPITAKVVADFLSNVGVDRVLTIDLHAEQIQGFFDVPVDNIFGTPVLLEDMQSRGLDNPVVVSPDLGGVVRARATAKALGDIDIAIVDKRRPRANVSEVMNLIGDVEGRDCVIVDDMIDTGGTLCKAAEALKERGAKRVFAYATHAVFSGNAADNIKNSVLDQVIVTDSISLSKEMAATGKVTTLSLSRMLAEAIRRISNEESISAMFN

SEQ ID NO: 83314 - protein, 311 aa, Rubrobacter xylanophilus DSM 9941
MKRFLVDTDTAGDDVTSLLFALRWPGVSLEGITVVAGNVYLHEALENALYTVEISGRARVPVFPGADRPMLRSLVTAHEVHGEDGMGNSNFPKANQRPEKVHAVDAIVDTADRWSGELEIIAQAPLTNLALAVMKDPDLPKRVRRLWIMGGSNNSLGNITPAAEFNFYVDPEAARIVLGAGFNTTVVPWDVCLKDGVLTRPELAPILKMKTKLSEFYLAVNRAAWEFNRTRVGGVDGITHPDSIMTAMAIDEEVILDRERYFVDVECCGSLTRGYSLVDELRVLGKEANAEVVLRADKAKFKEMLARLLED

SEQ ID NO: 83315 - protein, 418 aa, Vibrio parahaemolyticus RIMD 2210633
MSLLAIGINHNTASVDLREKVAFGPDKLGPALEQLREHEAVNGSVIVSTCNRTELYCDVKQGARNKLIDWLAQFHQVSREDLMPSLYVHEEQAAIKHLMRVSCGLDSLVLGEPQILGQVKQAFSDSRDHQAVDSSIDKLFQKTFSVAKRVRTETDIGGNAVSVAYAACTLAKHIFESLSDSTVLLVGAGETIELVAKHLASNGCTKMIVANRTKERAQGLAEQFGAEVISLNEIPDYLARADIVISSTASPLPIIGKGMVETALKQRRHQPILLVDIAVPRDVEAQVGELNDAYLYSVDDLQSIIDSNIEQRKVEAIQAEAIVSEESASFMTWLRSLQAVDSIRDYRKSANEIREELLSKSLQSLAAGADPEKVLRELSNKLTNKLIHAPTRALQSAAEQGEPAKLTIIRQTLGLDDL

SEQ ID NO: 83316 - protein, 439 aa, Escherichia coli O157:H7 EDL933
MSQAKSNKMGVVQLTILTMVNMMGSGIIMLPTKLAEVGTISIISWLVTAVGSMALAWAFAKCGMFSRKSGGMGGYAEYAFGKSGNFMANYTYGVSLLIANVAIAISAVGYGTELLGASLSPVQIGLATIGVLWICTVANFGGARITGQISSITVWGVIIPVVGLCIIGWFWFSPTLYVDSWNPHHAPFFSAVGSSIAMTLWAFLGLESACANTDVVENPERNVPIAVLGGTLGAAVIYIVSTNVIAGIVPNMELANSTAPFGLAFAQMFTPEVGKVIMALMVMSCCGSLLGWQFTIAQVFKSSSDEGYFPKIFSHVTKVDAPVQGMLTIVIIQSGLALMTISPSLNSQFNVLVNLAVVTNIIPYILSMAALVIIQKVANVPPSKAKVANFVAFVGAMYSFYALYSSGEEAMLYGSIVTFLGWTLYGLVSPRFELKNKHG

SEQ ID NO: 83317 - protein, 378 aa, Bradyrhizobium japonicum USDA 110
MALQGLPRTLRLLQVSLIMSAAAPRFHRLAVNDLRREASDAISVTFAIPSELASDYAFTPGQYLTLRTMLDGEEVRRSYSICSGPDDGEIRIAVKKVDGGAFSSWAADELKCGDELDVMTPTGRFGAVAPADTGRIHVGFAAGSGITPILSIVKGVLAREPDSRFFLFYGNRTTDNIMFLEALEELKDRFIDRLSIFHVISGEEQDIPILHGRLDGDKVRVLLRSLVPAGSVDHVFICGPSGMSEDIEATCRDLGIAEERIHVERFVSEFGGKPRPKKAVAPDAPPKAIASLIIDGKRRDVPVAEDEAILDAALRAGVDLPFACKGGMCSTCRAKLVEGEAPMDINYSLEPWELKAGFVLTCQAKPSSERVVVDYDHV

SEQ ID NO: 83318 - protein, 527 aa, Triticum aestivum
MGQCPSAPRYHHHRKPPPPPPSPTAQAASPGFCSAAAAEDAAAEADYTSDLPEELLAVVFGLLGSGDRKRCSLVCRRWLATEASSRLRLALDARAPLLAAAPAILARFSAVSKLALKCDRRAESVGDPALALVAHRLGPGLRRLKLRSVRAVTDHGVAALAAAAINLRKLSVGSCTFGAKGIEAVLRSCPQLEELSVKRLRGLADSEPITVSSPRLQSLALKELYNGQCFSCLITRSPNLKTLKIIRCSGDWDPVLQAIPQGALLAELHLEKLQVSDLGVAALCGLEVLYLAKAPEVTDVGLAALATKSPRLRKLHVDGWKANRIGDRGLATVAQKCAALQELVLIGVNLTSASLELIAANCPTLERLALCGSDTFGDAEISCVATKCASLRKLCIKACPVSDAGMDKLAAGCPRLVKVKVKKCRRVTFECAERLRASRHGALAVNFDTPGGAGELQDASVDESGLLENAGSDVVQDDFDDQIGVPDLLCGTSGRPSGWKAWMSALIPRSLSVSMFRRRPRGSSHNS

SEQ ID NO: 83319 - protein, 339 aa, Rhizobium leguminosarum
MSLLASFERYPLTFGPTPIEHLPRLTEVLGGKVQIYAKREDCNSGLAMGGNKLRKLEYIVPDAIATGADTLVSIGGVQSNHTRMGAATAAKIGMKCVVIQEKWVPHYDAVYDRVGNILMTRLMGADSRLVDDGFDIGIRQSWEDAIQSVKDAGGKPYPIPAGASVHKYGALGYVGFAEEVAAQEEELGFIFDYIVVCVVTGSTQGGMIVGFAAQDRAEQVIGIDASGTLQQTRDQVRGIVDSTAELVGLGRAIRESEIVINPDYAYPAYGVPSEETNEAIRLAARTEAMITDPVYEGKSMQGMIDLTRKGFFPEGSKVLYAHLGGAPALNGYSYYYKDG

SEQ ID NO: 83320 - protein, 404 aa, uncultured marine bacterium 440
MKRLILKFGGTSVGTIEKIKKVANVIKNRFSEDNEIIVVVSAMSGVTDELKAKSGLISKNFDSKELDVLLSSGEQVSCSLLSGALIDLGVKARSWLGWQIPIVTNDNYTSSQIMKIKTDEILNFISKKGVAVIAGFQGISKEIRITTLGRGGSDLSAVAVAKFFQTDSCEIYTDVDGVLTTDPSINKKAKKIDKISYEEMLEMSSLGAKVMQPNAVQASMIDNIPIHVRSTFSEKTGTKIIPESEIDYKKVVTGIAYSKGNAKVSVVGVVDKPGVAADVFEPIGKNNINIDMVIQNTSLDGKKANITFTIKREDLKKTLSLIEKNKKKLNYNKITHDDKLAKVSIIGAGMQANPGVTHKMFRSLADEKINILAISTSEIKISVLIREDLTKKAVKTLHKIFGLN

SEQ ID NO: 83321 - protein, 429 aa, Vibrio vulnificus YJ016
MDFIMDLAFDRQHIWHPYTSTLTPLTCYPVNSASGVYIKLEDGTTLIDGMSSWWSTIHGYNHPHLNQAAHRQIDQVSHVMFGGITHQPAINLCKKLLSLAPNNLEHVFLADSGSVAVEVSLKMALQYWHAKGDRRPKFLTLQHGYHGDTFAAMSVTDPDNSMHSLYKGFLPEHIFAKSPTGGFWDEWKPEDLTDFAQKIEQHHQELAAVILEPIVQGAGGMRIYHPEFLKGVRALCDQYGLLLIADEIATGFGRTGKLFACEHANIQPDILCVGKALTGGYMTLSATLTSKHVADTVCGGEAGCFMHGPTFMGNPLACAVATASLELIEQGQWQQQTKQIESLFSELLPKLDKYDLVKNTRWLGAIGVVETHRPVNMETIQALFVEQGVWIRPFGKLIYMMPPFIGEPAHIEQLVNAIETALQRAECFV

SEQ ID NO: 83322 - protein, 339 aa, Rhizobium leguminosarum
MSLLASFERYPLTFGPTPIEHLPRLTEVLGGKVQIYAKREDCNSGLAMGSNKLRKLEYIVPDAIATGADTLVSIGGVQSNHTRMVAATAAKIGMKCVVIQEKWVPHYDAVYDRVGNILMTRLMGADSRLVDDGFDIGIRQSWEDAIQSVKDAGGKPYPIPAGASVHKYGALGYVGFAEEVAAQEEELGFIFDYIVVCVVTGSTQGGMIVGFAAQDRAEQVIGIDASGTLQQTRDQVRGIVDSTAELVGLGRAIRESEIVINPDYAYPAYGVPSEETNEAIRLAARTEAMITDPVYEGKSMQGMIDLTRKGFFPEGSKVLYAHLGGAPALNGYSYYYKDG

SEQ ID NO: 83323 - protein, 107 aa, Triticum aestivum
  misc_feature (24)..(24): Xaa can be any naturally occurring amino acid
  misc_feature (53)..(53): Xaa can be any naturally occurring amino acid
  misc_feature (57)..(57): Xaa can be any naturally occurring amino acid
  misc_feature (72)..(72): Xaa can be any naturally occurring amino acid
  misc_feature (75)..(75): Xaa can be any naturally occurring amino acid
  misc_feature (95)..(95): Xaa can be any naturally occurring amino acid
  misc_feature (99)..(99): Xaa can be any naturally occurring amino acid
MRGRGIGWSTDKELRKRRDTLSNXKSRAKQMAESFNMSTFANREDLLGQSKKXADDXSRVSGLDNQGIVGLXRQXMKEQDEGLEKLEHTVLSTKXIALXVNEELDLH

SEQ ID NO: 83324 - protein, 552 aa, Cryptococcus neoformans var. neoformans JEC21
MLPLIRRPLQLRAYTSAAFASTPSSSKLSPLALKAAEDVSSKWKGTTANGGKTKIYIGGEFLDSKTDKWLEVRDPASQTLVNTVPETTPDEFRAAVDAASQAFKTWSKTSIMRRQRAMFELQHLIRQHAPEIANSIVLEQGKTYADALGDVGRGLQVVENATAITSTLLGDKLEVANDMDTYVRRLPLGVAAAISPFNFPAMIVLWSAALATVTGNTLIVKPSERDPGATMIIAELCERAGLPPGVINVVHGTVPTVNRICDDPAIKAISFVGSDKAGEHIYNRAIVQGKRVQANLGAKNHAIIMPDANKNLALNSVAGAAFGAAGQRCMALSVAIFVGTAREMIPELIERAKGLKVTGGFEEGADLGPVISPQAKKRIEDYIGSVEEEGGKILLDGRGYNVSEYPDGSFVGPTIVEAVTTMKVYRNEVFGPVLTIVEADTLDDAIAIINANKYGNGASIFTNSGSTARKFEIEAEPGQIGINVAVPVPLPMFGWSGNKASAKGDIPFYGKSGLDFYTYKKTTTSLWPAADAVGNRVSVTFSNDLFLTFSML

SEQ ID NO: 83325 - protein, 372 aa, Pseudomonas syringae pv. tomato str. DC3000
MSFAKKNVIDGISKTPLIDLARINKEISTNVIVKLEKYNPGGSIKDRAAAYIIREAEKKGQLKPGGTIIESSSGNFAISLAMIGAVSGYKVIALVDPKATETNKALMKAYGAEVITVTEKDDTGSYHKTRIKLANDLAKKIPGSYRPDQCFNVLSSLAHYNSTAKEIHEQTSGNIAGVVCAVSTGGQIGGVSEYFKDHLPDVKVTCVDAYGSAVFGGPSHAYKIPGVGLGWTPRNINDTTKIDYFYRAKDESAYIAARLLCRHEGILVGVSSGAVLLAALNLSLHLGNQKPIVAILGDSGERYLDTLYNDDWLNEHGVDTGLELNKLQLLIDNMATPIESPHIKSNYRDDLIGILEVPETTITHFNMLEGRN

SEQ ID NO: 83326 - protein, 310 aa, Candida glabrata CBS 138
MSLKNSTATLKLNTGAEIPVVGLGTWRSAANDGYDSVLAALKLGYRHIDAAAIYGNEDQVGRAIKDSGVPRQEIFITTKLWGTEHRNPAKALDSSLKRLGLDYVDLYLMHWPVALKAHGSEEKDLLNIPKKPDGKTDIDIEDWDFIKTWELMQELPKTGKTKAIGVSNFSINNLKALKNSPKFNTVPAANQVEIHPLFPQTELIEYCKSENILIEAYSPFGSADAPVLKEPELHKLAEKYNISTAQLIISWSVQRGYVVLPKSVHAERIEANLKVLTLKDEDMETITNLSKVKGEKRLVQLDWSPFPTFE

SEQ ID NO: 83327 - protein, 139 aa, Glycine max
METPTVTIPKIGPKPSKKLKLPTPKELISHYESQGMDSQDASLKVIEDLQKALFGVISSGKGKHDKLLTESSRKIDAISNRLTVLDMKLDSKPGYVETFAIGLASGAALKGIGAIVPHIIAPLFQIWNSVFTATKSSPQ

SEQ ID NO: 83328 - protein, 125 aa, Colwellia psychrerythraea 34H
MKNNDEYKDKLTDAAFKVCRLAATEQPFSGIYNDHWQQGLYHCACCEQPLFSSYSKFDAGCGWPSFFAAIETKVAYKSDESHSMQRVEIQCDNCQSHLGHVFDDGPKPTGKRYCVNSLSLKFYSE

SEQ ID NO: 83329 - protein, 340 aa, Synechococcus sp. WH 7805
MRIGINGFGRIGRLVFRALWGRPGIELVHVNDPAGDAATAAHLLEFDSVHGRWDRAISSSAEGFTVEGALLTWSSEKDPTAVPWSERGVEMVLEASGKIKTPETLNPYFERVGLKRVVVACPVKGVVAGAEALNIVYGINHHLYEPDRNRLVTAASCTTNCLAPVVKVVHESFGIEHGMITTIHDITNTQVPIDAFKSDLRRARSGLTSLIPTTTGSAKAIAMIFPELKGKLNGHAVRVPLLNGSLTDAVFELKHSVTVEEVNAAFKAAAEGQLKGILGYEERPLVSCDYTNDNRSSIIDALSTMVVDGTQLKVFAWYDNEWGYSSRMADLTCHVVESEA

SEQ ID NO: 83330 - protein, 106 aa, Oryza sativa
  misc_feature (29)..(29): Xaa can be any naturally occurring amino acid
  misc_feature (49)..(49): Xaa can be any naturally occurring amino acid
  misc_feature (57)..(57): Xaa can be any naturally occurring amino acid
  misc_feature (71)..(71): Xaa can be any naturally occurring amino acid
QTFMMMQPDDVRRGLVGEVVGRCEKKGTXLRAVKLIHVRKSLPESRYDXLSCKPFLXAFVEYIVSGPVVAXMVWEGKQVRSSGRELDGGTNPLCAEPGTSRGDFAG

SEQ ID NO: 83331 - protein, 462 aa, Oryza sativa Japonica Group
MSVQEYLEKHLLSRKIEEAVNAAVRAKAPDPILDGRGEPAVEVSLHTNKAVHRASAAAADAPEGAAADAVRDAEKRKLLARAVADAVRVINDKVSEALVGMDPQQQSQIDQAIMDLDKAHHKAEIGVNSMLAVSIAACKAGAAEKEVPLYKHIAELVGKSATTLPIPAITVINGGTHAGNSLPIQEIMILPVGAKNFEEAMQMGSETYHHLKDIILEKYGSNSCNIGDDGGFAPNISRQWNYAIQYCWSAVNLMAYINRTTLNHRSRELEQQLECVVCYGNKYDMEFKFAEKSGQGFKTADDLIEIYSQLCSEYPLVSIEQPFDKDDWEHSKKFTTLELCQVVGDDLLMSDPERIKRAVNEYTCNALVLKANQVGTVTEAIEVVRQAKDAHWGVMVSHRSGDTDDSFIADLAVGAAAGQIKAGAPCRGECLSKYNQLLRIEEELGSDGVYAGENWRTTASTS

SEQ ID NO: 83332 - protein, 204 aa, Colwellia psychrerythraea 34H
MTLNESIPAIRARVKLSIKEDIPAEIISFTGLVDDKEHIAIVFKSADKQQKSPLVRVHSECLTGDLFHSSRCDCGEQLDESINIMKDNGGIILYLRQEGRGIGLYNKLDAYLFQEQGIDTYEANRKLGFNDDDRNYDDAINMLKALNVSSLHLLTNNPLKIDAIGKEILIESIQNTKTYLKKDNKNYLLAKYELSDHQLESSLI

SEQ ID NO: 83333 - protein, 815 aa, Cryptococcus neoformans var. neoformans JEC21
MAPKPAKTSSKTAKLPTPAATPTRQPSVDTLSKPAVVDTPPTPASPAQVSAPVPPKKFAYPIPSRLSPSTINNTESLLRFIILALICGAAIGSRLFAVIRFESVIHEFRASKVLVNKGFYEFWNWFDPSAWYPLGRTVGTTLYPGLMVTSGLIWHALRAINMPVDIRNVCVLLAPGFSGLTAWATYLFTTEMSTPSAGLLAAAFIGIVPGYISRSVAGSYDNEAIAIFLLMSSFYSWIKAVKTGSSFWGMITALFYGWMVAAWGGYVFITNMIPLHAFVLIVMGRFNNRLYTAYSSWYVIGTIASMQVPFVEFLPIRTSEHMAALGVFGLVQLIGFVEVVRRLVPGKQFQLLLKAFVVAVFCLSFAALVTLTFSGWIAPFAGRFYSLWDTGYAKVHMPIIASVSEHQPTAWPSFYFDLEMLIFFFPAGVFWCFKELRDEQIFIIIYAVLSAYFAGVMVRLMLVITPVVCVSSAIAFSKLLEAYIDPVIPESDEEAGESQTQVVSKSKAKKMAAANANKSGFSFTGILSGKSVSGIFGLDTRFAVVSILSVFLFIFVLHCTYVTSTAYSSPSVVLASRNPDGSQNIIDDFREAYYWIRQNTAEDSVIMSWWDYGYQIAGMADRPTLVDNNTWNNTHIATVGKAMASNEDVAYPILRKHDVDYVLVIFGGLLGYSGDDINKFLWMVRISQGEWPDEVQEVNYFTQRGEYAVDDRATPTMKNSLMYKMSYYRFPELYGGHPAQDRVRGQIIPPNSVTLDTLDEAFTSENWIVRIYKVKKEDPIGRDHKAVTAWNGGKKLKKSPSASEGVKRGSGRPSM

SEQ ID NO: 83334 - protein, 167 aa, Pseudomonas stutzeri
FARACSTTAAPGLRGGYLLNNELTDFAFEPRDAQGKPVANRVEPGKRPRSSMSPTLVFEADGGRLLASVGSPGGAAIIHFTAKTLLGMYGWGLDAQRAINLPNFASYNGPTMLEAGRFPSSSLKALEARGHEVRESEMTSGLQAIQRTASGWFGGADPRREGLVMGE

SEQ ID NO: 83335 - protein, 206 aa, Candidatus Protochlamydia amoebophila UWE25
MKKAVQAKFIKTAILNKDYPIIRSPSGDILPEVAVVGRSNVGKSSLLNHLFEAKHLVKTSATPGKTQALNFFSLNDQIAFADLPGYGYAKVPPSVRKEWGPMVRSYLESRESLKLILFLLDIRRIPNEEDIQFLEWVLYHEKALILVLTKIDKVNQKELRLNTTKILDTLSLMNLHHLYYSVPKNRGRKELMIMIQDALNDEDKQE

SEQ ID NO: 83336 - protein, 338 aa, Glycine max
MAAGVYNQPIVAFQSHSHINNFNHQQKFNNLVRLVTKDFIGSNFLSRRDCRVIQSLASQTSVVDTVSSPSKSKTSDRDTHKKSNEASLILIRHGESLWNEKNLFTGCVDVPLSKRGIDEAIEAGKRISSIPVDLIFTSALIRAQMTAMLAMTQHRRRKVPIIMHNESEQARGWSQVFSEDTEKQSIPVIAAWQLNERMYGELQGLNKQETADRYGKEQVHEWRRSYDIPPPNGESLEMCAERAVSYFRDQIEPQLLSGKNVMISAHGNSLRSIIMYLDKLTSQEVISLELSTGIPMLYIFKEGRFVRRGSPIGPTEAGVYAYTRRLALYRQRLDDMFQ

SEQ ID NO: 83337 - protein, 435 aa, Oryza sativa
  misc_feature (235)..(235): Xaa can be any naturally occurring amino acid
MAAAATAAVPLDEAKAKEVLRQVEFYFSDSNLPRDNFLRKTVEESEDGLVSLALICSFSRMKKHLGLDLDVKQETMPEETVLAVAEVLRRSSALRVTEDGKKVGRSIELSKLDEIMEQVDSRTIAASPFPYNVKLEDVQSFFAQYGKVNSVRLPRHIADKRHFCGTALVEFSEEEEANAVLKNTLVFAEADLEIKPKKEFDTEREAKKEAYEKSQPTKNGHDEGYPKGLIVRKWXAAIVLESTCSMISSSFDNSIDDANKSRTGHDEKIPENSDIKEDLSDDVEKSKEAAAQSVKKGESPSENADDPISREDFKEEFGKFGTVRYVDFSIGEDSGYIRFEDSKAAEKARALAAISDEGGLIMKGHLVTLEPVSGQAEKDYWSAIKGGQGKYRDNRSNRGRDWKNNRGGRHFGGKRGRHSDGHERANKARKVDAAA

SEQ ID NO: 83338 - protein, 512 aa, Arabidopsis thaliana
MVSHPMEKAANGASALETQTGELDQPERLRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPKTRAIAIFALGFWILDVANNTLQGPCRAFLADLSAGNAKKTRTANAFFSFFMAVGNVLGYAAGSYRNLYKVVPFTMTESCDLYCANLKTCFFLSITLLLIVTFVSLCYVKEKPWTPEPTADGKASNVPFFGEIFGAFKELKRPMWMLLIVTALNWIAWFPFLLFDTDWMGREVYGGNSDATATAASKKLYNDGVRAGALGLMLNAIVLGFMSLGVEWIGRKLGGAKRLWGIVNFILAICLAMTVVVTKQAENHRRDHGGAKTGPPGNVTAGALTLFAILGIPQAITFSIPFALASIFSTNSGAGQGLSLGVLNLAIVVPQMVISVGGGPFDELFGGGNIPAFVLGAIAAAVSGVLGLTVLPSPPPDAPAFKATMGFH

SEQ ID NO: 83339 - protein, 418 aa, Vibrio angustum S14
MAAIAVFISIINHKIGRFQTTIAITGWSIAISLILLALTSFGYISIDKENALIELIQHIKFEDFLLKGVLGFLLFAGALNIDLDHLKDQKFEITFLALAGTLFSTFFIGIVLWLIFSLIGIELNFIYCCLFGALISPTDPIAVLAIVKKLKAPQRISTQIEGESLFNDGVGLVIFVTIFEVAFGKTAPTVSGTALLFIREALGGIAFGAVLGGIFHYLIKGSSDNMMRLILTMLIPTFGYVLGEHLEVSAPLAMVVSGILIGNITRKYISEQSANQMAHLWELVDEILNAVLFLLIGFVMITFSFHSIDIIAVIIAIPLVLLSRYLSIRLSYIGFTRYRQYNPESVKILTWGGLRGGLALAMAMAIPAHIYLPSHPDVSVKEIIVLMTYAIVIFSILIQGSTITPMIMKAKAVDNKPF

SEQ ID NO: 83340 - protein, 215 aa, Sordaria macrospora
SFGKVMQVRKKDTNRIYALKTIRKAHIISRSEVAHTLAERSVLAQINNPFIVPLKFTFQSPEKLYFVLAFVNGGELFHHLQKEQRFDVNRSRFYTAELLCALECLHGFNVIYRDLKPENILLDYQGHIALCDFGLCKLDMKDEDRTNTFCGTPEYLAPELLMGNGYNKTVDWWTLGVLLYEMLTGLPPFYDENTNEMYRKILSEPLHFPGPEVVP

SEQ ID NO: 83341 - protein, 272 aa, Vibrio angustum S14
MQSYVIEDRKLTYLDQGTGPVLVLGHSYLWDSKMWQPQIEALSQHYRCIVPELWAHGQADFAPEKTRTLRDYADDVIALLDHLNIDNFSLIGLSVGGMWGAELAIKVPQRVTALVLMDTFLGYEPEVLHAKYFAMLNTIIEQQAIPEAIIDSVVPLFFRRQAEQYTPELVDSFRQHLASLKGDKAVAIAQVGKMVFGRRDTFDDIAQLKAPTLILSGMEDNPRPPLEAQLMHDEIKDSEYVLIPEAGHISNLEQPEFVTKQLEAFLAKHIAR

SEQ ID NO: 83342 - protein, 178 aa, Xylella fastidiosa Ann-1
MRVAIFGTGYVGLVTGTCLAEVGHEVLCVDINQEKVDGLNCGVIPIYEPGLEPMVKANHATGRLRFTTDSVAAIAHGEITFIAVGTPPDEDGAADLQYVLAVARTIGQCIDRPTIVVNKSTVPVGTADQVRAAIQHEMDVRGVDFKFEVVSNPEFLKEGDAVADCMRPDRIVIGARSR

SEQ ID NO: 83343 - protein, 198 aa, Sulfolobus shibatae
ISNSAVSYKPIVNIENIVATVTLEQSLDLYAMERSIPNIEYDPDQFPGLIFRLEQPKVTALIFKSGKMVVTGAKSTEELIKAVKRIIKTLKKYGIKIMGKPKIQIQNIVASANLHVNVNLDKAAFLLENNMYEPEQFPGLIFRMDDPRVVLLIFSSGKMVITGAKREDEVSKAVKRIFDKLAELDCVKPIEEEEELEL

SEQ ID NO: 83344 - protein, 364 aa, Candidatus Blochmannia floridanus
MNNNTYHIAILPGDGIGPEIMQQAYKILNTVKNKFKINIITTEYKVGGNALDLEGSPLPKDTIKNCEKSNAILFGAVGGPKWNNINETSRPEFGALLTLRKHFNLFINLRPIYLPIELINLSPLKPEIISQGLDMICIRELIGGIYFGKPQGKSGIRSQEHAFDTAIYHRFEIERIAHFAFKLAQKRRKHVTSIDKANVLHTSMLWRKVVSEVASNYPNVHLQHLYVDNASMQLIRNPSAFDVILCPNLFGDILSDECAEINGSIGILPSASLNEHNFGLYEPAGGSAPDIAGKNIANPIAQILSTALLFRYSLKLNHVAITIEKAVYKALTLGYRTQDIAYNKQKSVNTDDMGDIIASLIYKL

SEQ ID NO: 83345 - protein, 124 aa, Oryza sativa Japonica Group
MASVWCLSASASAAAPVAAAAAAPGPLGASVASVSLARAAVPSRRRRRWDALVEWEKPKPGRRPDIFPKFSPMKTPLPHPLPADDPLDDDEEEEEEEPQPQEEPQEDDPDKEEPEEDDPDKPTE

SEQ ID NO: 83346 - protein, 359 aa, Cryptococcus neoformans var. neoformans JEC21
MPSNSRQHNIAVIPGDGIGIEVTASTLKVLRAVQKKVGGFELSFDELDYGSARYKAQGSYTPAGWLDHLRKSDAIFFGAVGDPDVPDHISLWELILPMRQTFQQYVNIRPSSILPGIPSRIVGTKPGDLDWIIVRENTEGEYAGQGGRTHVGTEWEVATELAVFTRKGVERVMRFAFETAQSRPKKFLTVVSKSNAQRYGLLLWDEVAEIVSKDFPDVKWDKMLVDAMTVRMVAKPTSLDTIVTTNLHGDILSDLAAGLSGSIGIAHSASLDPTRTSPSLFEPVHGAAFDIMGKDLANPIAAIMSAAEMLRWLGENEAADLVEKACKQSIADGQTTGDLGGKLKTSQVTEAVCKILETL

SEQ ID NO: 83347 - protein, 190 aa, Candida glabrata CBS 138
MGAKASKLSKEDLTSLKQSTYFDRREIQQWHKGFLRDCPNGYLTRDDFIRIYKQFFPFGSPEEFAGHLFSVFDKDNNGYIDFKEFITVLSTTSRGTLEEKLVWAFQLYDLNHDGFITFDEMLTIVASVYKMMGSMVKLDEDEATPELRVRKVFKIMDKDEDGYITLEEFREGSKVDPSIISALNIYDGLV

SEQ ID NO: 83348 - protein, 309 aa, Candida glabrata CBS 138
MKLIAAETPQKKFAMRTIEDSLKELEGLLHGGRVLRLPDLDHRYTIMSYENYEQRSADVPRQQICDTSRQRDNAYKVVPVTHTTHSADINSDFITNYKLSTPTQGLTTNVRTNPTVDVLTESKPNYQYYNKPTKLKASVKRKKSLAIVPAWVNVPEFSRFFVIKSISLDHIKKSFYNSIWSSTHFGNRKLSQAYKELKAGAKIFLFFSVNASGRFCGVAEMSSDLQDCLDTSLWDDSSKYGAAFRVRWVLVKDLKNAHLKRFLIPENEMKPITKSRDTQEIPFYIGQAVLQLFKSDNTNIKCFLDQDYN

SEQ ID NO: 83349 - protein, 392 aa, Synechococcus sp. WH 7805
MSRPLSLSSRAEALQPSLTLAISARAKALQQEGRDICSLSAGEPDFDTPEFIVEASVEALRNGMTRYGPAAGDPTLRELIASKISKENGIPTSAAEVLVTNGGKQAIYNLFQVLLNPGDEVLIPAPYWLSYPEMARLAGARPVAVPSSADDGFRLDLNALEAAITPASRVLIINSPGNPTGRVLSRDELLAIAELVRRHPRLVVMSDEIYEYLLDDGVTHDSFASLAPDLQDRCFMVNGFAKGWAMTGWRLGYLSGPESVIKAASALQSQSTSNVCSFAQQGAIAALTAPRDCVQTMAESYNRRRSFLVAGLQAMSGITLVPPQGAFYAFPQLPEGCGDSMSFCRRALEDEGLAIVPGVAFGDDRCVRVSCAVSRETITDGLARLARLLAVN

SEQ ID NO: 83350 - protein, 402 aa, Candidatus Protochlamydia amoebophila UWE25
MRVKDKLSIRDLNLKDKKALIRVDFNVPLEKGLITDDSRIQASLPTIQYVLDQEGAVILMSHLGRPKGLFDSKFSLAPCAKRLSELLNKPVKMAADCCGLDVEQMVRQLKSGEVLLLENLRFHKGEERPDDEPNFTSALSELGDVYINDAFGTAHRAHASTTKIAKFFPNRAAAGLLLEKEISYLGCALTNPKRPFCAVLGGAKISTKFKVIEALQSKADVLLIGGAMAFTFFKSEGIPIGDSLYESEFVAVARELLGVETQSRCRLLLPIDLVIAKKMDESFTETRIISVKEGIPDGYQGVDIGPDTIKLYQEELNRAATIFWNGPLGVFEVPAFSKGTQTIAQTLAVVNAITIVGGGDSLAAIEQAGVSKQINHLSTGGGASLEYIEFGQLPGIEALSDK

SEQ ID NO: 83351 - protein, 536 aa, Candidatus Protochlamydia amoebophila UWE25
MSQTPTGSREFSPWRSNLWPVHRYELKKLIPMLLIFFFISFDYNILRTLKDSLLITAKSSGAEVIPFVKVWAMFPGAILMTLLFTWLSNRLSREIVFYLITSLFLSYFFIFTFILYPIRDIIHPHATADYLETILPIGFKGLVAMFRYWTFTIFYVMSELWGSTVLFVLFWGFANQVTKISEAKRFYGLFGVGANLSGIFAGQASVYCCQFNKQNDLGILGSDPWYQSLVMMVSLILLSGALVLALFRWMNVEVLTDKRFYDPSSVKTEGEAKGKLSLKQSFSYLLRSNYLLCIALIVISYNLVINLTEVLWKHQVRELYPDPNDYTLYMNHIVSIIGVVATLSSLFVSGNAIRKFGWTTTALITPIILAVTSLGFFSFFFLKKASPEIFLSFSGVTPLVLVVFFGTAQNILSRGAKYSVFDATKEMSFVPLNPESKLVGKAAIDGVCSRLGKSGGSVVHQSLLLLFSTINASAPYVAIVLFAVILVWAMAIRVLGKQFNELTSQVENNETSGTLMTPIRAVNILSDTILKEQKAV

SEQ ID NO: 83352 - protein, 457 aa, Candida glabrata CBS 138
MNSGNGQSTLPPDAPTTGADTIGNELTSTLASGEKGTIRSLIDSAMQNNPYFAAGGGLMLLGTGLALAKSGMVKASRLAYKQMIVDLEIQSRDKSYSWFLSWMSKHPQRISKHLSVRTSYIQHDNGSVSTKFSLVPGPGNHWIRYKGAFIRIKRERSAKMVDISNGTPFETVTLTTLYRDRHLFQDILNEAKDIALKTTAGKTVIYTSFGPEWRKFGQPKAKRLLPSVVLDKGIKEDIIEDVHDFMKNGKWYSDRGIPYRRGYLLYGPPGSGKTSFIQALAGELDYNICILNLSENNLTDDRLNHLMNNMPERSILLLEDIDAAFNKREQTGEQGFHSAVTFSGLLNALDGVTSSEETITFMTTNHPEKLDKAIMRPGRIDYKVFIGNATSYQIEKMFLKFYPGEVNNCKKFVEAVESLGSSVSTAQLQGLFVMNKDDPESAIKMVHTMKTNEEFVV

SEQ ID NO: 83353 - protein, 349 aa, Streptococcus mutans UA159
MKTAVFVKAGQMAIETIEKPSVIEVDDAIIRVVRACVCGSDLWSYRGDDDKATHSANSGHEIIGIVDEVGSAINTVKKGDFVIAPFTHGCGHCAACRAGFEGGCQGHDRSTNFSSGYQAEYVRYAHADWSLVKIPGQPSDYSEGMIASLLALADVMPTGYHAARVANVQKGDTVAVVGDGAVGLCAVIAAKMRGAKRIIIMSRHKDRQELALEFGATDIVEERGEEGVAKVLELTNGDGVDAALECVGTQLSTETALAIARPGASIGRVGVPHTKDINLSDYFFQNAIIAGGPASVTTYDKSVLLKAVLDGEINPGKVFTQSYSLDDIDQAYKDMQERKTIKSMVVVSK

SEQ ID NO: 83354 - protein, 516 aa, Candidatus Protochlamydia amoebophila UWE25
MSQQESEFGKLRAFFWPIHGHEVKKVLPMMLMLFLICFNYSILRNVKDAIVVTAKASGAEVIPFIKVWVLLPTAVLFTLIFTKLSNRFSQEKVFYIVISTFLLFFGSFTYIFYPLRDVLHPHQLCDYLETILPAGFKGLIAMFRNWSFTLFYVICELWGSIVLTVLFWGFANEITKMTEARRFYSMLGVIASFAATIAGIIANLLSNDQSWEQTLNILMVAVIVSGTIAMVIFRWMNKNVLNGPEFQEFHEAKRIQKMKKRLSIRESFTYLANSKYLICIAVLVISYNLVINLVEIVWKDQLRQLYSSALDYNRYMNNMTSAVGIIATITSLFMSTMITRFGWTRTALVTPTIMLVTSVGFFAFMLFRNDLADPVYILTGTTPLTIAVFFGAAQVCMSKACKYSVFDSTKEMAFIPLDYESKLKGKAAIDGVGSRLGKSGGSLIHQSLLMIFATVSSSAPYVAVILIGVIIVWMLCVRSLGKQFAAIIGEKAREDIGESTPRTSEEQVLHPLKAAS

SEQ ID NO: 83355 - protein, 489 aa, Hiraea fagifolia
GPGISALEKKNLGRIAQIIGPVLDVAFPPGKMPNIYNALVVKGRDTLGQQINVTCEVQQLLGNNRVRAVAMSATDGLMRGMEVIDTGAPLSVPVGGATLGRIFNVLGEPVDDLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKAANLEMENNLK

SEQ ID NO: 83356 - protein, 170 aa, Arabidopsis thaliana
MLKDQANQLEFPRDFLGISLADQPNKYYFIIRTQRIVLEADSSIQLIMEKLQSYKSKVALYFDGFQYQLGDFRLRVGKVVPTHSENVRGIVMEVEYLPISSMEKAQKVMEEFLEIWNEALAKRSLPGKFVNIDLNFGEFGLGDIYTPQHTAVRYALVMAHMIATVQAVRG

SEQ ID NO: 83357 - protein, 417 aa, Methanosarcina mazei Go1
MGSVTAACFAEVGHEVICVDIDRKKTEQINAGIPPIYEEGLGELLQKYAGKKLIAITDYELAVKETEISFICVGTPSADDGTIDLSIVRAAAASIGKALAKKDAYHVVVVKSTVVPETTEKFVLPILEETSGKKAGKDFGVAMNPEFLREGKAVQDFMNPDKIVVGAIDKRSGNLVSELYRTFECEVTRTGPATAEMIKYANNSLLATKISFANEIGNICKKMGIDTYEVMEAVGKDFRISPKFLNSGAGFGGSCFPKDVKALIGKAKTIGYSPVLLESVIAVNEKQPLLMTEILQRKIGNPADKKIAVLGLAFKNETDDIRESRSIPVIAELLRLGAKVSAYDPMAAENMKRIFPSIEYCDNASDALKDADACLVMTEWDEFRNLDSEFQNMKEKIIIDGRRIIKAKNIDYEGLCW

SEQ ID NO: 83358 - protein, 323 aa, Methanosarcina mazei Go1
MGEKYFNSEEYNLTEFLFIGELTLTIKKALIPAAGLGTRFLPATKSMPKEMLPIIDTPVIQYVVEEAIASGIEDIIIITGRGKRAIEDYFDDSPELEMHLAKKHQTDMLKLVRDISSLVDIHYIRQKEPNGLGDAVLRAENHIGDEPFAVLLGDDIIVNDKPCTAQLIENFEKYGRSTIAVEEVPYEKLSSYGIIKGKPLDDSLYVLEDIVEKPAPEDAPSNIGAIGRYVFTPEIFDCIKHAGTGVGSEIQLTDGIRLLNKSQMIYACRFKGKRFDTGDRLGYVKSIVDFALQNENLRDDVLEYLREILAVNKISPEIDKLKQ

SEQ ID NO: 83359 - protein, 449 aa, Bradyrhizobium japonicum USDA 110
MSTRTSRVLHRSLRETPPKAIGGEGIYLFAEDGRRVIDASGGAAVSCLGHQHPRVIAAMAKQASTLAYAHTAFFSSEPAEALAETLVGHEPGGLAYAYFVSGGSEAIEASIKLARQYFIERGEPQRQHFIARRQSYHGNTLGALAAGGNAWRRAPYAPLLSAAFSHVTPAFAYHEKHDGESDAQFVARLAAELEAEFQRLGPNSVAAFLAEPVVGATAGAVTAPDGYFRAVREICDRHGALLILDEVMCGMGRTGTTHAWEQEGVAPDIQAIAKGLGGGYQPIGAMLASGRIIDTIRSGSGAFQHGHTYLAHPLACAAALAVQDVIREDGLLDRVKERGKQLEQRLTERFGNHRHVGDIRGRGLFWAIELVADRASRTSFDPALKLNQKIKAEAFANGLGCYPGGGTVDGVRGDHVLLAPPYIASVAEIDLIVDKLGTAVDNVLRSVNH

SEQ ID NO: 83360 - protein, 525 aa, Gibberella zeae PH-1
MSKTDQKACLIVIDGWGIPSADSPKDGDAITNAKTPVMDALYKDSKGYTELEASSLAVGLPEGLMGNSEVGHLNIGAGRVVWQDVVRIDQTIKNGELSQNDVIKKTFQSAAGGNGRLHLCGLVSHGGVHAKQTHLYALLKAAKEYGVPKVIIHFFGDGRDTDPKSGAGYMQELVDNIKEIGVGEIGTVVGRYFAMDRDKRWDRLEIALKGLILGEGEASEDPVATVKARYEQGGDMNKDEFLTPIIVGGDDRRIKDDDTVFFFNYRSDRVRQITQLLGDVDRSPLPDFQYPKIKPLVTMTQYKVDYPFEIAFKPQHMGNVLAEWLGKQNVEQVHIAETEKYAHVTFFFNGGVEKVFPLETRDQSQDLVPSNKSVATYDLAPEMSADGVADQVVKRLGEQKFPFVMNNFAPPDMVGHTGVYDAAVIGCEATDKAIGKILEGCKKAGYVLFITADHGNAEEMKFADGKPKTSHTTNKVPLLMANYPEGWSLKKTTEGVLGDVAPTVLAAMGLPQPEEMTGKSLLEKA

SEQ ID NO: 83361 - protein, 105 aa, Zea mays
SQLLRQRHQRHVGDTSFISCGHYNEVYLSAKGEPFPSDPKKQLELAEPAVVNSWESARGPKCGGGDRITGLLGTAVNVRRVGFANMGNTPGSGVLFSWSPHTGEK

SEQ ID NO: 83362 - protein, 357 aa, Bradyrhizobium japonicum USDA 110
MSKKQYRIAVIPGDGIGKEVMPEGLRVLEAAAKKHGVSLHFDHFDFSSWDYYEKHGQMMPDDWKEKIGKHDAIYFGAVGWPAKIPDHVSLWGSLIKFRREFDQYVNLRPVRLMPGVPSPLANRKPGDIDFWVVRENTEGEYSSVGGRMFPDTDREFVTQQTVMTRTGVDRILKFAFELAQSRPKKHLTSATKSNGISITMPYWDERVEAMAKKFPGVKWDKYHIDILTANFVLHPDWFDVVVGSNLFGDILSDLGPACTGTIGIAPSGNINPEGDFPSVFEPVHGSAPDIAGQGIANPIGAIWSGAMMFEHLGEKEAGRSIVEAIERTLAERTLRTRDLGGNADTTACGKAVADMVD

SEQ ID NO: 83363 - protein, 493 aa, Colwellia psychrerythraea 34H
MSSEIGIKLWSFTGKMKILHLSWMAFFITFMVWFNHAPLLAVIADSLGLSSSEIKTLLILNVALTIPARIIIGMLTDKYGPRLTFAVLLAVCSLPCFMFALSQNFEQAALARFLLGFIGAGFVIGIRLVSEWFPANELGTAEGLYGGWGNFGSAAAAMSLPLIALYIGKTFGVEDAWRYAVALTGLMSLLFSFIWYANVSDTPKGATYFKPTQTGAMEVTSVGDFYLLLLMKLPMYGALALLTWKLSPQGVSLLSSNMTIIAYVSLVILFIAEVWKTYQVNGHLFKEEVPEIHQYQFKQVAVLNVLYFATFGSELAVVSMLPLFFAETFSLDMVYAGMLASLYAFMNLMSRPGGGWLSDKYGRKKTLLILTAGLALGYLAMALIDSSWPLVLAVITAMACSFFVQAGEGAVFAAVPLIKRRLTGQIAGMTGAYGNVGAVVYLTVLSMVSYQTFFLVIAATAVLGFVTLLFMQEPKGSITEIREDGTVELIQVK

SEQ ID NO: 83364 - protein, 187 aa, Xanthomonas axonopodis pv. citri str. 306
MSLINTQVQPFKANAYHNGNFIEVTEASLKGKWSVLIFMPAAFTFNCPTEVEDAADNYAAFQKAGAEVYIVTTDTHFSHKVWHETSPAVGKAQFPLIGDPTHKLTRAFGVHIEEEGLALRGTFIINPEGVIKTLEIHDNSIARDVTETLRKLTAAQFVANNPGQVCPAKWKEGAKTLAPSLDLVGKI

SEQ ID NO: 83365 - protein, 198 aa, Flavobacteria bacterium BBFL7
MLSRKRKPYYFCSLEKQRTMRQHPWHDVSYGEDAPEKVMGIIEIPKNTRAKYELDKDSGMLILDRVIYSSMYYPTNYGFIPQTYCDDEDPLDILVLSQIEIVPMCLVEAKVIGVMQMLDGGEMDDKIIAVAANDMSVAHFNDVSELPEYWKKEMRNFFQDYKKLENKTVEVEEFQGREKAMEIVKQSIEDYKKKFPKN

SEQ ID NO: 83366 - protein, 124 aa, Oryza sativa
MAAEKGSPLPKFGEWDVNDPASAEGFTVIFNKARDEKKTGGNSQGQDLAAKSEQPSGQGLYPAKPNSSAILVISFTLQVHKCLVDSAREQVILKHNFTPATLALECFFNLKKWFCCMQPTAAES

SEQ ID NO: 83367 - protein, 169 aa, Methylobacillus flagellatus KT
MAKVEIEQQQTDGLREKMIGVNRVTKVVKGGRIMSFAALSVVGDGDGGVGMGKGKAREVPVAVQKAMDEARRSMIKVSLNNGTLYHAVTGVHGAAKVFIQPASEGTGIIAGGAMRAIFEVMGVTNVLAKCIGSTNPYNVVRATLNGLKSMNTPAEIAAKRGKSVEEIRG

SEQ ID NO: 83368 - protein, 441 aa, Salmonella typhimurium LT2
MTQYQALIIGFGKAGKTLAATLAKTGWRVAIIEQSASMFGGTCINIGCIPTKTLVHDAEREGDFSVAMQRKAAVVNFLRDKNFHNLADLDNVDVIEGRAEFIDNHTLRVFQADGERVLRGEKIFINTGAESVIPAITGLTTTAGVFDSTGLLSLSQRPARLGILGGGYIGLEFASMFANFGTKVTIFEAAPQFLPREDRDIAQAITRILQEKGVELILNANVQAVSSKEGAVQVETPEGAHLVDALLVASGRKPATAGLQLQNAGVAVNERGGIIVDDYLRTTADNIWAMGDVTGGLQFTYISLDDFRIVRDGLLGDGKRSTRDRQNVPYSVFMTPPLSRVGLTEEQARASGATVQVVTLPVAAIPRARVMNDTRGVLKAVVDVNTQRIVGVSLLCVDSHEMINIVKTVMDADLPYTVLRDQIFTHPTMSESLNDLFSLIK

SEQ ID NO: 83369 - protein, 342 aa, Mycoplasma penetrans HF-2
MPVNLKGRSLDSLLNFTTEEVQHLIDLSIDLKKAKYQGLHINNRPLVGKNIAILFQKDSTRTRCAFEVAASDLGAGVTYIGPSGSNMGKKESIEDTAKVLGRFYDGIEFRGFAQSDVDALVKYSGVPVWNGLTDDEHPTQIIADFMTMKEKFGNLKNKKIVFIGDYKNNVGVSTMIGAAFNGMHVVMCGPDNYKNEIDKNVLAKCIELFKRNGGSLRFSTDKILAAQDADVIYTDVWVSLGEPFELFDKRIGELKNFQVDMNMIKAAKNDVIFLHCLPAFHDDHTSFSKEVATTLGAKYPIVAKGEMEVTDEVFQSLHNKAFDQAENRMHSIKAIILSTIGY

SEQ ID NO: 83370 - protein, 343 aa, Triticum aestivum
  misc_feature (206)..(206): Xaa can be any naturally occurring amino acid
MSSCFNGGAGWPEPVVRVQAVSDTCGETIPEWYVKLPLDRPSATTLQPAVSHGGGSLNIPVVDMSMPDSGETVRAVDAACREWGFFQAVNHGVSPELLRRARSSWRGFFRQPAEVRERYANSPATYEGYGSRLGTTKGGHLDWGDYYFLHLLPPSIKSHDKWPSLPSTLRDATEEYGEEVVKLCRRVSKVLSKGLGLDGGRLQAAXFGGEGGEGACMRVNFYPRCPQPELTLGVAAHSDPGGMTMLLVDDHVRGLQVLSNAAYKSVEHRVTVSAAEERLSLAFFYNPRSDVPVAPMAELVAPGRPVLYPEMTFDEYRAHIRQRGLSGKAQLQSLQNANSSVAS

SEQ ID NO: 83371 - protein, 464 aa, Salmonella typhimurium LT2
MKNASTASGASVSDAASKNEPTLQRGLQNRHIQLIALGGAIGTGLFLGIGPAIQMAGPAVLLGYGVAGIIAFLIMRQLGEMVVEEPVSGSFAHFAWKYWGPFAGFLSGWNYWVMFVLVGMAELTAAGIYMQYWLPDVPTWVWAAAFFIIINAVNLVNVRLYGETEFWFALIKVLAIIGMIGFGLWLLFSGHGGEHASIDNLWRYNGFFATGWHGLLLSLAVIMFSFGGLELIGITAAEARDPQKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSHRGVPVNSLILSGAITSLVVLINYLLPQKAFSLLMALVVATLLLNWIMICLAHLRFRAAMRRKGRETQFKALFYPAGNYLCIAFLALILVLMCTMDDMRLSAILLPVWIVFLFIAFTVLRRKAH

SEQ ID NO: 83372 - protein, 453 aa, Aspergillus oryzae
MSQLRRTTQRLSLISRHLDQHLPLPDLNTPFSTERGSHPPDDIEYKPLDRTLPSTSPSQQPESPSTKMSSQAPHPTLLIPGPIEFDDAVLQSMAHYAESHVAPGFVKTFGETLTLVRKLFQSTNPAAQPFVISGSGTLGWDVVASSLVEKGENALVLHTGYFADSFATCLQTYGANATQLKAPIGERPSFEEIEQALKEKPYKIITITHVDTSTGVLSDIKRIAEIVRRVSPNTLVVVDGVCSVGCEEIAFDEWDLDVVLTASQKAIGCPPGLSILMTSPRAIDVFKNRQSPPASYYSSIGNWLPIMQNYENFKPSYFATPPTQLVHALHTTLSQITSRPMAERFAVHAQASDRVKAAVAELGLKQLAAKPENQAHAMTAIWLPEGLAPPDVLPGLLKRGVIFAAGLHKEAATKYIRFGHMGVSVSDPARKDIDNAIAALKEAMAEAKQAKGL

SEQ ID NO: 83373 - protein, 248 aa, Arabidopsis thaliana
MDEYVEDEHEFSYEWNQENGPAKWGKLRPEWKMCGKGEMQSPIDLMNKRVRLVTHLKKLTRHYKPCNATLKNRGHDMMLKFGEEGSGSITVNGTEYKLLQLHWHSPSEHTMNGRRFALELHMVHENINGSLAVVTVLYKIGRPDSFLGLLENKLSAITDQNEAEKYVDVIDPRDIKIGSRKFYRYIGSLTTPPCTQNVIWTVVKKVRTVTKNQVKLLRVAVHDNSDTNARPVQPTNKRVVKLYKPKSL

SEQ ID NO: 83374 - protein, 584 aa, Cryptococcus neoformans var. neoformans JEC21
MPSATLIRLSKSLSMSSSNSTVRVALRGGAILNNPRFNKGSAFTHQERSEFALRGRLPYAVDSLEIQVKRAYEQYKSRETNILKNSFLQSMKAQNWTLFYALLQAHLVEMFPIVYTPTEADAIADYSHLFRRSEGLYLTPPGEKNMEEDFLDACEGRELELIVVSDGEAILGIGDQGSGGIGISGAKAVIYSLIAGVDPAKCLAITLDVGTNNQDLLNDPLYIGYREKRLRDDRYDQFVDKFVGLVKKHQPECLLHFEDLVSPMLNDSSEDIGARFNDDIQGTGAVTLAAVQAAISVTKSSLKDQRIVIYGSGSAGLGIARQLRDAIALDSSGSPSEAAKQFWLIDKHGLIKKSLGKDKIRSEIEDEFIRDEGDWGEGETGLKEVVKKIKPTILVGTSTQAGAFTEEVVKEMSKHVDRPIIFPLSNPTRLCEAQPKDVSEWSKGKALMSTGSPFDPVDISDSGEKYIVAECNNALIYPGLGLGSILAKSSKMTDKMIIAGAQRLGQLAPALVKKNANKSLLPDFGDAQKVNFEVALAVLEQAMEDGVARAKDIPEDKDERRKWAENNRWSPGYPNFKYDPEGLK

SEQ ID NO: 83375 - protein, 513 aa, Candidatus Protochlamydia amoebophila UWE25
MSQDAKQDFGKWRAFFWPVHGYELKKLLPMFFMFFFISFNYTILRDTKDTLIVTSAGAEAIPFLKSFGVVPAAILFMIIYAKLSNTLSRENLFYVTLLPFIIFFGLFAFVMYPAREVLMPHASAEALKAYLPGGWTGLAAAYENWMYSIFYILAELWGSVVLSLLFWGFANQITRVNEAKRFYSLFGLGANLALLVSGPAIVYVSDIRKHLPANVDAWQISLNYLMGMVVIAGLAILAIYWWINRAVLTDPRFYDLNQEKAPGKKKKAKMSLGESFKFLFTSKYILCLAILVIAYGISINLVEITWKSQVKLQYPNPNDYSTFMGWFSTMTGAVTILMMLFVGGNVIRHKGWGFAALITPVVLLVTGIAFFSFVIFKDHLAGYIAALGTTPLFLAVIFGAAQNIMSKSAKYSLFDPTKEMAYIPLDDESKVKGKAAVDVVGARLGKSGGSIIQMGLLAFGTLATITPYIGAILMVIIAAWIVAARSLSKQFTQLTAEQNIEKNIDKTSEIATS

SEQ ID NO: 83376 - protein, 649 aa, Candida glabrata CBS 138
MAPVTLDPKVTADTSRYSGVQSNSGFAYGEITFGEYVFRRLLSCGTKSVFGVPGDFNLALLEHLYDDSVADALRWVGNCNELNAAYAADGYSRYTNKIGCLITTYGVGELSALNGVAGSFAEDVKVLHIVGVASSQTSCKNTDNKNVHHLIPALNDSNFVSPNHKTYYEMVKDRVCCAAEYLEDIDVACDMLDKVIEDMYRYSKPGYLFIPADFADMMVSTRNLVARPTITLEQAIAPLVGCGESQLEAIVAKVAQLIYNSSNPCILGDVLTDRYGVSQQLNSLISHCQMWNFSTVMGKSVIDESNPYYKGLYNGRECSSSVIEDFSKCDLILHFGIERNEINNGHYTIDYNEHIGANVVEFHSDYIRFFNSKTKEEDMIRGVNFVHVLNRLQPAIQADKLSFNYQECSTTSNADSKIDSQSSNEITQEFLQDIMPQYLNPGDVLVCETGSVQFGVRDYRFPSNVKYVSQGFYLSIGMALPASLGVGIGMQDYPMSHIPNPEEIEYEPKLILFEGDGSAQMTIQELSTMLHNNVKMEIFLWNNDGYTIERAIKGPTRSYNDIAPWNWTKMFEAFGDGLGSKHKTRNQVYSTREEFLTRLREKKDTKHNDPACQIELLEVKMGVLDFPEQLKCMVSAAMYNKKKEQSMSN

SEQ ID NO: 83377 - protein, 251 aa, Synechococcus sp. WH 5701
MEIKSAREVKIMRQASKIVATVLREVMAMVEPGQTTGDLDAFAERRIREMGATPSFKGYHGFPASICASINNEVVHGIPSAKRVIHRGDLLKVDTGAYFEGYHGDSCITVCVGDASKEAQTLSRVARESLMAGIGQVKAGNTLLDIAGAVEDHVKANGFSVVEDYTGHGVGRNLHEEPSVFNFRTDELPNVTLRPGMTLAIEPILNAGSKGCRTLRDRWTVVTRDGALSAQWEHTVLVTSDGCEILTDRGD

SEQ ID NO: 83378 - protein, 475 aa, Bordetella bronchiseptica RB50
MSTQYRSFVAGQWQDGGEPVALYNPSDLQEEAGVYMHAPVEMVNQAVRAAEEALDAWRGLHAMARSRLLDGIADGLVRRRDELAMAIAREQGKPLRDALAEATRAADIFRYFASETIRQKGYTYASIRPGVRVEVQRNPVGVVALVTPWNFPVVIPAWKAAAALAYGNTVVMKPSEIAPCGAWILADVMREAGLPAGVFNLVLGAGQAGAALVAHEAVAAVSFTGSVATGKRIAAAAAGKRIQLEMGGKNPLIVLDDADLDTAVACAIDGAFLYAGQRCTASSRIIVTEGIHAAFVKRLLAQTASLAVGHALDEATVIGPVVNAEQFEKNRRYADLARQEGGTVAGGRALSRPTRGHYFEPCLVTGLDNSATVCREEVFGPFACVLTARDYEHALAIANDTPFGLSSGLCTTSMKHAQHFKAHTKSGLASINTSTSGVDFHVPFGGNGASSYGPREQGEFAIEFFTTLRTVYIGD

SEQ ID NO: 83379 - protein, 489 aa, Piriqueta cistoides
GPGDSALEKTNQGRIVQIIGPVLDVAFPPGRIPNIYNALVVKGRNPIGQQIHVTCEVQKLLGNNRVRAVAMSATDGLTRGMQVIDTGAALTVPVGEATLGRIFNVLGEPVDDLGPVDTRTASPIHRSAPAFIQLDTELSIFETGIKVVDLLAPYRRGGKIGLFGGAGVGKTVLIMELINNIAKAHGGVSVFAGVGERTREGNDLYKEMKESGVINEENLTESKVALVYGQMNEPPGARMRVGLTALTMAEYFRDVNKQSVLLFIDNIFRFVQAGSEVSALLGRIPSAVGYQPTLSTEMGSLQERITSTKEGSITSIQAVYVPADDLTDPAPATTFAHLDATTVLSRGLAAKGIYPAVDPLDSTSTMLQSQIVGDEHYDTAQRVKQTLQRYKELQDIIAIMGMDELTEEDRLTVARARKIERFLSQPFFVAEVFTGSPGKYVGLPETIKGFQLILSGELDSLPELAFYLVGNIDEATAKATNLEMENNWK

SEQ ID NO: 83380 - protein, 156 aa, Zea mays
MQGSMQFKRALLKSLLLGLRERGVASREMGFLERKRAIRRAADAALVSARGSDATRWSQALETQCRPSTSKRVLRRCHRPRPRKAGTAARPRGSAGVVARAMLRKRTQVLKGIVPGVQAVDDECTLLGEALDYAVCLKAQVDVMQLLVRALQAPKQ

SEQ ID NO: 83381 - protein, 357 aa, Colwellia psychrerythraea 34H
MYDKYFTSEDDATNASHLLSKELPTYRKAYSDRTAWIMSVMSELAYIKFNSLFPESGSTDFIKEHFIKKVNSLVGEEKSKIVTTLINKINYNPTVEKAKLESNLDEFQFKLLKTFDDKGTQAILVDAGTYIILSFRGTEADSLSDIKADAKANLAKCSVSEGQIHTGFRDSFNYIRRDVEEEINKEEYSNKPLFITGHSLGGALATVATKFLTHKGGIAACYTFGSPRVGNDDWVNNIKSPIHRIVNAADSVTMLPPGDVPISALSFCLRFIPSIGEPASKYLSEKFGRYMHAGNMRYLTNCKPGDFNDVRVLYSVSFTYRIKALIVKSLPFGKLLSDHSISNYSKKLMIIAINRNK

SEQ ID NO: 83382 - protein, 597 aa, Oryza sativa Indica Group
MATAAAAAGEGGSGRRYWRWSKADFFPEPSFASWRSYGGALAATVPRLVDRVGSRSSEAAEAGTLRAVSENPLRRCLSWLDLAFLGFGSVVGSGVFVLTGQEARFDAGPAIPLAYAAAGFSALLSSFCYAELATEIPSAGGSFSYLRVELGDIAAFLAAGNILLEAVVGAAGLGRSWTSYLAALLGRDTDSLRIHVPALAEGFNLLDPIAVVVLVSTSAVAMSGARLTSTLNSLASVVGIAIIAFVLAAGFSHFDAGNLAPSFFPFGAAGVFRAAGVVYWSYTGFDMVATMAEETKNPGRDVPLGLISSMSSITVVYCLMSLALVGMQRYTEIDANAAYSVAFAAAGMRWARYVVALGALKGMTSGLLVGALGQARYTTQIARTHMMPPYFALVHPTTGTPIYATVAVTLGAACVALFSSLDVLASVSSISTLFIFALVAVALLVRRYHVAGATTPGQLRTFLAFLALVVLSSIGVSAYYNSRYARRWPGYAAFGCGWAAGAAGLAACAEKQRAPRVYGAPLVPWLPAMSIATNLFLMGSLGTAAYARFGICTAAMLVYYVLFGVHATYDVAHADDAAADNLEHGKIAAAPAPTTPA

SEQ ID NO: 83383 - protein, 191 aa, uncultured marine bacterium 441
MTEEQTFGKILIIDDEKDNTEIIKDILEDVNYSTMLARSAAEAKVVLAANHFDLILMDVWMPGQDGISLLSEWHSEGFDTPVVMMSGHAEPSDIVKAMKLGAVDFLKKPLHDFLPILRNIMTPDKSEQEIQHVSGINYSLKLKEARNIFESQYLVHHLDANDNNIAVVAEIAGLERTTLYRKLKDLGIDKK

SEQ ID NO: 83384 - protein, 540 aa, Mycosphaerella graminicola
MGLLQEVLAQFDAQFGQTSLWKLVGLGFLAFSTLAILLNVLSQLLFRGKLSDPPLVFHWVPFIGSTITYGIDPYKFFFSCREKYGDVFTFILLGKKTTVCLGTKGNDFILNGKLKDVNAEEIYSPLTTPVFGKDVVYDCPNSKLMEQKKFVKYGLTTSALQSYVTLIAAETRQFFDRNNPHKKFASTSGTIDLPPALAELTIYTASRSLQGKEVREGFDSSFADLYHYLDMGFTPINFMLPWAPLPQNRRRDYAQKKMSETHMSIIQKRRESKRANMRKTTSRCKYKDGNAIPDKEIAHMMIALLMAGQHSSSATESWITLRLASRPDIQDELLQEQKDMLGVNADGSIKELTYANLSKLTLLNQVVKETLCIHAPIHSILRKVKSPMPIEGTAYIIPTTHTLLAAPGTTSRMDEHFPDCLHWEPHRWDESPSEKYKHLSPTTALGSIAEEKEDYGYGLVSKGAASPYLPFGAGRHRCIGEQFAYVQLQTITATMVRDFKFYNVDGSDNVVGTDYSSLFSRPLSPAVVKWERREEKEEKN

SEQ ID NO: 83385 - protein, 667 aa, uncultured marine bacterium 441
MNFDQNLIAPALGVLGLLIVVIIYQWITKQDGGSGAVKKIGEQIHIGAIVFMKREYKMLSIFALVLLVLLYIFLGAASALCFVVGALTSATAGYIGMNTATIANVRTAQAAHDSGSSAALTVAFFGGSVMGLSVAALGLLGLGGLYYFFGAEHSEALHGFAMGGSVVALFSRVGGGIFTKSADVGADLVGKIEAGIPEDDPRNPAVIADNVGDNVGDIAGMGSDIFESYCGSMIATIAIASTLSAMALDMLGGNRSELMFLPLALASLGLVCSIIGIIFVKLSSNKSPESALRMGTIGSAVLFIVTSYFLISSLDVSNNIWAAVLMGSIGGIIIGLVTEYYTAGKPIRDIAEAGQTGSATVMIKGLSVGMQSVVVPVLMICLIIYVSNLFVGLYGVGIAAIGMLATVGMTMAIDAYGPIADNAGGIAEMAGLGEDTRNITDSLDELGNTTAAIGKGFAIGAAALAALAIITAYTETVAANSSDFLLQLNSAEVLIGLFIGGTIPFLIASLTMTAVGDAAFEMIEEVRRQFKEIKGLLDGKAEPDTAKCVDIATTAALKKMILPGVIAVAAPVLVGFLISPEALGGMLGGALLGCVLMALMMANAGGAWDNAKKHVEKGNFGGKGTDVHAATVVGDTVGDPFKDTSGPSMNILINVMAIVSLVIAPLL

SEQ ID NO: 83386 - protein, 95 aa, Arabidopsis thaliana
  misc_feature (18)..(18): Xaa can be any naturally occurring amino acid
KNFFSKFIHWPSWFWLLXTFFSGTEFVFPYHHKLFLGRKRINFYKPTSAIGTPSSTSAPPPASNGRKFFSIYSPNGDIFPGPPASGHGGGPPPPP

SEQ ID NO: 83387 - protein, 514 aa, Zea mays
  misc_feature (28)..(28): Xaa can be any naturally occurring amino acid
  misc_feature (78)..(78): Xaa can be any naturally occurring amino acid
  misc_feature (93)..(93): Xaa can be any naturally occurring amino acid
MESLRLAVTHRPALPLPTSHSHLRRRHXHLHLHSYPNPLSLSPPIASHLSPIPRRHLPPLLASASASQASSKPAGGRXSGGAKPLPLFLSLAXAGLAVRFLVPRPAEVTPEAWQLLSIFLSTIAGLVLGPLPVGAWAFLGLTATVATRTLPFTAAFGAFTNEVIWLIVISFFFARGFVKTGLGDRVATYFVKWLGRSTLGLSYGLAISEALISPAMPSTTARAGGVFLPIVKSLSLSSGSKPNDPSAKKLGSYLVQSQLQAAANSSALFLTAAAQNLLCLKLAEEIGDTPEAPALAAEKLKNMGPVTKNEWVMIGTMLLAVSLWIFGETIGVSSVVAAMIGLSILLVLGVLNWEDCLNEKSAWDTLAWFAILVGLAGQLTNLGIVSWMSNCVAKVLQSFSLSWPAAFVVLQASYFFIHYIFASQTAHVGALYSAFLAMHLAAGVPALMSALALAYNANLFGALTHYSSGQSAVYFGAGYVDLPDVFKLGFITAAINAVIWGVAGALWWKFLGLY

SEQ ID NO: 83388 - protein, 517 aa, Gibberella zeae PH-1
MESLYETLRTLPLSVSIPLTTSIIIILSIVTNVVKQLWFPNPHRPPVVFHIFPFIGSTVQYGIDPYAFFFDCRDKYGDCFTFILLGKSTTVFLGPKGNDFILNGKHADLNAEDVYGKLTTPVFGEEVVYDCSNARFMDQKRLLKLGLTTDSLRCYIPKFVKEVEDYVKNSPYFKGDTGIVNITEVMAEITIYTASGSLLGNEVRSMFDSTFATLYRHLDDGFQPINFVMPGLPLPQNFRRNHARKVMEKLFSDIISKRRETGNQGDETDMIWMLMNAQYKDGEPLPDHHAARMLIAILMGGQHNTAVSGAWLLLNLAHKPHLVQELYEEQTQVLGSPQEPLTWENLQKLTLNGQVIKETLRLHSPIHSILRQVKSPMRVPGTEWVVPPSHTLLSSPGTMARSEEFFPRPSEWDPHRWDKIEPLVKTAEDGQTVDYGFGVMSKSVSSPYLPFGAGRHRCVGENYAYAQLGAIVATFIRLVHIEQPDPKAPLPAPDYSSMFSRPMNPAEIRWRRRETVE

SEQ ID NO: 83389 - protein, 613 aa, Heliobacillus mobilis
MYAAIAGVIGLLFAGYLAMSVLKEDQGTQRMKELSQAIFEGAMAFLNRQYRTLIPFAVIIFGALLYGNWGNQKLAWGQAISFLVGASFSAVAGYVGMTIATKSNARTTAAAMRGLNEALSVAFRGGAVMGMSVAGLGLLGVSVLYIVYQDAVIINSFAFGASVIALFARVGGGIYTKAADVGADLVGKVEAGIPEDDPRNPAVIADNVGDNVGDTAGMGADLYESYAATTIAAMLIGVTVFPGRLEGIFYPLLIGAAGLIAAIIASFFVRTTEDGNPQMALNKGLWGTNVLTAVATYFIAQSLFADIPASSAFPSGVPLGLTISVIAGLLVNVAIGWITEYYTSYNYKPAQHIASSSLTGPATNIIAGIGVGLKSTALPIIVIVIAIAVSYNYAGIYGIAMAAMGMLCTAGMVVAIDSFGPVADNAGGIAEMAELGPEVRKKTDKLDAVGNTTAAVAKGFAIGSAALTALALFTAFAEEVIKSPGVSSALHGGHLVLNLLEPKIIIGLFIGGTVPFLFCAFAMEAVGKAAFEMIGEVRRQFREIPGLMEGKAKPDYARCVDISTRAAIRQMIAPGLLAVITPLIVGFGFGAQALGGMLAGVTVAGVLLAIFMG

SEQ ID NO: 83390 - protein, 470 aa, Candidatus Blochmannia floridanus
MSIQIETQVLVLGSGPGGYSAAFRCADLGINTILVERYPNLGGVCLNVGCIPSKALLHISKLIQTNSDLNEFNISKNITNIQLDINKIRLWKNDIIKKLSNNLNSIATAKRNIKIIYGFGTFINKHTLQVSCDKEIIKVIFDYAIIATGSHPTSLPFSPNDHRIWNSTDALELKFIPEKLLIIGSGAIGLEMSTVYHSLGSKVDLMEASDQIMPILDKDIINLFSKNLIKKSINCTVNTQVHAFNSKPNGIDVITTNKLDPNTKKTHRYDAVLIAIGRFPNSKELNLDGIGIQTNKNGFISVDKQMRTNISNIFAIGDIVGNPMLAHKSIHEGHIVSEVISGKKYYFDSTVIPGVIYSDPEIAWVGYTEKEAQTKNIKYASVTFPWNSLGKAITSNYTEGITKLIFDKNTHRIIGGSVIGLHASEIIGEIALAIEMGCDVEDITLTIHAHPTLYESIELAASIYNKSINT

SEQ ID NO: 83391 - protein, 143 aa, Xanthobacter autotrophicus Py2
MTVSVILSRKGNDICTIGPDATVGDAVARLAGRRIGAIVVVDDAMSVEGIISERDVVRLIGEQGVNVLAEPLSSVMTRAVVTCTPDETVPVIMERMTRGRFRHVPVVSGDKLVGIISIGDVVKFRVEEMERESAQLRDYIMSA

SEQ ID NO: 83392 - protein, 425 aa, Candidatus Blochmannia floridanus
MVININVPNIGENELEVTEIFIKNGDNIDINQPLLIIEGDKSSTEIPSPYAGIITKIHVQVGDKVQTGTLIISLDIIKTHDLDQSIQTKQNTKNEPNINNNIIDNNTDIQKYHITSISNNNIPTHATPFIRHMARKFDINLSHIQGSGRKGRILKEDIQKYLSNTSTKTMDYNPINKNISSLHPDTNFSKFGHTETIQLNKIQKISASNLQKNWSIIPHVTQFDMVDITSLEIFRKQQNFEIKKNKLNYKITMLVFVIKAVSKALQELPQFNSSLSQDGHTLILKKYINIGIAVDTKRGLLVPVLQNTDKKNITTLSKELLEISQKARVGKHLTPLDIQGGTFTISNLGGIGGTLFTPIINAPEVAILGISQAIMKPVWTGKKFIPRLMLPLSLSYDHRVINGADGAKFINRINKIISDIRLLSI

SEQ ID NO: 83393 - protein, 538 aa, Heliobacillus mobilis
MSSPQTPVMLIVLDGWGLRDDMEGNALKLANLPNFHRLWETYPHTSIQASGEYVGLPKGQIGNSEVGHLNIGAGRVVYQELTRISKAVETGELEKNPVLAAAMDRLSGTGKALHLMGLLSDGGVHSHIDHLFALLDMAVAHGVDKIFVHAFLDGRDVPPANAKEYVEALDKKLAQIGVGQLATISGRYYAMDRDKRWERVKRAWDAIVYGEGEKAPLGSAAVETAYHARLTDEFVLPTVIIDEKGEPRGTVADGDSVIFFNFRADRARQLSHVFTDQNFDGFDRGPKLPQVHFVCMTQYDITLDAPVAFLPQNLENTFGEVVSRAGMRQLRIAETEKYAHVTFFFNGGVEEPNEGEDRVLVPSPKVATYNLQPEMSANEVTDRVVEKINSKEYPVIVLNLANPDMVGHTGILPAAIQAVETVDGCLGRIVPAVLDQDGVVIITADHGNVEQMIDPDDGGPQTAHTTNPVPVILVSDRHKDKQLRSGGALEDIAPTMIELLRLEKPLEMTGESRSLCPKQNSYIWWYICGKSGCNDSAR

SEQ ID NO: 83394 - protein, 251 aa, Heliobacillus mobilis
MRTPVLAGNWKMYMTPEEGRQMVQALIPLVADCREREIVLCPPYISLDSLAKALKGTNIALGAQNMHPAKEGAYTGEVAPGMLKALDCKYVILGHSERRQYFGETDATVAEKVKAALAANLIPIVCVGETLAQREQVITEPVVDIQVRLGLAGLSPEELAGIIIAYEPVWAIGTGKTASSADAQKVCRFIRSVLSSWHGDTAEKVRILYGGSVKPDNIRELMEQPDIDGALVGGASLKADSFARIVRFEEQ

SEQ ID NO: 83395 - protein, 277 aa, Agrobacterium tumefaciens str. C58
MHNVTANGATIPALGFGTFRIPGSDVLRIVPHALKVGFRHVDTAQIYGNEAEVGEAIANSGVARGDIFLTTKVWVENYGHDAFIKSVDESLKKLKTDYVDLLLLHWPNEAVSLAEQIGALNEVKEAGKVRHIGVSNFNTELMAESVKLSRAPIVTNQIEYHPYLSQDVVIAAARKAGMSVTGYFGMADGKVFNDPVLRDIGARHGKSVAQVVLRWLVQQEGVIALSKTVGEARVLENFAIFDFALSADEMAAIHALAVPGGRIVSPDGLAPVWDKAA

SEQ ID NO: 83396 - protein, 500 aa, Glycine max
MFGYAAAIIAAILFFQYFFHRRRCCKHPILTEYPILGMLPQLLFNLWRAHDFFTEILKRHGGTGEFIGPWFTNMDYLVTCDPINVHHMLSKNFHNYVKGPEFRHIFQAFGDGIFAADSEAWKYNRDLFHSLFKQKSFEVFVAKTIHNKVHNGLLPILDHVQQQGRVVDLQDVFNRFTFDNICSIVLGNDPNCLSIDFSEVAIEKAFNEVEESIFYRHVVPRCVWKIQRWLQIGQEKKMTEACKTLDQFIHACIASKREKLSKYNENEMGEAHHVDFLTALMREETAHDDKFLRDAVFNLFVAGRDTITSALTWFFWLVATNPSVEAKILDEMKEKLGTKEKTLGVLSVEEVKRLVYLHGAICEALRLFPPIPFETKQAIKADMLPSGHRVNSGTKILFILYAMGRSEETWGKDCLEFKPERWISEKGGIIYVPSYKFIAFNAGPRTCLGKEISFIQMKMVAAAILHKYRVRVVDHVATPSPSIVLLMKDGLKVQIAKREI

SEQ ID NO: 83397 - protein, 632 aa, Oryza sativa Indica Group
MSGVASLGLRSSGSYGSLQQSNGQSPAPAPSPPLAARKAGKMSFGGAGAGGRGLLFARICKLTSRRRRMLLLLLVAAAVLFCFLFSSLVSKDEDAPPGIETMLGISDQVRSFVNPVWTSSGRPITQGDSLNGNGLNTASQTEKQSDSDSSHKKLQGLSWSFPPSIVLEHHPCENFSFFPPPIDRKRTGPRPCPVCYVPVEQALALMPGAPSASPVLRSLNYLSGDNLISKESNHGSLFGGYPSLEERDKSYDIKDSMTVHCGFARGKIPGVNTGFDIDRADLSEMWQCQGIVVASAIFGNYDIMQQPKNISVFSKDTVCFFMFLDEETEAAIKNTTTIDNSKRIGLWRVVVVRNLPYSDARRNGKMLIDLECLPDLKAIVMLLVKANDAMLNVPKLLLHRLFPNVRYSIWIDGKLKLVRDPYQLLERFLWRKNVSFAISRHYRRFDVFEEAEANKVGGKYDNASIDYQIEFYKREGLTHYSSAKLPITSDVPEGCVIIREHIPITNLFTCLWFNEVDRFTSRDQLSFSTVRDKIRKRVNWTADMFLDCERRDFVVQAYHRELWEQILRSPPPPQPRLVRQQPRKMLPDNTAKEPGKASGSKRVSAKRTRDKKSGSKRAHRSKVTGGKEFIQL

SEQ ID NO: 83398 - protein, 384 aa, Staphylococcus aureus subsp. aureus Mu50
MISNKLANIPDSYFGKTMGRKIEHGPLPLINMAVGIPDGPTPQGIIDHFQKALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSTVDSQIIDKTKLIYLTYPNNPTGSTATKEVFDEAIAKFKGTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKTRRDRFEAMLAKADLPFVHAKGGIYVWLETPPGYDSEQFEQFLVQEKSILVAPGKPFGENGNRYVRISLALDDQKLDEAAIRLTELAYLYE

SEQ ID NO: 83399 - protein, 516 aa, Hyphomonas neptunium ATCC 15444
MRNELKVHAARLSRQPLKALSAARAGTEPLSAAGWKISLARHFLDTEAEQSLLDFGAEARLTKAAEALFGEAIVNPSEGRPALHWALRAPARLMGEAESVRQSVIDALEFAGKVQTGEVRTAGGEAFTAVLHIGIGGSDFGPRLIADAFEDLAHPAIKLRFAANVDPYDLDRAMAGLKPENTLVVGVSKSFGTEETLYNLGRARRWLEEKLGDDASKHLALVTANPDKAKAWLGGRAAYTFDMPISVGGRFSLWSAASLACMIYLGPENFRSILNGANEMDEHVRTAPLAQNAAMRLALLDFWNTSIREKPMRVLLAYANRLRLLPTYLQQLEMESNGKSVDSQGNSVAPPTAPALWGGEGSVGQHSYHQWLHQGSQDVPCEFILAPDYNRDSEGLDALTAHALAQAEVLANGRSIAEVRAEEPGISDAVAPQKVHAGGRPSTLFSHASFGPEAFGALVALYEHRTYFAGQLWGLNPFDQWGVERGKTMAGRIKAVLKTPEIAADPVTAALLKQIF

SEQ ID NO: 83400 - protein, 266 aa, Brassica napus
MEFCNGGISNGDVLGVSPKREKLIIDTDPGIDDSMAIMMAFQTPELEILGLTTVFGNVSTQDATRNALLLCEVAGFPDVPVAEGSSEPLKGGIPRVADFVHGKNGLGEVSVPLPSRKKCEKSAAEFLVEKVSEHPGEVTILALGPLTNLAIAIKRDSSFASKVKKIVVLGGAFFALGNVNPAAEANIYGDPEAADVVFTCGADITVVGINITTQLKLTDDDLLALRDSKGKHAKLLSDMCKFYRDWHVKSDGVYGVYLHDPVSFVA

SEQ ID NO: 83401 - protein, 158 aa, Picea sitchensis
MARECKVSLKSSDDELFDVNEAVAFESQTIKNMIEDTGTASAIPLPNVSSKILSKVIEYCKYHVEAQKPADEKSAISEDEIKTWDQEFVKVDQATLFDLILAANYLNIKDLLDLTCQTVADMIKGKTPEEIRKTFNIKNDFTPEEEEEVRRENQWAFE

SEQ ID NO: 83402 - protein, 478 aa, Methanosarcina mazei Go1
MISMSKLEKLLKERGPIKKIGVLGMGYVGIPAAVLFADAPCFEKVLGFQRNSKSSGYKIEMLNRGESPLKGEEPGLEELIGKVVKAGKFECTPDFSRISELDAVTLAIQTPFANPKDLEPDFSALIDGIRNVGKYLKPGMLVVLESTITPGTTEGMAKQILEEESGLKAGEDFALAHAPERVMVGRLLKNIREHDRIVGGIDEASTKRAVELYSPVLTVGQVIPMSATAAEVTKTAENTFRDLQIAAINQLALYCEAMGINVYDVRTGVDSLKGEGITRAVLWPGAGVGGHCLTKDTYHLERGVKIGRGELDYPEGADSIYVLARKVNDFMPAHMYNLTVAALERLGKKMDGSKVAMLGWAFIKDSDDARNTPSEPYRDLCLKAGASVMVHDPYVVNYPGVEISDNLEEVVRNADAIVVLAGHSAYSSLKADWAKKVSAKANPVIIDGRNVIEPDEFIGKGFVYKGIGRGDKNSHKIK

SEQ ID NO: 83403 - protein, 470 aa, Oryza sativa Japonica Group
MASRRQWGAGAGAVDVPAQERKGGKAATDHLLRAFFAVFFVLEGLSWRRRRRRDGEGVFLLRYVACLLCLQAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDSHNELAVVDYVEDIYRFYRNTENTYRPLCTYMVSQTEINERMRAILTDWLIEVHYRLMLMPETLYLTVYIIDQYLSLENVPRKELQLVGVSAMLIACKYEETWAPLVKDFLVISDNSFSRQQVLSTEKSILNKLQWNLTVPTMYMFILRYLKAALGDEELEHMTFFYAELALVQYSMLFFAPSVIAAAAVYAARCTLGLSPLWSDLLEYHTGLAEPQLLECARRLVSLHAAAPESRQKVVYKKYASPKLGAVSLHSPAKKLLPPPSPVAA

SEQ ID NO: 83404 - protein, 99 aa, Zea mays
  misc_feature (72)..(72): Xaa can be any naturally occurring amino acid
MVGVSPKIAPSMLSSDFANLAAEAKRMIDLGANWLHMDIMDGHFVSNLTIGAPVIESLRKHTNAYLDCHLMXTNPMDYVDQMAKAGASGFTFHVEVAQE

SEQ ID NO: 83405 - protein, 219 aa, Oryza sativa Japonica Group
FTDKDKAAAHLKGGAKKFVISAPSKDAPMFVVGVNEKEYKSDVNIVSNASCTTNCLAPLAKVINDRFGIVEGLMTTVHAITATQKTVDGPSMKDWRGGRAASFNIIPSSTGAAKAVGKVLPALNGKLTGMAFRVPTVDVSVVDLTVRLEKPASYDQIKAAIKEEAEGKLKGILGYVEEDLVSTDFQGDSRSSIFDAKAGIALSDTFVKLVSWYDNEWGY

SEQ ID NO: 83406 - protein, 184 aa, Ehrlichia ruminantium str. Welgevonden
MFIMYYTKRLIMNLDNVTSGNNVPKEINVIIEISQNSYPVKYEFDKKKNLFCVDRFLPTSMYYPCNYGFIPHTCAGDGDPVDVLVASRFPITNGVLICARPVGVLVMHDEGGEDIKVLAVPVNKVDQYYSSIQNYTDFPVSFLNSISHFFTFYKKLEEDKFVSVEGWKDISAAETFISNALLSK

SEQ ID NO: 83407 - protein, 448 aa, Magnetospirillum magnetotacticum MS-1
MEAVMDQVRPAPPGQASAEASLGALNASVPVRMDGSWLRRLVAFLGPGYMISVGYMDPGNWATDIAGGAQFGYTLLAVILLSNLMAIVLQALAARLGIATGLDLAQACRERTSRPVAIALWLICEAAIIACDLAEVIGTAIALKLLFGIPLTLGAIITALDVFVVLLLLRRGFRALEAFVIGLLTIIFVCFGLQIAMAAPPLQAVLGGFIPSREIVTNPAALYIAIGIIGATVMPHNLYLHSSIVQTRAYPRTEEGRREALRFAVTDSTVALMLALFVNAAILIMAAAVFHAGGRTDVEEIEQAYELLSPLLGVGLASTLFAVALLASGLNSTVTATLAGQIVMEGFLRLRLPNWARRLITRGIAIVPVVIVTALYGDQGTAKLLVLSQVVLSMQLPFAVIPLVRFVSDRKLMGSFVVPGWLKGLSWAIAAIIVVLNLKLLAETLLPG

SEQ ID NO: 83408 - protein, 432 aa, Agrobacterium tumefaciens str. C58
MRVNVTRLSSGLTVVTERMPHLESVALGVWIKSGSRNETTAEHGIAHLLEHMAFKGTARRTARQIAEEIENVGGEVNAATSTETTSYYARVLKDHVPLAVDILADILTESLFDEDELEREKNVILQEIGAATDTPDDVIFDNFSGVAYRDQTIGRPILGTPDTVQSFTSGEIRHYLARNYTTDRIFVVAAGAVDHESFVKQVEERFASLPLVPAAPPVMEKAIYTGGEIRETRDLMDAQVLLGFEGKAYHARDFYCSQILANILGGGMSSRLFQEVREARGLCYSVYAFHWGFSDTGIFGVHAATGGNDLPELIPVIVDELRKSSETIHQDEINRARAQIRAQLLMGQESPAARAGQIARQMMLYGRPIPNEEMMTRLEDITRERLTDLAGRLFFDTVPTLSAIGPLEQLPPLSDITAALSAQQPARIKANG

SEQ ID NO: 83409 - protein, 610 aa, Colwellia psychrerythraea 34H
MLEMAVIYLAAAIIAVPIAKRVGLGSVLGYLLAGILIGPFLLGLVGDQTDVMHFAEFGVVMMLFLVGLELQPSRLWKLRHSIIGLGGLQVVVTTLLISAACYTILSLAWQTSLAIGLMLALSSTAIVLQTLNEKGWIKQEAGQNAFSVLLFQDIAVIPILALVPLLAFSDNISDSGSHGNLIEHFPVYIQTAISVGVIAAIILAGKYVSAPLFRYIAETRLRELFTVFALFLVIVIAVIMQKIGLSPALGTFLAGVVLAESEFRHELEVDIEPFKGLLLGLFFITVGASIDFPLLFEELGLVTLLVVSLIAIKAAVLFLLSILFKMEKKQKLLFTLALAQGGEFAFVLLSLTSSLQILTPEQSKITTLVVAISMLMAPVLLIFYEKVLDKEAENAREFDKPEDIEATKSVIIAGYGRFGQIVGRLLGSQGYHLSILDHSPTQIDLLKKFGNKVFYGDAARKDLLEASGAQEAQLLVIAIDDADKIIEIAQLAQKHYPNLQIVARAIDRHHAYELIRIGVKTIKRETFESALGLGVSALELLGNSQESAKRAGQLFSEHDRESMHVLSEVWGDDHSYGVAVKQRMELLKQVLVSDEEEQSKIQTCQKSPEA

SEQ ID NO: 83410 - protein, 652 aa, Zea mays
MEQDQSVVVGSADSGAAAFGFATGNPPSLAVTGGSAVAPDGGAQAVDASAYQAEHTALNGTVGDMGNYPSTGVAENGEAVPNETGEPVPELSYEEAVLSAEEARLWSVVTANSLDFNAWTALIEETEKNAENNILKIRKVYDSFLAEFPLCFGYWKKYADHEARLDGVSKVIEVYERAVLAVTYSVDIWYNYCQFAISTYDDSDIIRRLFERGLAYVGTDYHSNILWDEYIKYEESLESGHQWGASYAQQAAYPAYGTYDYSHQMPQPAPQTAAYGAYPPTYSVQAYTGRKVAIVGSGPSGLAAADQLNKMGHFVTVFERADRIGGLMMYGVPNMKTDKIGVVQRRVNLMAEEGVTFVVNANVGSDPLYSIERLRSENDAVILACGATKPRDLTIPGRELSGVHFAMEFLHANTKSLLDSNLEDGKYISARGKKVVVIGGGDTGTDCIGTSIRHGCTSLVNLELLSKPPSTRAADNPWPQWPRIFRVDYGHQEAATKFGKDPRTYEVLTKRFIGDGNGKVKALEVVRVKWEKVDGRFQLKEMEGSEEIIEADLVLLAMGFLGPEATIAEKLGLEKDNRSNFKAQFGDFATSVDGVFAAGDCRRGQSLVVWAITEGRQAAAAVDKYLSRYDQNAAATGDSTPSGTGLVQPVAA

SEQ ID NO: 83411 - protein, 132 aa, Glycine max
  misc_feature (109)..(109): Xaa can be any naturally occurring amino acid
  misc_feature (125)..(126): Xaa can be any naturally occurring amino acid
RKNPTSPSPHRRTSRWRRGARRGFRTRRARRLQHGWASSRVSARPAQSGASRGRAVACAVSFRPCIDIHKGKVKQIVGSTLRDASDDGTALVTNFESDKSPAEFANIYXEDGLVGGHVIMLGGDXXSCSAAL

SEQ ID NO: 83412 - protein, 490 aa, Xylella fastidiosa Ann-1
MLVSGVWLCLVWAAIFCRVSCCIANAIRWDVSLLIHRSMSSSMSSVQPTSPVSDSPSLGEMHASVAVSRRGHWGFRLLAFLGPGYMVSVGYMDPGNWATGLAGGSRFGYMLLSVILLSNVMAIVLQALAARLGIASDMDLAQACRARYSRGTTLVLWAVCELAIIACDLAEVIGTAIALNLLLGVPIIWGVVITAVDVVLVLLLMHRGFRALEAFVIALLLVIFGCFVVQIVLAAPPLQEVLGGFVPRWQVVADPQALYLAIGIVGATVMPHNLYLHSSIVQTRAYPRTPVGRRSALRWAVADSTLALMLALFINASILILAAAVFHAQHHFDVEEIEQAYQLLAPVLGVGVAATLFATALLASGINSTVTATLAGQIVMEGFLRLRLRPWLRRVLTRGLAIVPVIVVVALYGEQGTGRLLLLSQVILSMQLPFAVIPLLRCVADRKVMGALVAPRWLMVVAWLIAGVIVVLNVKLLGDYAVHLMVGVSD

SEQ ID NO: 83413 - protein, 447 aa, Candidatus Blochmannia floridanus
MPEIVNIISREIVDSRGNPTVESEVHTKSGFFGLASVPSGSSLGSQEALELRDNDHARFFGKGVKKSVNIINSTIRVSLLNIDVTKQSVIDEIMINLDGTNNKSQLGANSILSVSLAIAKAAASFMGMPLYQYIARLYGMSSNVYSMPVPMMNIMNGGKHADNNLDIQEFMIVPVGAKNIKQAIQMGSEISYSLKNVLNNLGISIALGDEGGYAPNLKSHSYALELINKSIEQSNYVLGKDVVLAIDCAASELFEVSTGKYVINSEKVSFTSEEFVDYLSSLARKYCIFSIEDGQSEHDWHGFSYLTKKLGDIMQLVGDDLFVTNPNLLKMGINKNVANSILVKPNQIGSLTETLNVIKLAKESGYSTIVSHRSGETEDTSIADIAVGTSAGQIKTGPVRCSERTSKYNRLIRIEEFLKDNSKFYGVNEIKNLSAQLWMYQNKNMNI

SEQ ID NO: 83414 - protein, 312 aa, Agrobacterium tumefaciens str. C58
MPMALGHEAAGVVEALGEGVRDLEPGDHVVMVFMPSCGHCLPCAEGRPALCEPGAAANAAGRLLGGATRLNYHGEVVHHHLGVSAFAEYAVVSRNSLVKIDRDLPFVEAALFGCAVLTGVGAVVNTARVRTGSTAVVIGLGGVGLAAVLGARAAGASKIVAVDLSQEKLALASELGATAIVNGRDEDAVEQVRELTSGGADYAFEMAGSIRALENAFRMTKRGGTTVTAGLPPPGAALPLNVVQLVGEERTLKGSYIGTCVPLRDIPRFIALYRDGRLPVNRLLSGRLKLEDINEGFDRLHDGSAVRQVIEF

SEQ ID NO: 83415 - protein, 569 aa, Candidatus Blochmannia floridanus
MIMLKYNNKLLSDNERIKKNSNFLRGTIEKDLDNNLTGGFNVDNAQLIRFHGMYQQDDRDVRLERMNQKLEPLINMMLRCRLPGGVITSQQWLNIDNFSEEQTLYSSIRLTTRQTFQLHGILKPKLKGIHQLLNKLGLDSIATAGDVNRNVICTANPMESKVHYQIWELSKKISEHLLPKSKAYAEIWLNEKKIESIDSEPILSSVYLPRKFKIAIAVPPVNDVDVYANDLGLVAIKDNTGNLIGFNVLIGGGLAMTYGDKSTYPRMASEFGYINLQDILKIVESVITVQRDWGDRYNRRHAKTKYTLVKVGIDILKKEIENRSGLKFSPMYPYKFTERGDKFGWIRGINQDYWHLTLFIENGRVCNTSNILIKKGLSEIAKVHSGFFRITTNQNLIISEIHQDKKDIIEDLLKQYGLLGDFVTSQRKSSMACVAFPTCPLAMAEAERFLPAFVTKVEHVMSKYNLQRDAIILRVTGCPNGCARAMLAEIGLTGRGIGRYNLYLGGNKNGTRIPRLYKENITEDEILHVLDITIGDWAKNRKTQESYGDYVVRAGIVRAVINSEEDFYL

SEQ ID NO: 83416 - protein, 435 aa, Heliobacillus mobilis
MFIFVVGLNHKSAPVEIREQLSFPEHILESSLHRLKSEPGIEGCAILSTCNRTEIYAATTDLEKGQAAVKRFFSNSGPLQVDDFANSIYTHTLYDAIRHLFRVSAGLDSMVLGETQILGQVRRAYQAACDYGTSNGIINTWFQQAITVGKRVRTETGIDQHAVSISYTAVELARQVFDSLEGRTALILGAGKMSELTLTHLIANGVTTVLVANRTRERADELARKCGGKAVSFAELEQHMEVADIVISCTAATHYVIRRNLVETVMAKRPERPLFLIDIAVPRDIEPAVGTVQSVHLFDIDDLNSVVDRNLAERQKAASQAEVIIEEEIHEFIKWLNSLFVVPTIVALRNKGDAIKEKELERVLGKLKSLSEKDKKTLGAMASSIVKQLLHDPVIQIRHYAASPEGHLYSEILQNLFSLDIAGQRPKGCDDNNLR

SEQ ID NO: 83417 - protein, 518 aa, Xanthobacter autotrophicus Py2
MPTKRQQPLKRQRATKIVATVGPASNSEEKLKALFLAGVDVFRLNFSHGTQENHGEVLARIRRLEKEMNRPIGVIADMQGPKLRIGRFKDGAIAIKAGDILHFDADVDRPGDETRVPIPHPDILAALNVGSTVLCDDGKVRLKVVKKGEGFLEAQVVAGTRLSNNKGFNIPDVVLPLSPLTDKDRLDLEFACEAGVEWIALSFVQRPEDIHEARALIKDRAAVMLKMEKPSAVDYLTELVELSDSIMVARGDLGVEISLAEVPALQKRMIAEARKFGRPVIVATQMLESMITAPVPTRAEVSDVATAVYEGADCVMLSAETAAGQFPVEAVTFMDDIIRHVECDPGYRQALDATQAEWGKTIGDAVTKATYQAAIAVDASALVAFTLSGTTGLRAARERPAIPILGLTPKMETARRLALSYGVHAVHMKEDIHSFGDMVDTAVRTAVEHGLGKPGDRLAITAGVPFAKPGTTNIMRITTIGADSPPSRHDADTPAVRSTKAHESKGQEKKAHGSKVHA

SEQ ID NO: 83418 - protein, 403 aa, Methylobacillus flagellatus KT
MQKSFWQAGHKPTLFSAFLYFDLSFMVWVLLGPLAVQMAADLALTPAQKGMMVATPVLTGALLRLVMGVLVDQIQPKKAGLIGQLIVLAALAFAWLHGVHSYQQALLLGVFLGFAGASFAVALPLASRWYPPEHQGTALGIAGAGNSGTALAALFAPGLALAFGWHNVFGLALIPLGIALVVYMVFAKDAPNPPAGKSLSQYLAVLKDKDAWWFMFFYSVTFGGFVGMASSLTIYFNDQYGLDPVHAGYFTAACVFAGSFVRPIGGNLADRIGGIRTLSAMYILAAVFLFILSVGLGQQLAGLAIVVLAMISLGMGNGAVFQLVPQRFRKEIGVMTGLIGMAGGIGGFYLASSLGYSKQVTGSYQLGLAVFASLAVVALFGLTLVKKRWRTTWGSAAVTSARV

SEQ ID NO: 83419 - protein, 376 aa, Aspergillus nidulans FGSC A4
MPSGSVLVTGGTGYIGSFTTLALLEAGYKVVVADNLYNSSAEALNRIELISGKKAEFAQLDVTDEAAFDKVFEAHPDIDSVIHFAALKLYPLKAVGESGEKPLDYYHVNVYGTICLLRSMVRHNVTNIVFSSSATVYGDATRFPDMIPIPEHCPLGPTNPYGNTKFAIELAITDVINAQRNNAKKAGNETEAAKWNGALLRYFNPAGAHPSGIMGEDPQGVPYNLLPLLAQVATGKREKLLVFGDDYASHDGTAIRDYIHILDLADGHLKALNYLRANNPGVRAWNLGTGRGSTVYEMIRAFSKAVGRDLPYEVAPRRAGDVLNLTSNPTRANTELGWKAQRTLEQACEDLWLWTKNNPQGYRQQPPAELLEQLKK

SEQ ID NO: 83420 - protein, 340 aa, Ustilago maydis 521
MPLFKSSDIPDLTGRVAIVTGGNSGLGEVSCLELARNGAKVYMASRTESKAQEAIQKIKQAIPKADIHFLQLNLTELAAVRKAAEDFLSREQRLDILLNNAGVMATPYTFTKDGIELQVGTNVVGHYLFTMLLLPTLYKTSKLPEYSAPDSPSVRIVQVSSLGHVASPSDTSFKDLEAVNKQHWPEVKGTWDRYGKSKLGNILIANELSKLLPKDARITSLSIHPGVVRTGLLRGPNESYGKIIGSVNSLLSRFFTAAEDGALTQLYACTSPEVDRLNLNGAYLVPVAKLGQKSKLAQDTDGRLGQELFSFCNSFIKEKLDLDLPAHLKEIGVQLPQSHL

SEQ ID NO: 83421 - protein, 488 aa, Candida glabrata CBS 138
MHCDTVEVVKFLMDNHIEIMSPPISGELSQVFVIYKATNVKIEAFKRIINAIHEISHGIELKIGDLNEEPIITYIDCAILHEFHCILKNRKRQHPKGDELKLNGLKQEEKFRRLIEDKSSDFQKRIEAILTTRTQATQLGIERAKQLEPVEPVIPRCNSLEHRELLSKCTMISNNKIISLKWPIFINQKQEFIQCVQNKIHFVPNMKPKTDPNLGDCSYLDTCHKMHCCRYVHYLQFTPQILETKYNSWLADENIARSKNSWISLYTRGECCSNLSRNVAPPQWIQCDVRKFDLSLLGKFSAVIADPAWNIHMHLPYGTCNDTELLNLPLNILQDEGILLLWVTGRAIELGKESLKKWGYKVINEISWVKTNQLGRTIVTGRTGHWLNHSKEHLLLGLKGDPEWLNRNIDLDIIVSPTRETSRKPDEVYGIVERLVGSKSRKLEIFGRVHNLRPGWITIGNQLEGTHVIDPEIKNRLLIQELANKKST

SEQ ID NO: 83422 - protein, 274 aa, Zea mays
PKAEATVRASATREVAAAVPGARVRATMSSAVEAVSCPKVDVPAGPEPGEPAKEAAPPAEHCDTAPNGKCAPRCHGEEEEEEEDEEDEEKAPKAIDLGPMVSIKEQLEKDKDDESLRRWKEQLLGGVDLNSVGETLEPDVKIMSLSILSPGRPDIVLPLPVEPNGKGVWFTLKEGSPYRLKFTFSVSNNIVSGLRYTNTVWKTGLKVDRAKEMLGTFSPQLEPYTYVTPEDTTPSGMFARGSYSARTKFLDDDRKCYLEINYTFDIRREWPSTS

SEQ ID NO: 83423 - protein, 271 aa, Zymomonas mobilis subsp. mobilis ZM4
MSHIHFIGSGQMSEAMIRAIIKHKTASASDITAYDIRPEREKELHDNYGITTFAKPKKNIETLQKADIVVIGVRPQDDLKAVTADIAQNAKEKALIVSIVAGVTLAQFEDLLGKERAIARIIPNTLTDTGLGYSGVVINNQADKALTEKFVSGFGKCLFLEESLIDIFTGFGVCGPNYVYYFIEALVDAGVLAGLPRDIAWETTMENLVGSVKMLEISGKHPRQLLDINNSPAGVGMNSLFALNQSDFTAGLQKSVLAAVKRTTELGQKKD

SEQ ID NO: 83424 - protein, 404 aa, Hyphomonas neptunium ATCC 15444
MNTDFHKIRRLPPYVFEQVNRTKAALRAKGADIIDLGMGNPDLPTPKHIVDKLVETARKPDVNGYSASRGIPGLRRALTDYYKRRFDVVLDRDREVIVTLGSKEGFANLAQAISAPGDVILAPDPSYPLHHFGFIIAGASIRGVPAHTPEQYLSSLGRAVKYSVPPPTAMVLCFPSNPTAAVCDLDFYKEAVKFAKKHDLWVLSDLAYNEIYFEEPTPSILQVDGAKDIAVEFTTMSKTYSMAGWRMGFVAGNEKLVGALARVKSYLDYGAYTPIQVAAVAALDGPQECVAETRAIYKGRRDVLVDSFTRAGWPVPSPKASMFAWAPIPEQLRHLGSLEFALQLINEAHVAVAPGAGFGEHGDDYVRIALVENEQRIRQAGRNIRKFLAARGVKEIKPAVAAAE

SEQ ID NO: 83425 - protein, 334 aa, Methanosarcina mazei Go1
MSKIVITGGAGFIGSHIAENLAKDGHEIVIVDNLDPYYSVDLKKKNLNIALNSGDATFINADVTDLSGIKDVIDSTVDYVYHEAAQAGVRISVEDPFKPNDVNVHGTLNVLKASLDAGVKKVINASSSSVYGKVKYLPFDEQHPTEPVSPYGVSKLAAEHYCRVFYEVYGLPTTSLRYFTVYGPRMRPDLAISIFTRKMLANEPITVFGDGEQTRDFTYIEDVVEANKRLLYNRATDGKVLNIGGGNRISVNNLIENLRFITGSTSEIINADKQKGDTEDTLANVDLGNNMIGYTPLFNINKGLNKFVDWFKTENQCRDPEQSLLSQSAPQLLK

SEQ ID NO: 83426 - protein, 257 aa, Hyphomonas neptunium ATCC 15444
MGRVSGKMALITGGAQGLGEATARMFAREGAKVTVTDVNGAGAEKVAASINEAHGPGTAFAFQHDVTSEEQWKDVAQKAHDAMGGLNILINNAGIGGLGSVEDETYERFRKVQAVDVDSIFLGCKYSIPLMRDHGLGSIVNISSIAGIIASANYISYNTAKAAVRHMSKSIALHLAKTGGQIRCNSVHPVFINTPILDGIKEMFGEEKGLQKLARQVPLGKVGEPDDIAYAVLYLASDESKLVTGAELKVDGGISAM

SEQ ID NO: 83427 - protein, 412 aa, Gossypium hirsutum
MGSLGALVKHPGDFYPLLKLKMASRHAERQIPSEPHWAFCFSMLHKVSRSFALVIQQLDTELKNAVCIFYLVLRALDTVEDDTSVATDIKVPILEEFYRHIYDRDWHFSCGTKNYKVLMDEFHHVSTAFLELEKGYQEAIEDITKRMGAGMAKFICKEVETVGDYDEYCHYVAGLVGLGLSQLFHACGTEDLAPDTLSNSMGLFLQKTNIIRDYLEDINEIPKSRMFWPRQIWGKYVNKLEDLKYEENSVKAVQCLNDMVTNALIHVDDCLKYMSALPDPAIFRFCAIPQVMAIGTLALCYNNIEVFRGVVKMRRGLTAKVIDRTNTMADVYGAFYDFSCMLKAKVDKNDPCAQKTSSRLDSILKTCRDSGVLNERKSYIIPNQTNYTPLLAVLLFILLAITLANRGPHEPN

SEQ ID NO: 83428 - protein, 433 aa, Picea sitchensis
MASTVSTTCVLSNKIEAHLLHKSRNNNGRRKTRYLEGNSFANPWYPPSCNRRKLNRKHGLLLVSCSTPSYTGRVGTHSRVGNVTLASFEIKPKRFPNGQRVDFTESLSGVLPLVVAGTAAAALIKPATFAWVSKEYYAPALGGIMLSIGVQLSVKDFALAFQRPLPLTVGYLAQYLLKPILGVLIARAFGTPPIFAAGFILTACVAGAQLSTYASFLSKGDVALSIVLTSLTTISSVIITPVLTGLLIGSVVPVDAIAMSKSILQVVLIPVALGLALNTYAKPFVNLIRPFMPLMAMVCTSLCIGSPLALNQSQIISMEGLQLVFPVLSFHTFAFVIGYWVAKLPLLRQEENVCRTISLCTGMQSSTLAGLLATQFLGSTNAVPAACSVVAMAIMGLSLASFWGRGFRIKDIPTKFMSRLDTFLNAESSNAYS

SEQ ID NO: 83429 - protein, 468 aa, Colwellia psychrerythraea 34H
MSTNTTTSSLAFSSLSLKQDLVKNLSSLGYEQMTPIQAKTLPELLKGKDVIGEAKTGSGKTAAFGLALLNKLEVKKFRIQSMVICPTRELADQVAKELRKLARGIHNIKILTLCGGTPFGPQIGSLEHGAHVIVGTPGRLEEHVIKGTLQLDNLNLLVLDEADRMLEMGFQAALDNIVGRTPLDRQTLLFSATFPDQIKSISESIMTDPVMVKIASSEDQSTISQKFFKVGNDDDRLDALRLLLLGNQVESTAIFCNTKKETQQVADALHFDGFSVLALHGDLEQRDRDQTLLRFANKSASILVATDVAARGLDIDSLDLVINYHIARDSEVHVHRIGRTGRAGSTGIAYSLFSDKESYKVGLLEDYLEAVITPEPLPSLAVLSNERPQAKMATIQIDGGKKQKVRAGDILGALTGDNGVQGSQVGKISVLDNKAYVAVTKAALNLALKKISKGKMKGRTFNARHLTN

SEQ ID NO: 83430 - protein, 238 aa, Thlaspi caerulescens
MSSQICRSASKAARSLLSSARNVRFFSEGRAIGAAAAVSASGKIPLYASNFARSSGSGAASKNWLTGLIALPAAALMLQDQEVLAAEMERTFIAIKPDGVQRGLISEIVSRFERKGFKLVGIKVVVPSKDFAQKHYHDLKERTFFNGLCDFLSSGPVIAMVWEGEGVIRYGRKLIGATDPQKSEPGTIRGDLAVVVGRNIIHGSDGPETAKDEINLWFKPQELVSYTNNAEKWIYGDN

SEQ ID NO: 83431 - protein, 574 aa, Vibrio parahaemolyticus RIMD 2210633
MISGILASPGIAIGKALLLQEDEIVLNTNTISDDQVEAEVARFFDARNKSAAQLETIKQKALETFGEEKEAIFEGHIMLLEDEELEEEILALIKNDKMTADHAIHSVIEEQACALESLDDEYLKERATDIRDIGSRFVKNALGINIVSLSDINEEVILVAYDLTPSETAQINLDYVLGFACDIGGRTSHTSIMARSLELPAIVGTNDITKKVKNGDMLILDAMNNKIVVNPSEAEVEEAKAVKAAFLAEKEELAKLKDLHAETTDGHRVEVCGNIGTVKDCDGIIRNGGEGVGLYRTEFLFMDRTALPTEEEQYQAYKEVAEAMNGQAVIIRTMDIGGDKDLPYMDLPQEMNPFLGWRAVRISLDRREILRDQLRGILRASAHGKLRIMFPMIISVEEIRELKNAIEEYKAELRAEGLAFDENIEIGVMVETPAAAAIAHHLAKEVSFFSIGTNDLTQYTLAVDRGNEMISHLYNPLSPAVLTVIKQVIDASHAEGKWTGMCGELAGDERATLLLLGMGLDEFSMSGISIPKVKKVIRNSNFAEVKAMAEEALSLPTAAEIEAVVEKFIAEKTQ

SEQ ID NO: 83432 - protein, 908 aa, Agrobacterium tumefaciens str. C58
MKKWVYTFGNGAAEGGAGDVAILGGKGANLAEMASLGLPVPPGLTIIADACALYHKNGRDLPEELKLQVMAGLHGMEIVTGKTFGGSHSPLLISVRSGARASMPGMMDTVLNLGLNDRTVEALGHDAGDARFAWDSYRRFIQMYGDVVMGLDHEMFEEILEDEKGRLGHEYDTDMSAVEWQHVVSLYKKLIEDELGEAFPQDCHVQLWGAIGAVFASWTNHRAVTYRHLHNIPGDWGTAVNVQAMVFGNLGSSSATGVAFTRNPSTGEAELYGEFLVNAQGEDVVAGIRTPQSITEAARLVSGSDKPSMEKLMPEAFSEFLAICKRLETHYRDMQDLEFTIERGKLWMLQTRSGKRTTRAAMKIAVDMVEAGLISQEEAVCRIEPSSLDQLLHPTIDPGISRPIIGSGLPASPGAATGEIVFTSEEAVAAEAEGRRVILVRIETSPEDIHGMHAAEGILTTRGGMTSHAAVVARGMGIPCVTGAGSMRVDMRNKVLIGVGCMLKRGDVITIDGSSGRVLKGEVPMTQPELSGDFGKLMQWADNLRRMTVRTNADTPADARAARAFGAEGIGLCRTEHMFFEGDRIHVMREMILAESEKGRRAALDQLLPMQRSDFTELFQIMHGLPVTIRLLDPPLHEFLPKSDGEIVEVAAAMGMPQTVFRQRLDALHEFNPMLGHRGCRLAISYPEIAEMQARAIFEAAVAAARITGAPVVPEIMVPLVGLRSELDYVKAVIDTVAAEVAEETGMSIEYLTGTMIELPRAALRAHVIAEAAEFFSFGTNDLTQTTFGISRDDAARFINTYQRKGIIERDPFISLDFDGVGELIRIAAERGRQTRPELKLGICGEHGGDPASIHFCEDADLDYVSCSPFRVPIARLAAAQATLAAKAKQGETPSNVAFIPVRGSVGR

SEQ ID NO: 83433 - protein, 296 aa, Vibrio fischeri
VLRALYESDKRDKIEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 83434 - protein, 166 aa, Vitis vinifera
MEIFWPLERSESNNGVGSTNGPAFECILMKDFLKSLSKRLKGNIAGYENYHRVYVPEGQSPKFDPKEPLRVYVLFQHIQKMLSGEIAVIAETGYSWFNCQKLKLPRKCRYEFQMQYGSIGWLVGVTLGYVQATPKKRVMISCIGDGSFYVTLLDISIMILLIRNRQ

SEQ ID NO: 83435 - protein, 406 aa, Thermus thermophilus HB27
MFREAELRNGLRVIAEVVPGARSVALGYFVKTGARDETKEESGVSHFLEHMVFKGPEDMDALAVNRAFDRMGAQYNAFTSEEATVYYGAVLPEFAYDLLGLFAKLLRPALREEDFQTEKLVILEEIARYQDRPGFMAYEWARARFFQGHPLGNSVLGTRESITALTREGMAAYHRRRYLPKNMVLAATGRVDFDRLLAEAERLTEAWPEGEAERAYPPLEPAFGVEERPYEKARALYLVALFPGVAYQEEARFPGQVLAHLLGEEGSGRLHFALVDKGLAEVASFGLEEADRAGTFHAYVQADPARKGEVLAVLQEELDRLGREGVGEEEVERAKTPLATGLVFAGETPMQRLFHLGMEYLYTGRYLSLEEVKARVQRVTSREVNALLERGFLEKGLYYLVLPHGA

SEQ ID NO: 83436 - protein, 403 aa, Thermus thermophilus HB27
MSRVERLPNGLVVALEERDFPGVAFQLLVPAGAVNDPEGMEGAAALLEGWLWKGAGDLDARALAQALDALGVRRNSGAGLEYTAFAAAFLPEVLDEVFRLYALLLTRPRLPEEGLEAVRSVALQALLSLEDQPARKLLSELRRKVFRSPHGREPLGREEGLKGAGAEALKADYRRRYTPKGAILAVAGGVSWERLRAALEPFLAWEGEEALYPAPELSEPHRFVLRRPTAQVQIGLAYPDVGPEDPGFYAARLALEVLSGGMSSRLFTEVREKRGLVYAVSAFPAGVKGQGLLMAYAGTTKERAGETLEVLRAEVERLAEGVTEEELSRAKVGLKTALVMADESIRSRAASMARDLYMLGRVRSLSEIEAAIEGTSLEAVNAFLRAHPYRDPWVGLLGEVEDV

SEQ ID NO: 83437 - protein, 117 aa, Zea mays
PVAAGETGQAYNINVDTAAGEIAAPVGAEKLLLLTDVFGILAGRNDPGSLGKVVDIAGVRKMVADGKVAGGMIPKGECCVHALAQGVPPPSIIDGGVPPSFLLEIFTEGGTGPMIPG

SEQ ID NO: 83438 - protein, 374 aa, Streptomyces purpurascens
MSSSSPGEPLEPTDQDLDVLLKNLGNLVTPMALRVAATLRLVDHLLAGADTLAGLADRTDTHPQALSRLVRHLTVVGVLEGGEKQGRPLRPTRLGMLLADGHPAQQRAWLDLNGAVSHADLAFTGLLDVVRTGRPAYAGRYGRPFWEDLSADVALADSFDALMSCDEDLAYEAPADAYDWSAVRHVLDVGGGNGGMLAAIALRAPHLRGTLVELAGPAERARRRFADAGLADRVTVAEGDFFKPLPVTADVVLLSFVLLNWSDEDALTILRGCVRALEPGGRLLVLDRADVEGDGADRFFSTLLDLRMLTFMGGRVRTRDEVVDLAGSAGLALASERTSGSTTLPFDFSILEFTAVSEEAAPAAQASEALPAQE

SEQ ID NO: 83439 - protein, 124 aa, Synechococcus sp. WH 7805
MREAVTVQSVSTRVERPWGWYEDLLSGPGYKLKRLLVRHGCRLSLQRHRHRSENWTVVAGTGQLLCDGHLVKAKAGTTFHIPCGSIHRASGGPGDLLIIEVQHGGTLEESDIERLEDDFGRVIN

SEQ ID NO: 83440 - protein, 485 aa, Pseudomonas syringae pv. tomato str. DC3000
MLKNQLKDPSLLVDRAYVDGQWISADDGATLAISDPATGEVIAQVPALQGAETRRAIEAADRAWPAWRARPAAERAALLERWHQAMLDNVEDLALIMTLEQGKPLNESRGEIRYGASFVKWFAEEARRSYGETIPTPSADRRLMTLKQPVGVCAAITPWNFPNAMITRKCAPALAAGCTIIVKPSDLTPLSALALAVLAERAGIPVGVFSVVTGMPTAIGEELTGNPVVRKISFTGSTPIGRLLMRQSAEHIKRLSLELGGNAPFIVFDDADLEQAVAGIMLSKFRNAGQTCVCANRILVQSGIYDRFAARLVEEVAKLKVGNGLEEGVTIGPLINPAAVSKIARHIDDALSQGAKLLYGGLPNGDGQFVQPTVLGDTHAGMLLANEETFGPVAPLMRFTDEAEALALANATPYGLAAYYFTQDLRRSWRFGEALEFGMVGLNTGIISMEIAPFGGIKQSGLGREGSSYGLDEYLEVKAFHVGGL

SEQ ID NO: 83441 - protein, 251 aa, Zymomonas mobilis subsp. mobilis ZM4
MRFQDKIVVITGGGNGMGKAAAERFSSEGAIVVLADWQIKDAEEVAASLPKDRAWPYKIDVSDPDAVKKMMDDIAAKYGKIDVLVNNAGILIPGKIMDASIEDWKKISSVNIDGVIYCAKFAMPYLVKSKGCIVNTASVSGLGGDWGMVYYCTTKGAVVNFTRALALDSGVNGVRVNSVCPCLVKTKMAANWPESAQAQFKNRVSLGRIPEAEEIASVMAFLASDDARFITGVNLPVDGGATASDGQPHLG

SEQ ID NO: 83442 - protein, 694 aa, Synechococcus sp. WH 7805
MMEHPLGIFALLVAIAVLVPPLTRRLRLPDLVGLLAAGVLVGPHCLQWLDAQGETITLLSDIGAIYLLFTVGLEIDLEEFNRVKNRSVGFGLLVFAFGVATGVGIGQLFGFSLVPSLLLGALMATHTPLGYPIVRSYGAQRDESVIVSVGSTILTDIAALLLLAVALGLGRGNLTAAGMTGLFASIALFSLGVVWAIRWLGRRLWMRSITDENRVFLTVLLALFIASLGAELAGVEKIVGAFLAGLAVNSVLPEGRVKEQVIFVGGALFIPIFFIHLGLLLNLSDLAASVNTLDFTALMLIGALGCKALAAVIAGRWFRYSNNQILLMWSLAMPKVAATLATAFVGFQAGLLDATVLNSVLAVMVVTATLGPTLTTRSVVALMEPDESSSNPILSGSARNETANTRIRAVVRRPLNVVVPISNPDTERRLLTIAARLLKGDDAKSGQLLPLALVSPNLEDARGGLNRALAAARERLKEASVIGNHLSVNTRCLLRLDEDIPGGMSRSALEQGADLLLIGAGRPDRLRNWLFGDLVDGVCRTAHCPVVVVNLKEETETEFRRILVPIKDLSSNAREQFELALRLQGSAGETNGARITLLHIHDPRFNRHDRSWMREELLSWSARDDAEGLDLRIELCEGPGIDRFIHVQSRNHDLVILRSQRRRVAGLPIPASDRTSNLVNQLKCASLVVSDPLH

SEQ ID NO: 83443 - protein, 156 aa, Haemophilus influenzae
NRTNTPVLVDGKDVMPEVNAVLAKMKDFCQRIISGEWKGYTGKAISDVVNIGIGGSDLGPYMVTEALRPYKNHLNMHFVSNVDGTHIAETLKKVNPQTTLFLVASKTFTTQETMTNAQSARDWLLKAAKNESAVAKHFAALSTNAKDVEKFGIDTN

SEQ ID NO: 83444 - protein, 1481 aa, Mycoplasma penetrans HF-2
MSKQNDKIWNRSLDDIMSESFGKYAKYIIQDRALPDVRDGLKPVQRRILHAMNELKIHHDKPYKKSARTVGEVIGKYHPHGDSSIYEAMVRMSQEWKNNLPLLDMQGNKGSIDGDSPAAMRYTECRLSKFGQTILKDIDKNTVKFINNFDDSEQEPTVLPSLLPNILINGATGIAAGYATNIPPFNPSEVIDGTIYRILRPESSLAELAKIIKGPDFPTGGIIQGKEFIQEIYKTGKGKFFIRAKIEEEPTKSTKNVKRLIVKEIPYDTNKSAIVKSLDEIKYNNELPGFKEVRDDSDKNGISIVLEFDTEKDLEIIKTFLYKKTQLQISYNANMVLIKDRKPVQAGLLEILDSFIEHANNVVIKAAQYDLEKSLLRKEIIEGLIKAISEIDVLVNLIKSSVSKEEAKLKIQDYFKVNERQSEAIVNLRLYVLTSFDTEKLKKEYEELLEFIKEKELIINSVPYRNKFIVSILENHKKSFGYKRRSLIENEVEELEIETVDIVEERNGTCIVTRDNYIKFIDDVSIEELDLSKAKIKDADIPVDIFRLSTLDHLVCLTNRGKMITIPAYKIKMTKLKDNGVHINELITIDSFEKTILAFGVSKYSDINTEILVATKNSLIKRISLEDINLSKNAKSSTYVSLKGGNDDVVSAYILKKEYSEVVSVTQNGYATRYKIDEIPLVGRTAAGVKNMSLKDKDLMAFTVPIPKHENFLFFISNRGAKRIHINDIVVTSRSKLGKRIFQQIDSNPYIVNSGFMVGGRSNVFMLLESNELVSLKVAEIPITEADSRMNLITKIGKSSILKGTYLTINKSHIETSQTNNFLTLNSEKSSSSELKENSDDNEDDEHHFVEDDVEIIPIEKLKKQLEKQQPKENEFESSTNFNILEEMEKNKNSSKSNTKKEIEPSIEKVEEKTEDNQIQEEELENNSDEIIEESDNEELALEDAEEENEDNNSDESDDDIKITESEDSEDDNSEDYESDDENDELEDSTEETEDEEYYDDSEESEDETEITESEDSEDDNQDESYDEEDDSEETEDYESDDENDEEYSDDSEETEDEEYSDEENDDESEDSEENSEDDSEELYDESDEDSESYDEETEGYESDDENDEEYSDDSEEIVDESYDEEDDPEETEDESEDSEENSEDDSEELYDESDDEETEDYESDDENNEEYSDESEEIEDEFYDEEDDPEETEDEEYPDDESDDLDISDEDENEDNDSDESEDETEITEIKDSEDDNSEDYESDELEDSTEETEDEEYSDDSEENSEDDSEELYDESDEDSESDYEETEDYESDDENDEEYSDDSEEIEDESYDEEDGSEETEDEEYSDEENDDESEDSEENSEDDSEELYDESDDEETEDYESDDENDEEYSDDSEEIEDESYDEEDDSEEETDDESEDSEENSEDDSEELYDESDEDSESDDEETEDEEYSDDDYEEELENEFEEDESSDEDEEESEFSFDDLNDMEEDDLDDEDNED

SEQ ID NO: 83445 - protein, 179 aa, Thlaspi caerulescens
SSNASPVADLDSISRAKQRIKAGLATRRPWRVMFDYHSVGLPRGVSVVFSRIKTNIVYFQTNYAIVILIVLFLSLIKHPTSLIVFTVLIFVWVFLYFLRDEPIKVFRYQIDDRTILGVLSVITIVLLFLTGATFNIVGALLIGAVLVLIHAAFRTTEDLFLDEEAATSEASGLTSYPSS

SEQ ID NO: 83446 - protein, 322 aa, Vibrio parahaemolyticus RIMD 2210633
MSKIYEDNSLTIGNTPLVRLNKVSKGNVLAKIEARNPSFSVKCRIGANMIWEAEKAGTLKPGVELVEPTSGNTGIALAFVAAARGYKLTLTMPESMSLERRKLLKALGANLELTEAAKGMKGAIAKAEEIVASNPEKYLLLQQFNNPANPQIHEKTTGPEIWDATDGEIDVLVAGVGTGGTITGTSRYIKGEKGKAITSVAVEPAESPVIAQALAGEEIQPAPHKIQGIGAGFIPGNLDLDIIDRVEPVTSEEAIEMARRLMEEEGILAGISSGAAVVAANRIAELPEFEGKTIVTILPSSGERYLSTALFAGIFTEKENQQ

SEQ ID NO: 83447 - protein, 755 aa, Salmonella enterica subsp. arizonae serovar 62:z4,z23:--
MHFFNTKYTLRFIWYDQITLWIQETDMLYKGDTLYLDWLEDGIAELVFDAPGSVNKLDTATVASLGQALDVLEKQHDLKGLLLRSNKAAFIVGADITEFLSLFLVPEEQLSQWLHFANSVFNRLEDLPVPTLAAVNGYALGGGCECVLATDYRLATPDLRIGLPETKLGIMPGFGGSVRLPRMLGADSALEIIAAGKDVGAEQALKIGLVDGVVKQEKLIEGAMAVLRQAIVGDLDWKAKRQPKLEPLKLSKIEAAMSFTIAKGMVAQTAGKHYPAPMTAVKTIEAAARFGRDEALNLENKSFVPLAHTNEARALVGIFLNDQYVKGKAKKLTKDIETPKQAAVLGAGIMGGGIAYQSAWKGVPVIMKDINDKSLNLGMTEAAKLLNKQLERGKIDGLKLAGVISTIHPTLDYAGFDRVDVVVEAVVENPKVKKAVLAETEQKVRPQTVLASNTSTIPIGELASALERPENFCGMHFFNPVHRMPLVEIIRGEKSSDETIAKVVAWASKMGKTPIVVNDCPGFFVNRVLFPYFAGFSQLLRDGADFRKVDKVMEKQFGWPMGPAYLLDVVGIDTAHHAQAVMAAGFPQRMQKEYRDAIDALFDASRFGQKNGLGFWRYKEDSKGKPKKEEDAAVDDLLASVNQPKRDFSDDEIIARMMIPMINEVVRCLEEGIIASPAEADMALVYGLGFPPFHGGAFRWLDTQGSAKYLDIAQQYQHLGPLYEVPEGLRNKARHNEPYYPPVEPARPVGSLKTA

SEQ ID NO: 83448 - protein, 418 aa, Methanosarcina mazei Go1
MSKICVLGQGYIGLPTALLFANNGHEVVGIDVNKRVVDTLKAGKMPFEEKGFQELLDGAIAKNAFRAESLVEEADTFLVAVPTPFDSEMRMADLKYVVSACEMIVPHLKKGNLVIIESTIPPKTCDKQVKQILEKSILKMCEDFYVSHCPERAIPGNTLHEMVYNDRVIGGVDEKSTQLTAELYSSFVKGNLHLTTSTTAEMIKLMENTFRDVNIALANEFAQIADDYGIDVWKAIEIANKHPRVSILKPGPGVGGHCIAIDPWFLTENANNSSLIMMSRQINDSMPQYVLKMVKEILVGIENPTITVFGVAYKGDIADTRATPAKKFIRLAEKEGFKVKIYDPFVKEWSYPILELGEAVEGSDCIVVLTDHSEFKEMDPEKFGSKMNKLNIIDTRNIINKSLWKKSGYNIKIIGNES

SEQ ID NO: 83449 - protein, 290 aa, Bradyrhizobium japonicum USDA 110
MFKENLLAGRRILVTGGGTGLGKSMAARFLQLGAEVHICGRRKIVCDETATELMDLHGGRVTSHGVDIRNALAVEEMIENIFREAPLTDLINNAAGNFISRTEELSPRGFDAVANIVMHGTFYVTHAVGKRWIALKQPGNVVSITTTWVRNGSPYVVPSAMSKSAIHAMTMSLATEWGRYGIRLNTIAPGEIPTEGMSKRIKPGDEAGARTKAMNPMGRVGTMEELQNVAVFLISGGCDWISGETIAMDGAQALAMGGNFYQLRDWSDDDWKTARESIMAQNEKDRAKRG

SEQ ID NO: 83450 - protein, 296 aa, Vibrio fischeri
VLRALYESDKRDKIEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHAPHSAIVDGSQTRVSNG

SEQ ID NO: 83451 - protein, 306 aa, Oryza sativa
NDCIGEEVQKLAATLPDGGVLLLENVRFYKGAGKNDPEFANKLASVADLYVNDAFGTAHRAHASTEGVTKYLRPSVAGFLMQKELDYLVGAVANPKKPFAAIDGGSKVSTKIGVIESLLAKVDILILGGGMIYTFYKAQGYAVGKSLVEEDKLELATSLIEKAKSKGVSLLLPTDIVVADKFAADAESKAGPAPAIPDGWMGLDIGPDSIKTFSETLDTTKTVIWNGPMGVFEFEKFAAGTDAIAKKLADITAKGVTTIIGGGDSVAAVEKAGLADKMSHISTGGGASLELLEGKTLPGVLALNDA

SEQ ID NO: 83452 - protein, 288 aa, Staphylococcus aureus subsp. aureus Mu50
MNEQWLEHLPLKDIKEISPVSGGDVNEAYRVETDTDTFFLLVQRGRKESFYAAEIAGLNEFERAGITAPRVIASGEVNGDVYLVMTYLEEGASGSQRQLGQLVAQLHSQQQEEGKFGFSLPYEGGDISFDNHWQDDWRTIFVDKRLDHLKEELLNRGLWDANDIKVYDKVRSQIVEELEKHQSKPSLLHGDLWGGNYMFLKDGRPALFDPAPLYGDREFDIGITTVFGGFTSEFYDAYNKHYPLAKGASYRLEFYRLYLLMVHLLKFGEMYRDSVAHSMDRILQGTTS

SEQ ID NO: 83453 - protein, 353 aa, Rubrobacter xylanophilus DSM 9941
MKAARLHEYDAKIGTHPLRVEEVEDPKIEGPFDVIVRIGAAGLCRTDLHIIEGQWQPIQDPDHTLLPYIPGHENAGWVEEVGSAVTNVRPGDTVIVHPLITCGLCRACRAGDDMHCENASFPGLSRDGGFAEYLKTSARSVVKLDPGLHPRDIAALADAGLTAYHAVKKAAPLLYPGARCVVIGSGGLGHIGIQTLKALTPAEVIVVDPSEKALELARELGADQTVKVEGGYVERVLEMTGGGAEVVMDFVGEKGAQADAWRMTRPRGSHFVVGYGGKVEVPTIDIISTERNIVGNLVGTYNDLAELMTLTAQGKVRLHTRTYPLEEINAAIADLNEGRLQGRGIIVPEGAAA

SEQ ID NO: 83454 - protein, 450 aa, Streptococcus agalactiae NEM316
MKVVKFGGSSLASSQQLYKVLNIIKSDYTRRFVVVSAPGKRYEEDLKMTDALIQYYQNYINGKDIVKDQTWIINRYQEIISDLSLGSTIAEEITRSIEQLASLPIENNQFLYDCFLAAGEDNNAKLVATFFNQNDIPARYVHPNEAGIIVTKEPCNARIIPGSYDKIENLCLYNEVLVIPGFFGVTEDNQICTFSRGGSDITGSLIAAGIKADLYENFTDVDGIFAAHPGVVKNPHAIPELTYKEMRELAYAGFSVLHDEALLPAYRDRIPLVIKNTNNPQQPGTKIVLKHTRSNIAVTGIASDSRFASINVSKYLMNREVGFGRKVLQILEDLNISFEHMPTGIDDLSIVLREKELTPIKEQEILNYLTRKLEVDYVDIQHNLSTIVIVGENMKSQIGVTATATQALSREKINITMISQGSSEVSIMFVINSKDEKRAIKALYETFFQK

SEQ ID NO: 83455 - protein, 364 aa, Neptuniibacter caesariensis
MSELRTNVESVLGQIEIPFREQDLLTAGAINSLSCEGGEILVGIELDFPSAGVAKALEKSIQDKLAELSGVNSCKVSISHSVKASQGQQSIPLMAGVKNVIAIASGKGGVGKSTTTVNLALAMAAEGAKVGILDADIYGPSQGMMLGVDEGVRPQPYDEKSFSPIEAHGLQSMSMSYLVEENTAMVWRGPMAAGALQQLLTQTRWHDLDYLFIDMPPGTGDIQLTLSQKVPVSGAVIVTTPQDIALLDAKKGIEMFRKVDIPVLGVVENMSTHTCSNCGHTEAIFGDGGGKEIAELYETELLGKLPLALSIRQQADSGKPSVAAEPEGEYAQIYREVARTLAVRLASKNAKADSVIPSIVVADD

SEQ ID NO: 83456 - protein, 296 aa, Vibrio fischeri
VLRALYESDKRDKVEVVAVNELSQPEAMAHLFQYDSTHGRFQHKVTHDQEYLYIDLPNGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 83457 - protein, 296 aa, Vibrio fischeri
VLRALYESDKRDKVEVVAVNELSQPEAMEHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 83458 - protein, 296 aa, Vibrio fischeri
VLRALYESDKRDKVEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 83459 - protein, 175 aa, Pasteurella multocida subsp. multocida str. Pm70
MGLETVPAGKALPDDIYVVIEIPANSDPIKYEVDKESGALFVDRFMATAMFYPANYGYVNNTLSLDGDPVDVLVPTPYPLQPGSVIRCRPVGVLKMTDEAGSDAKVVAVPHSKLTKEYDHIKDVNDLPALLKAQIQHFFESYKALEAGKWVKVDGWEGVDAARQEILDSFERAKK

SEQ ID NO: 83460 - protein, 299 aa, Colwellia psychrerythraea 34H
MSSRNPIIAVTGSSGAGTSTTTASFEHIFRTLGISSVNVEGDSFHRFSRQEMDMEKRKAKEARKNISYFGDLANDFSALEKQFRDYSETGRGQIRRYLHTFDEAVPYNQMPGTFTPWEEFGEGTDLLYYEGLHGGVVTKDNDVAKHVDLLIGMVPIVNLEWIQKIIRDTNKRGHSREAVTASIVRSMEDYISFITPQFSRTHINFQRVPTVDTSNPFSAKAIPSLDESFVVIRFREVKNVDFQYYLRMIDGSFMSRINTLVVPGGKMGLAMELILTPLIRDLMDRKNQANKQLDWMSDL

SEQ ID NO: 83461 - protein, 224 aa, Listeria innocua Clip11262
MINQKKIAGEKACEWIEDGMVVGLGTGSTVYYTIEKLGEMVQKGLNITGVSTSIETEQQARTLGIPLKSLNDVTKIDVTIDGADEINQAFQGIKGGGGALLREKMVAQASSKNIWVVGEEKLVTELGKFPLPLEVIPFGWKQIKRMLENDGVETTLRKQSSGEIYETNNGNYILDIINQTFTNPEAWHEKLAGIPGVLEHGLFLHYVDIIICGKASGEIEIIKK

SEQ ID NO: 83462 - protein, 591 aa, Oryza sativa Indica Group
MAMSRAAAAAAGTPVARRRLMGAVAARSMASWFGHVEPAAKDPILGVTEAFLADPSPDKVNVGVGAYRDDSGKPVVLECVREAERRIAGSMNMEYLPMGGSIKMIEESLKLAYGENCEFIKDKRIAAVQALSGTGACRLFADFQKRFLPDSQIYIPTPTWANHHNIWRDAQVPQKTFTYYHPESRGLDFAGLMDDIKNAPDGSFFLLHACAHNPTGVDPSEEQWREISHQFKVKKHFPFFDMAYQGFASGDPERDAKAIRIFLEDGHQIGCAQSYAKNMGLYGQRAGCLSILCDDEMQAVAVKSQLQQIARPMYSNPPVHGALIVSTILGDPELKSLWLKEVKGMADRIIGMRTALKENLEKLGSPMSWEHITNQIGMFCYSGMTPEQVDRLTKEFHIYMTRNGRISMAGVTTGNVAYLANAIHEVTKTNLLIQRHARRTLSLSGGTAATVGRCVRGGRVSAAWQHLQRHNSHANVDASRVNGWATHRNGGRVRLLLLQRRFHQTPGANGGAVADGGLVRYRHGTYSKGSFNIKVTLHSLTIHPPSLQLFGLLLAEHWTQWPPQDSTFDCSTAHRTLPCQGSPFSALQEDD

SEQ ID NO: 83463 - protein, 517 aa, Neptuniibacter caesariensis
MIQLLVSKSQSLKSDVLSGLTVALALVPEAVAFAFVAGVEPLVGLYAAFMVGLITAAIGGRPGMISGATGALAVVMVSLVAQHGVEYLFATVVLMGIFQVLAGVFRLGKFIRLVPHPVMLGFVNGLAIVIFLAQMKQFQFSDENGVLQWLQGEQMMLMLGLIALTMAIIHFLPKLTRAIPSSLAAILTVTLLVIGLDLDARTVQDVLADMTGNPAATIAGGLPQFHIPMVPLSVETLKIILPYALILAAIGLIESLLTLTLIDEITETRGRGNKECIGQGVANVATGFFGGMGGCAMIGQSMININSGGFGRASGISAALFLLTFILVGSSFIEMIPVAALVGVMFIVVIGTFEWASLRLWGKIPRSDLIVVVAVTGVTVWQDLAIAVVVGVIISALVFAWKHASNMSFDIRDEYDTKVYVPNGPLFFASVQNFRDHFNPKMDPPEVIVDFKNCRVMDHSGIEAIDALAERYEKAGKELHLRHLSPECRNLLTKAGSVVEVNSSEDPKYKVADDSLA

SEQ ID NO: 83464 - protein, 298 aa, Candidatus Blochmannia floridanus
MINDTSRIHIAFLGPKGSYSHIAAKKYANYHFNKITEYSCQNFSDILHVVENNQVDYGILPIENSNSGLINEVCDLLLTTHLILIGDITIPIQHRILVNNYNSSLKQIQTIYSHPQPIQQCSNFLKKFPHWKIILCESSSIAIKKVAYLNQPNIAALGSTQGGIIYGLHPLLLSPYIISNYPLNSTRFIILKNENLLFTNTTAILEKIMLIISIDTKLNKLYSILKILQFYKIKINFLRLCCSLLPNNTTNSIILEITAHFHHTYTQQALIKIYNIAYSLKILGCYSTIAYQPYQQYT

SEQ ID NO: 83465 - protein, 382 aa, Thermus thermophilus HB27
MRIQVNAKGAARLLSRHLWVFRRDVVSGPETPGLYPVYWGRRFLALALYNPHTDLAVRAYRFAPAEDPVAALLENLAQALARREAVLRQDPGGGYRLVHAEGDLLPGLVVDYYAGHAVVQATAHAWEGLLPQVAEALRPYVQSVLAKNDARTRELEGLPLYVRPLLGEVPERVQVREGRVRYLVDLRAGQKTGAYLDQRENRLYMERFRGERALDVFSYAGGFALHLALGFREVVAVDSSAEALRRAEENARLNGLGNVRVLEANAFDLLRRLEKEGERFDLVVLDPPAFAKGKKDVERAYRAYKEVNLRAIKLLKEGGILATASCSHHMTEPLFYAMVAEAAQDAHRLLRVVEKRGQPFDHPVLLNHPETHYLKFAVFQVL

SEQ ID NO: 83466 - protein, 434 aa, Pseudomonas syringae pv. tomato str. DC3000
MNSKVDETPHLLRQRDQFVPRGIVTAHPLVIDRAQGSELWDVDGKRYLDFVGGIGVLNIGHNHPNVVKAIQAQLSKVTHACFQVASYQPYLDLAKRLSLMIAGQSGIDHKAVFFTSGAEAVENAVKIARARTNRPAIISFRGGFHGRTLLGTTLTGMSQPYKQNFGPMAPEVFHTPYPNEYRGVTTEVALAALHELLATQVAPDRVAAILIEPIQGDGGFLTAPVEFLKALRALTEQHGIVLILDEIQTGFGRTGKWFGFEHAGIQPDLVTVAKSLAGGMPLSGVVGRAEIMDAPLPGGLGGTYGGNALSCAAALAVIDTYEQDNLLARGEQLGEHLRAGLLRLKDRYACIGDVRGTGFMLAMELTKNDAARSPDADLNQKVIDQARIGGLLVIKCGVYRNVLRFLAPLVTTEQQIDEALSILDAALARVLKSS

SEQ ID NO: 83467 - protein, 386 aa, Salmonella typhimurium LT2
MRNNPLIPKSKLPNLGTTIFTQMSALAQKHQAINLSQGFPDFDGPRYLHERLAYHVAQGANQYAPMTGAQALREAIADKTAEIYGYRPDDVSDITVTAGATEALYAAITALVRAGDEVICFDPSYDSYAPAVALSGGVLKRIALTPPHFRVDWQAFSALLSERTRLVILNTPHNPTATVWRQADIEALWQAIGEREIYVLSDEVYEHICFAAEGHASVLAHPQLRERAVAVSSFGKTFHMTGWKIGYCVAPAAISAEIRKVHQYLTFCVNTPAQLALADMLRAAPEHYRALPDFYRKKRDVLVNALAQSRLKVLPCEGTYFLLIDYSAVSTLNDVEFCQWLTEEVGVAAIPLSVFCAAPFPHQLIRLCFAKQESTLLAAAERLCKL

SEQ ID NO: 83468 - protein, 514 aa, Triticum aestivum
MANIDMAAVLADMERDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLAVLSCDPAAGTVRCRCENTAMLGERKNCNLPGIVVDLPTLTEKDKEDILGWGVPNDIDMIALSFVRKGSDLVTVRQLLGQHAKRIKLMSKVENQEGIVNFDDILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNDAVFKEMIKAAPLPMSPLESLASSAVRTANKARATLIVVLTRGGTTAKLVAKYRPRVPILSVVVPVLTTDSFDWTVSSEGPARHSLIYRGLIPLLAEGSAKATDSESTEEILQAALKSAVKKQLCKAGDAVVVLHRIGMASVIKICTVK

SEQ ID NO: 83469 - protein, 471 aa, Candida glabrata CBS 138
MLPRTIDILKKFATFVGPGIMVSVAYMDPGNYSTSVSGGAQYKYKLLFSIFVSNIFAVLLQCLCVKLGTVTGYDLAENCRRNLPKKVNYVLYFFAEIAIIATDLAEVVGTAIALQILFNIPLTLGVILTVLDVLLILMFYRPDGQSMKKVRMFELFVGVLVICTVLCFVLELFKINIPNKRELFEGFMPTSIIFKEKQALYISLGILGATVMPHSLYLGSSLVKPRLYDYDIKKYGKVGSSPSLSAIKYSLNYSYAELIISLFLIATFVNSAILIVAGATLAGQPEAEDADLLSIYNLLVHYISPAAGLIFAAAMLFSGQSAGIICTLAGQIVSEGFLEWSLPPWATRLCTRLIAIIPCLFVTLTLGERGISNILNFSQVVLSLILPIVSAPLIYFTANRSIMTVEDHHLHVADINDVDESTPLNSSAQRKKKDFTNSKLLTGAAVFVWALIGGLNCYLVGSWLNGADVHF

SEQ ID NO: 83470 - protein, 515 aa, Cytophaga hutchinsonii ATCC 33406
MEHLHRKQITNTFTETFPGDLSMNNTTRQTPGVLYCSVLPTPVHHPQLLAWSADVAEMLGLESPVPEDVLILGGNTVNPTMKPYASCYAGHQFGNWAGQLGDGRAISLGFCSGKDSMEYELQLKGAGPTPYSRNSDGRAVLRSSLREYLMSEAMHYLGVPTTRALSLVSTGDAVLRDMFYNGHAAYEPGAVVLRVAPSFIRFGNFEILAERNNRDLSQQLCDWVITRYYPEIRGEDRVVQLFQAVAERTADMVVQWLRVGFVHGVMNTDNMSILGVTIDYGPYSFVDEYDARFTPNTTDLPGRRYAFGNQAAVAYWNLGRLANALAFLVPETDKLVAVLKNYQDVYETKYYTMMANKLGFDALREDDRLLIDSFEEMLRTVKPDMTMFYQLLIDLPADPGTAADVKQFFQSCFYTEADEALLHTCIAAYSKRIKTNTCSKEVSAEKMRAANPRFVLRNYILHEAIEKLEKGDDALLKKLEEYIKQPYSKNADEYFIKRPDWAAQKAGCSMLSCSS

SEQ ID NO: 83471 - protein, 356 aa, Vitis vinifera
  misc_feature (4)..(4): Xaa can be any naturally occurring amino acid
  misc_feature (196)..(196): Xaa can be any naturally occurring amino acid
  misc_feature (355)..(355): Xaa can be any naturally occurring amino acid
MASXQSSSFRAAPIQSVQELIKEPIPAVPQPFILDBPQPPILSASTPLPLLPTIDMKHLIMSETAGSELEKLNSTCKEWGFFQLVNHGVNSSLVEKLKSEIGEFYKLPLEERMKYKMRPGDVEGYGHLPIRSEEQKLDWADRFYMITNPIHTRKPYLLPELPSSLRDSLECYLAELQKLAMMLLGFMAKALKLEKXEMEELFEDGMQSVRMTYYPPCPQPELVMGLTPHSDATGITILLQINGVDGLQIKKDGVWIPVSFLPDALVVNVGDVLEILSNGVYTSIEHRATVNAAKERISIAMFFNPKFSAQIKPAPSLINPQNPPLFKQVGMEKYFKDFFSRKLDGKSYLEHMKIXK

SEQ ID NO: 83472 - protein, 316 aa, Bacteroides fragilis NCTC 9343
MAKIAKKLTELIGHTPLMELSGYSRKYGLQENIVAKLESFNPAGSVKDRVALSMIEDAEERGVLQPGATIIEPTSGNTGVGLAMVATIKGYRLILTMPETMSLERRNLLKALGAQIVLTNGQKGMAGSIAKAEELKKSIPGSVILQQFENPANTEVHARSTGEEIWQDTDGEVAVFVAGVGTGGTVCGVARALKKHNPNVYIVAVEPASSPVLEGGKAASHRIQGIGANFVPGIYDASVVDEVMPVPDDEAIRGGRELASTEGLLVGISSGAAVYAARQLAGRPEFKGKMIVTLLPDTGERYLTTELFAFDAYPLD

SEQ ID NO: 83473 - protein, 399 aa, Colwellia psychrerythraea 34H
MSEFKAFSLLESIIDRVNLKGYKQPTPIQKECIPALINGNDLLGIAQTGTGKTAAFSLPIINKFGRNKIDIKAKSTRSLILTPTRELASQIMQNIDDYSDGLGLKTKVVYGGVGRQAQVDSIELGLDILVATPGRLLDLIETGDINFKALEVFVLDEADTMLDMGFFKDVQSIISKLPKSRQTLLFSATMPAEIEILAEAILTDPTKIQITAETVTIDLVNQSVYHLDKSNKVPLLFNILTKADYEKVLIFCKTKYGADIIVKALEKASITAASLHSGKTQAVREEALQNFKDSTLRVLVATDVAARGIDVDNITLVINYNLPEDPRNYIHRIGRTARAGKSGMAISFAVENDIRQLTNIENSIGQVIPVVTEQPFHKEFSKAPIQDKKKKQVKKTKRK

SEQ ID NO: 83474 - protein, 153 aa, Bacillus thuringiensis serovar konkukian str. 97-27
MVFEGHLVGTGLKVGVVVGRFNEFITSKLLGGALDGLKRHGVEENDIDVAWVPGAFEIPLIAKKMANSGKYDAVITLGTVIRGATTHYDYVCNEVAKGVASLSLQTDIPVIFGVLTTETIEQAIERAGTKAGNKGYESAVAAIEMAHLSKQWA

SEQ ID NO: 83475 - protein, 337 aa, Vitis vinifera
MVGGGSRRDEGSMVINNNNVFAVLESLRKKKKSDKERGSSKSKGSSKAQEKDPEPQVFWAPARLTVKSWADVDDDDDYYATTAPPQSVWGTSEQSQTMEKPTQVEVCGSFYVLLIGQWESESEEDILDEVDDDLEEEHDHEPEVPVQPEPVVKKPVESSLVSKETERQLTKKERKKKELAELEALLADFGVSQKESNGQVESHGVSQEKKEEDKKGELNGDGEKKDNAPTESKNAKKKKKRDKLSSKEVKESHDLPDSSDAANGLEEAAAGEQVEEETPAVDMKERLKKMASGKKKKSTKEMDGAARAAASEAAARSARLAAAKKKEKNHYNQQPVR

SEQ ID NO: 83476 - protein, 443 aa, Zymomonas mobilis
MSESLAAYAGRILGHVSIDEGTPRWIGKLVAYDGLMLEATGFPMPIGHGALIMDANGQSSRAEVVGVPGNTTVLMALDADAPHNPGARVEPDRQLSIVHVGDGLLGRVIGALGEPLDNLGPIITDEYWPLVGKMGNPLNRGRVTSPFDMGVRAINALLTAGVGQRIAIMAGSGVGKSVLMGQMIAGAKADVIVTGLIGERSREVTDFVETKISDDVRPKSVVVAGSADHPPVLRLRAAMRATAIAEYFRAKGKNVLLLNDSLTRIAHAQREVGLSLGEPPTIKGYPPSALGLIPRLVERAGIDIHSKGAITAIYTVLADGDDPDDPIVDTARAIVDGHIILSRSLAEQGVFPAIDLGKSLSRVMSDIISPGHRQAAAHLRRLWSVYEENRDLILMGAYRSGTDASIDEAINRHNDVLDFIRQGQNERFDLATSIATLMERFAV

SEQ ID NO: 83477 - protein, 605 aa, Vitis vinifera
  misc_feature (50)..(50): Xaa can be any naturally occurring amino acid
  misc_feature (72)..(72): Xaa can be any naturally occurring amino acid
  misc_feature (153)..(153): Xaa can be any naturally occurring amino acid
  misc_feature (195)..(195): Xaa can be any naturally occurring amino acid
  misc_feature (397)..(397): Xaa can be any naturally occurring amino acid
MDVKTTLLNGDLEEEIYMDQPEGCVVQGKEKKVGRLSQYTQSPNQDHWTXVRRVLKYLRGTINYGLCFSGFXSVLEGFSDTNWISDSDDMKSTSGYVFIIVESAVSWKSAKQTCITQSTMETKFITLEKTSSEAKPIPSVSMHCDSQTAIVKXKSKIFNGNNKHIRLRHNIVRQLLETWVISLEFVRLELNLVDXLTKPLNKKLVEETSRGMGLMPITKVKNGGNFFHYHTRIGWNSGSRSRVSSVRFIRFRAEFCEGSSVLFVVVGRGKYLGLLKMPVKLQQSSFRDRTPEFLNVAERLKNASKAEEQRFAVAMQSEFNKRASKIGFGIHQTSQKLSKLAKLAKRTSVFDDPTMEIQELTAVIKQDITALNSAVVDLQLLSNSRNESGNISSDTTXHSTTVVDDLKNRLMSATKEFKEVLTMRTENLKVHENRRQLFSTASKDSTNPFVRQRPLATRSAASASASPPPWANGSPSSSQLFPRKQIDGESQPLIQQQQQQQQQQQQQQQLVPLQDSYMQSRAEALQNVESTIHELSSIFNQLATLVSQQGELAIRIDENMDDTLANVEGAQGALLKNNNGDGFETGHPYPNPVSFIQNNFHPLPI

SEQ ID NO: 83478 - protein, 284 aa, Triticum aestivum
MASQMSSAWAAVVVIVSSLLAVALSHDEGGGPSFGYTPGTPDGPENWGKLSPAYKACGDGKAQSPIDIVIANAVPNPNLDTLTRVYAPSNATLHNTGKDIVMSFEQGGEPVMPGSINVTTADGTVKEFKLKMIHWHAPGEHTVNGKRFPLELHMVHVDDQDHKAVIGILYEIGNPDPFYDQLTEKLRELKTTPTVAAGVVELKSLQKRTGSYFRYMGSLTTPPCTENVVWNILGKGRELSQEQLQLITAPLPHQDNRPPQPLNGRSVAFYNPPNSTISIQSLVQ

SEQ ID NO: 83479 - protein, 462 aa, Bacillus thuringiensis serovar konkukian str. 97-27
MTFSKSTTDKPSYTYEELSEKNKAYVWHPFTQMKDYLEEDPVIIERGEGRKLYDVNGNEYWDGVSSIWLNVHGHQVPELDEAIREQLNKIAHSTMLGLANVPSILLAEKIIEVVPEGLKKVFYSDSGSSAVEIAIKMAFQYWQHKGKPKKQRFVTLKEAYHGDTIGAVSVGAIDLFHQVYSSLLFEAIKMPYPYTYRSPYGNDKAEIVKKHLEEMEELLKDKHEEIAAIIVEPLMQGAGGMITMPKGYLRGLRNLCTKYNVLFITDEVATGFGRTGKMFACEHENVTPDILTAGKGLTGGYLPVAITVTTDEIYNAFLGSYEEQKTFFHGHSYTGNPLGCAVAIANLELYEKTNLIEEVARKTEYVATQLEELFACKHVGDIRQCGLMVGIELVKNKETKEAFEWTERVGVQVCKRSRELGMILRPLGNTIVFMPPLASTIDEIDEMLRILYKAISDITEGE

SEQ ID NO: 83480 - protein, 269 aa, Escherichia coli CFT073
MEKKIGFIGCGNMGKAILGGLIASGQVLPGQIWVYTPSPDKVAALHDQFGINAAESAQEVAQIADIIFAAVKPGIMIKVLSEITSSLNKDSLVVSIAAGITLDQLARALGHDRKIIRAMPNTPALVNAGMTSVTPNALVTPEDTADVLNIFRCFGEAEVIAEPMIHPVVGVSGSSPAYVFMFIEAMADAAVLGGMPRAQAYKFAAQAVMGSAKMVLETGEHPGALKDMVCSPGGTTIEAVRVLEEKGFRAAVIEAMTKCMEKSEKLSKS

SEQ ID NO: 83481 - protein, 251 aa, Salmonella enterica subsp. arizonae serovar 62:z4,z23:--
MVEDSQETTHFGFQTVAKEQKADMVAHVFHSVASKYDVMNDLMSFGIHRLWKRFTIDCSGVRRGQTVLDLAGGTGDLTAKFSRMVGETGKVILADINDSMLKMGREKLRNIGVIGNVEYVQANAEALPFPDNTFDCITISFGLRNVTEKEKALRSMFRVLKPGGRLLVLEFSKPIIEPLSKAYDAYSFHILPRIGLMVANDADSYRYLAESIRMHPDQDTLKVMMQDAGFESVDYYNLTAGVVALHRGYKF

SEQ ID NO: 83482 - protein, 296 aa, Vibrio fischeri
VLRALYESDKRDKVEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLRNIVDYTEAPLVSIDFNHDPHSAIVDGSQTRVSNG

SEQ ID NO: 83483 - protein, 286 aa, Kineococcus radiotolerans SRS30216
MPTHIPTTTLNNGVQMPVLGFGVFQVPAEEAERVVTDALAAGYRHLDTAAAYENEAGVGRAIAASGIPREELFVTTKLWIQDAGEQAAPAAFDRSLQRLGLDYLDLYLIHQPYGDYYGSWRAMEELNRTGRARAIGVSNFHPDRLVDLIDHTEVVPAVNQIETHPFFQRGTDHDVMRQRGVQHESWGPLGQGRDDLLTYPLLTELATAHGKTVAQVVLRWLLQRDTVVIPKSSRPQRMAENLDVFDFSLTEQEMTRIASLDTGVSAVFDHRDPASVAAFGTVRFDT

SEQ ID NO: 83484 - protein, 441 aa, Escherichia coli CFT073
MNKYQAVIIGFGKAGKTLAVTLAKAGWRVALIEQSNAMYGGTCINIGCIPTKTLVHDAQQHTDFVRAIQRKNEVVNFLRNKNFHNLADMPNIDVIDGQAEFINNHSLRVHRPGRNLEIHGEKIFINTGAQAVVPPIPGITTTPGVYDSTGLLNLKELPGHLGILGGGYIGVEFASMFANFGSKVTILEAASLFLPREDRDIADNIATILRDQGVDIILNAHVERISHHENQVQVHSEHAQLAVDALLIASGRQPATASLHPENAGIAVNERGAIVVDKQLHTTANNIWAMGDVTGGLQFTYISLDDYRIVRDELLGEGRRSTDDRKNVPYSVFMTPPLSRVGMTEEQARESGADIQVVTLPVAAIPRARVMNDTRGVLKAIVDNKTQRILGASLLCVDSHEMINIVKMVMDAGLPYSILRDQIFTHPSMSESLNDLFSLVK

SEQ ID NO: 83485 - protein, 304 aa, Kineococcus radiotolerans SRS30216
MSHTPSTSTPTPALTLNNGVTMPALGLGVFQSEPEETTDAVEAALATGYRHIDTAAGYGNEREVGEGVRRSGLERSEVFLETKVWVSDYGYEQTLHAFTKSAAKLGVEQIDLLILHQPMPQHFERTRAAYRALERLLTDGAVRAIGVSNFLPHHLTGLLEQAEVVPAVNQVELHPYFTQPDVQAANAAHGILTQAWSPIGGITFYPGWGENRTSALADPTIAAIAAAHGKTPAQVMLRWHLQQGRSAIPKSTKPTRIAENFAVHGFTLDDDELARLDSLDTGRRGGPDPDAVDPSTWDLTIPDA

SEQ ID NO: 83486 - protein, 245 aa, Rubrobacter xylanophilus DSM 9941
MSGARGGRLPAGEERARLVREMFDRIAGRYELLNALMTAGLYRRWNAAAVRASAVRPGDRVIDLACGTGSLTRALARRVGPQGYVLGVDFSPGMLRRARGGPNIEYRIGDATDLGWVETASFDAATIAYGARNIPDLDALFSEMARVVRPGGAVVCLEIARPQGRLFAAFYGLWFDRIVPRLGAAVSGDPGAYSYLPESVREFVAPGVLAGIMERNGLQDVTWRRLAGGIITLHRGIRGFVEGGG

SEQ ID NO: 83487 - protein, 111 aa, Brassica napus
MATSTFSSRGAQTVNTMFVKPLLRKSIHKKSASQDIVRETVKIDGTSVREAEMKTMRGFSIARETSSSSESSWVPHEVTRIYYPKGQEKVMQDVPPPPAGSHAEELVNWFS

SEQ ID NO: 83488 - protein, 296 aa, Vibrio fischeri
VLRALYESDKRDKVEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDEQVIDAYHSDLRRTRAASQSIIPVDTKLHKGIERIFPKFSNKFEAISVRVPTVNVTAMDLSVTINTNVKVNDINQTIVNASRCTLRNIVDYTEAPLVSIDFNHDPHSAIVDGSQTRVSNG

SEQ ID NO: 83489 - protein, 512 aa, Bradyrhizobium japonicum USDA 110
MDKPTPKADVFQANRDRVAPLLKTLRADGIGHMIDGKIVPSISGETFETKSPVDGAVLASVARGNAEDIDRAATAAALAFKSWREMGPAMRKKLLHRVADAIEDNADDIAVLECIDTGQAYRFMAKAAIRAAENFRFFADKCAEARDGQNTPSDEHWNVSTRVPIGPVGVITPWNTPFMLSTWKIAPALAAGCTVVHKPAEWSPATAAILARLVKEAGVPDGVLNTVHGFGEEAGKALTEHPAIKAIGFVGESATGSAIMVQGAPTLKRVHFELGGKNPVIVFDDADLDRALDAVVFMIYSLNGERCTSSSRLLIQQSIAEKFVEKLTARVKALKVGHPLDPSTEIGPLIHERHLAKVCSYFDVARKDGATIAVGGKAYDGPGGGHYVEPTLVTGAHGKMRVAQEEVFGPFLTVLPFKDEADAIEVANDIRYGLTGYVWTNDVGRALRVADALEAGMIWLNSENVRHLPTPFGGMKASGIGRDGGDYSFDFYMETKHVSLARGTHKIQKLGI

SEQ ID NO: 83490 - protein, 382 aa, Arabidopsis thaliana
MYNLPRDLPEEVLCRIPLTSLRPVRSTCKKWSTLSKCGSFAKKHLAQAKVLADAKEFMVVLMMNFRVYLMRVNLQNNVVESSSSSSSSSSSCIKREAKLISLGDEEADISQVFHCDGLLLCISITESKTRLVVWNPYWGHTRLFEPTHQFNKFDSYSYALGYDKSRKSHKILRGITCLDPFKIYDFNSDLWRDLDVTPEWHLWQMLHGVSLKGNAYWFARENYTETMDTDHFFLLCFDFTSETFGPPLPLPFEFAVSEDTMSVSSVREEQLVVLYQPWDYLQLDIWVTSKIEPNAVSWNSKVFLSVSLKQLVSPQFQLTFGSFFIDEEKKVAVVFDKDYDNKRNIAYIFGVDGSFKAVDLGDSDRKCFPLVCSYVPSLVQLN

SEQ ID NO: 83491 - protein, 341 aa, Kineococcus radiotolerans SRS30216
MRAVVMHAPRDVRVEDRPEPRIQKPTDAIIRLAATCICGSDLWPYRGADEVSEPLPMGHEYAGVVEEIGADVHDIEVGDFVVGSFFASDNTCEICRAGYQTSCLHREVLGTGGGAQAERMRVPLADGTLVATPAMPDADLIPSLLAASDVLGTGWFGAVAAEAGPGKTVAVVGDGAVGLSAVLAAKQLGAEKIVLFSRHADRQALGREFGATDVIEERGDEGIAKLKELTGGLGAHSVVEAVGTHESMHQAIGSTRPGGHVGFVGVLHDVAITGEDIFMTHVHLHGGPAPVRRFLPELIDLIWTRRIDPGKVFDLELPLDEAAEGYRAMDERRATKVLLRP

SEQ ID NO: 83492 - protein, 358 aa, Mycobacterium smegmatis str. MC2 155
MAAMETSTAPLDEPAGLTDADGFTPLRVKDVIRETTDAVSLILDVPELIEDRFRYTAGQFVTVKTTIRGEEHRRCYSMSSSPHVGPDLRITVKRDRDGVVSNWINDTAAAGDRLLTAPPDGRFVLTTADRDVVTFAGGSGVTPVFSLVNTTLATTGRRVRMFYANRDADSVIFRDALTRLTDSHSDRLHVHHHLDTRDGVVSARHITEFLGASTVSTAEADFYICGPAPFMDTVERVLLDAGVPAQRVHLERFTVTPADPAVEAESAATEEVTIVLGRTTVTQPYRAGTTLLQTARLAGLKAPSSCEVGTCGTCIGQVVEGSARLLNNDALDDDEIAEGWVVTCQALPTSHTVKVVYE

SEQ ID NO: 83493 - protein, 412 aa, Salmonella typhimurium LT2
MKALTYHGPHHVKVENVPDPGIEQPDDIILRVTATAICGSDLHLYRGKIPQVKHGDIFGHEFMGEVVETGHDVKNIRKGDRVVIPFVIACGDCFFCRLQQYSACENTNDGHGAAMNKKQIPPPAALFGYSHLYGGVPGGQAEYVRVPKGNVGPFKVPPLLSDDKALFLSDILPTAWQAAKNAQIQQGFSVAVFGAGPVGLLTIACARLLGAEQIFVVDHHAWRLRFAEERYGAIPINFDDENDPAEKIIEQTAGHRGVDAVIDAVGFEAKGSLTETVLTNLKLEGSSGKALRQCIAAVRRGGVVSVPGVYAGFIHGFLFGDAFDKGLTFKMGQTHVHAWLGELLPLIEKGLLKPEEIVTHYMPFEEAARGYEIFEKREEECRKVILVPGATSAQAAQKQATGVVNPMPGGVV

SEQ ID NO: 83494 - protein, 379 aa, Triticum aestivum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCRSEESNLCDLLRINVDRGVMIGDGQSRFTIDGKPIFHFVGTSTFSEYTVIHVGCLAKIDPEAPLDKVCLLSCGISTGLGATLNVAKPKKGMTVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFLNERTLRGTFFGNYKPRTGLPGVVDMYMRKELELDKFITHSVPFSQINTAFDLMLKGEGLRCVIRMEE

SEQ ID NO: 83495 - protein, 487 aa, Salmonella typhimurium LT2
MSLSKDNIWKLLAPLVVMGVMLLIPVPDGMPPQAWHYFAVFVAMIVGMILEPIPATAISFIAVTICVIGSNYLLFDASELADPAFKASKQALKWGLAGFSSTTVWLVFGAFIFALGYEVTGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGVQISWLQWFLSFLPVGIILLIVAPWLSYVLYKPEVTHSAEVAAWAGGELKNMGRLSRKEWTLIGLVLLSLGLWVFGGKIINATAVGLLAVSLMLALHVVPWKDITRYNSAWNTLVNLATLVVMANGLTRSGFIDWFANTMSTHLEGFSPDATVIVLVLVFYFAHYLFASLSAHTATMLPVILAVGKGIPGVPMEQLCILLVLSIGIMGCLTPYATGPGVIIYGCGYVKSRDYWRLGAIFGVIYIAMLLLVGWPILAMWN

SEQ ID NO: 83496 - protein, 450 aa, Lactobacillus acidophilus NCFM
MRRGKNLEQKKSGLPTLASTTIWMISLGYLGVQIAFTLETSQMSRIFQTLGADPTKLGWFFILPPLAGLLVQPGIGSLSDRTWIPKIGRRLPYLLIGMVFAVITMIILPNVGSFGLGYGSLEALVFGAVAIAVLDVASNMAMQPFKMMIGDMVNDDQKSYAYGIQSMLSNFGAVIAAFFPFLLTSLGVANTAKKGVVPQSVVISFYVGAAVLVVTSLFTIFRVHEYDPETYARYHGIKESDNKEGGGWIELLKKAPKVFWQVSLVQFFSWISFQYLSTYATGAIAQNVWHTTSASSSGYQIAGNWFGVLTAVQSIAAVIWSYVLAKVPNNHHKLGYGVSLFLGAIGYTSIFLVHSQMMLIVSFILIGISWAGMNTYPLTMVSNALSGKHMGTYLGLFNCSICLPQIVASLLSFIIFPLVGNSMPAMMLITGISGFLAALSVISIKETYVK

SEQ ID NO: 83497 - protein, 201 aa, Legionella pneumophila
MSVLVGRKAPDFTVAAVMGNGEIVDKFNLHEHLKGKYGLVFFYPLDFTFVCPSELIALDHRIEEFKRRNVEVVAVSIDSHFTHNAYRNTPVKNGGIGPVRFALAADMTHSICQSYGVEHPVAGVAFRGAFVIDTNGMVRSQIVNDLPIGRNIDEILRIIDAVQFFEENGEVCPAGWQKGQAGMKASPKGVAEYLSEHSESL

SEQ ID NO: 83498 - protein, 116 aa, Bdellovibrio bacteriovorus HD100
MAVVEITKNNIQEIVESNNMIILDFWATWCAPCRRFAPIFESVAAKHPDVIFGKIDTEAEVELADKFQIKSIPTLMIIKESDIIFSQPGALPEEIFEQIVVKAKEIDMEEVRRENS

SEQ ID NO: 83499 - protein, 196 aa, Oryza sativa Japonica Group
MAKARKQQPQGPFAGGAAAGERSFLGFQYHHHHRGGSVAPAYGDDDDLPDLAEADVWYAPSSEGGADHRGGGGGGGGGGGLEIGGGGWGGGKHKVGGLSRAFADGRQVAASAPVQVPAWPGRYADPDQAAFAEEEKRREEEDDAGDGDGDGWVPPHVYLARRQARSSVVEGVGRTLKGRDASRVRDAVWSRTGFDG

SEQ ID NO: 83500 - protein, 476 aa, Oryza sativa Japonica Group
MPSPMLIPRALLPPPPGCSSGPGHARASPAGGRRSRWTTAAARHPTAAVNSIGFRVFAPFLAWELGFLKLPGNELLMIFLHHIQAIGVLEAVDVSVEKEGLITELRKELRVSDVDHRELLNRVNSDDIIRSIREWRSAGGPQAMLPNNAQPMHDLAPSPTTSGRKRQKTSQSFPALPAPPPVMHSQQLALQGPPSSSTAKKGASSGAKGKKTKPGQKVPGGPSVKAMTSSAGPSGRGPHMNRNFPVGLVSFEPSEALHINPLINRKVMSRWPEDNSFYEATITDYNPETDLYALAYDINTANESWEWVDLKQMGPEDIRWQGDDPGIYQGVRGAPGSGGKKSSSRGGPTPGTGRGRGLPKHVSRKDFPPSQNGVGKRSSDDIDILHTESLIKEVERVFSINNPDPLEVEKAKKVLKEQEQSLIDAIARLAEASDGESDEHNRVRRNAPYAGSQHQANYADAMAVDGGHMLGGADAV

SEQ ID NO: 83501 - protein, 279 aa, Bacillus thuringiensis serovar konkukian str. 97-27
MSIQNISFLGAGSIAEAIIGGLLHANVVKGEQITVSNRSNETRLQELHQKYGVKGTHNKKELLTDTNILFLAMKPKDVAEALIPFKEYIHHNVLIISLLAGVSTHSIKNLLQKDVPIIRAMPNTSAAILKSATAISPSKHATKEHIQTAIALFETIGLVSVVEEEDMHAVTALSGSGPAYIYYVVEAMEEAAKEIGLKEDVAKSLILQTMIGAAEMLKASEKHPSILRKEITSPGGTTEAGIEVLQEHKFQQALISCITQAAQRSHNLGKTLEQLTKEK

SEQ ID NO: 83502 - protein, 400 aa, Zymomonas mobilis subsp. mobilis ZM4
MVHISAALSRIQPSPTIAVTSRVIELKSKGVDIITLGAGEPDFETPEFIKEAAIQAIHDGKTRYTNVDGTAELKEAIVGKFRRDNHLEYRTDQISVGSGGKHVLFNALTATIDQGDEVIIPAPYWVSYPDIVRFCGGTPVFIQATIDQDYKITAEQLEKAITPKTRWFIFNSPSNPTGAAYSADEIKSLAEVLRRHPHVWILSDDIYEHIVFDNFRFATIAEVAPDLFDRTLTANGCSKAYAMTGWRIGFAGGPTPLIKAMAKLQSQSTSNPCSISQAAAVAALNGPQDFLQGWSDDFARRRNLVVDGLNAIEGISCPKPQGAFYVYPGISELIGKKTPSGKVIEKDLDFSSYLIDEAKVAVVHGEAFGLSPAFRISYATSTELLKKALERISDAVARLK

SEQ ID NO: 83503 - protein, 439 aa, Bacillus thuringiensis serovar konkukian str. 97-27
MAVENITMPQLGESVTEGTISKWLVNVGDHVNKYDPLAEVMTDKVNAEVPSSFTGIVKELIAGEGDTLAVGEVVCVIQVEGADEVAATAVEEKTKEEPKAEVATPEKAPKAKQPTDGKPRFSPAVLKLAGEHNVDLDLVEGTGANGRITRKDILKLVESGNIPQAGAVKKEEAVAAVVEARPEAPKAAPVAQKVEAAKPVSVPTMPGDIEIPVTGVRKAIAANMLRSKHEAPHAWMMIEVDVTNLVSYRNSIKGDFKKREGFNLTFFAFFVKAVAQALKEYPQINSMWAGDKIVQKKDINLSIAVATEDELFVPVIKHADEKTIKGIAREITELAGKVRTKSLKADEMQGGTFTINNTGSFGSVQSMGIINYPQAAILQVESIVKRPVIMENGMFGARDMVNLCLSLDHRVLDGLICGKFLGRVKEILENTSENNTSVY

SEQ ID NO: 83504 - protein, 482 aa, Staphylococcus aureus subsp. aureus Mu50
MGSFFNKIARKEDPAIYQNKDGHLKRTLRVRDFLALGVGTIVSTSIFTLPGIVAAEHAGPAVALSFLLAAIVAGLVAFTYAEMAAAMPFAGSAYSWVNVLFGEFFGWVAGWALLAEYFIAVAFVASGFSANLRGLVKPIGIELPAALSNPFGTNGGFIDIIAAIVILLTALLLSRGMSEAARMENILVILKVLAIILFVIVGLTAINVSNYVPFIPEHKVTATGDFGGWQGIYAGVSMIFLAYIGFDSIAANSAEALDPQKTMPRGILGSLSVAIVLFIAVALVLVGMFHYSQYANNAEPVGWALRQSGHGVVAAIVQAISVIGMFTALIGMMLAGSRLLYSFGRDGLLPSWLSHLNDKHLPNRALVILTIIGVLIGSMFPFAFLAQLISAGTLVAFMFVSLAMYRLRKREGKDLPIPAFKLPLYPVLPAITFVLVLLVFWGLGFEAKLYTLIWFIVGIILYLSYGLRHSKKNDVAEYHPPK

SEQ ID NO: 83505 - protein, 236 aa, Zea mays
MSPSPPPSSGCSLAVLVGGTSTAGSSNKFRHAILRNLLLRLSNKDGAASPSWSSAMSLRERRDAVRHAADAALAAARGAAPRWSRALAAELSSQSQSQQHGRWHWHDDDAPHLLVAGADARPSGHQTCLPCGTAAAVAAAGCRKTVPRRRRLRVRARPKSGATTAWSAGAVARVVARRRARAGALRRMVPGGRGMADECTLLGETLDYAVSLRAQVDAMQLLLRTLQPPGHANNNP

SEQ ID NO: 83506 - protein, 457 aa, Staphylococcus aureus subsp. aureus Mu50
MHINTVNGRGMYMSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCELAPGDFEKRVTFGLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALEKICREHGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKKLKTRDASAALKICNYCFEHGVVIIAVAGNVLRFQPPLVITYEQLDTALNTIEDALTALEAGNLDQYDISGQGW

SEQ ID NO: 83507 - protein, 526 aa, Bordetella bronchiseptica RB50
MSDTATAPTTAEPRTAPPARADLLAHYARKTLSAPVYDVALETPLQAAPRLSRQLDCRVLLKREDLQPVFSFKIRGAYNRVAQLSPDERGRGVIAASAGNHAQGLALAAARLGIPALIVMPRTAPELKIDGVLAHGAQVALHGDAFPAALAHAQELAEREGRVFIPPYDDPDVIAGQGTVGMEILRQHPGRLDAIFVPVGGGSLIAGVAAYVKHVRPEIRIIGVEPVDSNCLQAALAAGRRVVLDRVGTFADGVAVAQIGHHNFEICRDHVDEVICVTNDEICAAIKDIYDDTRSITEPAGALAVAGLRKYAERGEAAGRTLVAIDSGANINFDRLRHVAERAALGEQREALIAVTIPERPGSFKAFCAALGPRQITEFNYRYHPGDEAQIFVGVRTHPEHDRRDALLAGLRGQGFAVQDLSDDELAKLHVRHMVGGRANQIDDEQVFRFEFPERPGALFDFLSKLGGRWNITMFHYRNHGSADGRVVAGLQVPADERHLVPQALTRIGYPFRDETANPSYRLFIR

SEQ ID NO: 83508 - protein, 275 aa, Pantoea agglomerans
MWNYSEKVKEHFFNPRNAKVVDDANAIGDVGSLSCGDALRLMLKVDPETEIILDAGFQTFGCGSAIASSSALTELIIGRSLTQAQQVSNQQIADYLDGLPPEKMHCSVMGQEALRAAINNFRGEAPDEDHEEGALICKCFAVDEAQIRRAVLANGLTTLEDVINYTKAGGGCTSCHEKIELCLEEILKEHPVKNPVAAKVRDENWLAVEEVVASLRPHIRADGGDMSLVRVDGQEVTVELSGSCSGCMMTDMTLAWLQQKLVERMGRYIRVVSAA

SEQ ID NO: 83509 - protein, 124 aa, Glycine max
PRSTRVYYQFNSFGTRLSPAKMSTVTRAYLDQRLAAAKRCSREAAMAGAKAAAVATVAAAVPTLASVRMLPWAKAHLNPTGQALIISTVAGMAYFIVADKTILSMARKHSFDDAPDHLKNTSFH

SEQ ID NO: 83510 - protein, 223 aa, Brassica napus
  misc_feature (213)..(213): Xaa can be any naturally occurring amino acid
MVKVFQAADATDLVTELRRSFDDGVTRGYEWRVTQLKKLLLICDNHEPEIVSALHDDLGKPELESSVYEVALLRNSINLAVKQLKDWMAPDKAKTSLTTFPASAEIVYEPLGVVLVISAWNYPFLLSIDPVIGAISAGNAVVLKPSELAPASSSLLAKLLEQYLDSSAVRVVEGAVTETTLLLEQKWDKIFYTGSSRIGRIIMMAAAKHLTPXVVLELEEKSP

SEQ ID NO: 83511 - protein, 227 aa, Thermus thermophilus HB27
MERPLESYKKEAAHAAIAYVQDGMVVGLGTGSTARYAVLELARRLREGELKGVVGVPTSRATEELAKREGIPLVDLPPEGVDLAIDGADEIAPGLALIKGMGGALLREKIVERAAKEFIVIADHTKKVPVLGRGPVPVEIVPFGYRATLKAIADLGGEPELRMDGDEFYFTDGGHLIADCRFGPIGDPLGLHRALLEIPGVVETGLFVGMATRALVAGPFGVEELLP

SEQ ID NO: 83512 - protein, 406 aa, Nocardia farcinica IFM 10152
MSYPKVIVEADGGSRGNPGPAGYGAVVFDADHVAVLAERRESVGIATNNVAEYRGLIAGLEAAAELGARTVDVRMDSKLVVEQMSGRWKVKHAAMIPLADRARRLVAGFDAVTFTWIPRAQNAHADRLANEAMDDAAVVEEVRTARDAGHAPTDLGAHRGAARPGPAATGEGAAALPDSGTPDTRVLPDTPADPAPGWTGATGRPTRLLLLRHGQTELSVQRRYSGRGNPPLTELGREQAARAAKMLAAKGGIAAVITSPLGRARQTAEAAAAALGVDVQTDDGLIETDFGEWEGLTFREAAERDPELHAAWLGDPSVPAPGGESFDQVRARVEAARRDLVALYPGRNLVVVSHVTPIKTLLQLALGVGPSLLYRLHLDLASLSIAEFYPDGGSSVRLVNDTSYLA

SEQ ID NO: 83513 - protein, 372 aa, Oryza sativa Japonica Group
MDAKKPYFIAIIIQVIYTGLFVVTKAAFNHGTNTFIFIFYRQAAASLLLLPLAIILERKNAPPMSIRLFAKLFLYALLGNTISFNLYNTGLKYTSSTVASAAASSVPVLTFFFAVLLRLEVIRLRRLSGVAKVAGVGLCLGGVLVIALYSGPALSPLNHHRAFGGGAESGSSGAATRARWVTGTLLMLLSNVTWSLWIVLMSPLLNEYPCKMLATALQSLLSAAQSLVLAAAAAARNPAARRLRLDAGLLAVAYSAVAVTGVSYYLQAWCIQKKGPVFLAMSSPLSFVFTIFCSSFFLGEVVHLGSVVGGVLMVAGLYSVLWGKSKEHDTLTVAAGQQEEDAAAPPAAESSSSSDNESKHQQGRFASADQQV

SEQ ID NO: 83514 - protein, 177 aa, Candidatus Blochmannia floridanus
MRYSNKQTSNIHELQEKLITVNRVSKTVKGGRVFSFAALTVVGNVNGRVGFGYGKAREVPSAIQKAMEKARHNMIDIPLNPGRTLQHSIIGIYTGARIYMKPASEGTGIIAGGAMRAILEVVGIHNVLAKAYGSTNPINIVRATVNALKNMKSPEMVAEKRGKSLEYILNNYTYNGR

SEQ ID NO: 83515 - protein, 410 aa, Arabidopsis thaliana
MAMSNLPRDLLEEVLSRVPVKSIAAVRSTCKNWNSLTYGQSFTKKLYGKTMATKEKEFLVVMTMDLEVYLMRVNLHGIHKDDNNVKSSIMQKAKLIRLNDDRVRVDDICKVFHCDGLLLCITIGIRLVVCNPYCGQTRCIKTRRDYHITDNYALGHEKMKNSPLRNYKILVFHDKSFLQNSWFEIYNFNSDSWKVLYFTCDWKLPFSQLVVSLKGNTYWFAREMYIHGPRIDLPDFLICFDFTTERFGPRLHLPFHSRCVDTVTLASVREEQLAVLFQDSKTLILEVWITTKIEPNAVSWSSKVFLEVNMSPLTGFQFNRSFGSFFIVEEKNVVVVPIKGGHFKRNLAYIIGKDEYFKEVDLGVPSSYIYFSPHVCSYVPSLVQIKKDAQVMLQHHNVSAEKHHEFCASL

SEQ ID NO: 83516 - protein, 319 aa, Xanthobacter autotrophicus Py2
MILVCGEALIDLLVGAPEGNEMPARAVAGGSPFNVAVGLARLGAPTAFFGGISSDRFGTHLVDVLAREGVDPRFVVRSDSLSTISVVATQADGQPLYSFHGAGAADRMLAPDRLPPVLPDEVRALTFGSYTLVVEPVASTYAALAEREAGRRVISVDPNLRPGVVGDLSRWAETTERFFRTADIVKASDEDIHIAFGGRMGLTDAARRFLDLGAKLVVITRGDKGAVAYSQLGEVSVPGRSVVVRDTVGAGDTFHAALLAGLHRTGRLEGAAIATLDTEAMGELVAYGTAAAAITCSRAGADLPTAAEVEASLTLAMAS

SEQ ID NO: 83517 - protein, 435 aa, Burkholderia sp. 383
MIPVTSKPAGGFALPGLSTAHTDGAARAALEGRRTGVAALLPFVGPAVIASIGYMDPGNFATNIQAGAAYGYRLLWVVLAANTIAMLFQAMSAKLGIVTGRNLAELCRDRFPAPVVWGMWVASEIAAMATDLAEFLGGALAFGLLCHLSLFTGMIATALATCAILALEKRGFRPLEAAIAALVGVIGACYLGELLIAPQDWHAAAFHLVVPQIPDHTALTIAVGIIGATIMPHTLYLHSGLTQDRTAPRDDAERRRLVRFSNREVVVALGLAGFVNLAMVMMASSAFHASAPGLTDIGDAYHTLIPVLGPAAGALFLVALLTSGVSSSVVGTMAGQVVMQGFIHRRMPVWVRRAVTIVPAFAVVAFGCDVTRAMVASQVVLSFVLPLPMVALLMLSARADVMGAYAMRLPLRIVAGAATVVIVGLNAYLVWAAFN

SEQ ID NO: 83518 - protein, 398 aa, Colwellia psychrerythraea 34H
MCSNHGNRGVVYTGPGSVEIQDIAYPKLAIGNRKCEHGVILKVVTTNICGSDQHMVRGRTTAEPGLVLGHEITGMIIEKGSDVEFLDIGDIVSVPFNIACGRCRNCREGNTGICLNVNPGRAGAAFGYVDMGGWVGGQSEYVMVPYADFNLLKFPDKDQALEKIRDLTMLSDIFPTGYHGAVTAGVVPGATVYIAGAGPVGLAAAASSQLLGAACVIVGDMNPERLAQARSFGCETIDLRQDATVPDMIEQILGVPEVDAAVDCVGFEAHSHGCSHHKEQPAIVLNTMMEVTRAGGGIGIPGLYVTGDPGASTEAAKTGQLSMNFGLGWAKSHYFVTGQCPVMKYHRNLMQAILWDKVQIAKAVNVKVISLDGAPEGYNAFDKGAAQKFVIDPHSMVV

SEQ ID NO: 83519 - protein, 322 aa, Picea sitchensis
MKLAGLKTVSNAHGESIWAVTWAPATASRPAKLLSGSLDESVKIWSGDELEEEATNTGHSLGVVAVAAHPTVAIAASTSLDSFVRVFDVDTNVTVSTLESPPSEAWNMRFHPKGDMLAVAGGGSATVKLWDTTSWRTDVSLEVPKGEGTNTKSSEKAGGKFVLAVAWSRDGSRLACSTMDGTIAIFDVPRAKFLYNLEGHYMPVRSLVFSPTDSRILFSASDDKHIHMYDVDNKSLICAMSGHASWVLSIDVSPDGLAVATGSSDRTVRLWDLSMRSSVQTMTNHTDQVWGVAFRPTGSPGSRAGRLASVSDDKSISLYDFT

SEQ ID NO: 83520 - protein, 670 aa, Magnaporthe grisea 70-15
MPPSSAEPPAASAANAARHVSIDEPRRDGRKDPNQNEQSPLLSPQDDEVDSLMARRESAIEDDDDEIDPFETTKSVWYLILLTISIGGLQIAWSVELSNGSPYLLSLGLSKSLMALVWIAGPLSGTLVQPYVGMLSDNCRISWGKRKPFMLVGAAATITSLLFLAWTREIVSGILGLFGAPADSDGVKTTIIVVAVLWVYILDFAINTEAANSMASRITGVGNIVGYVAGFVNLPKIAWWLGKTQFQDLCAIASIALGVTVIITCILIPERDPRLEGPPPRDQPGVLSFFTKIFTSIKRLPPVTKRVCQVQFCAWVGFFPMLFYTSAYIGEIYVQPFLRNNPNMTPKELDELYERATRVGTFALLIYSITSLSTNVFLPFFIQPTYDAAPVVSADAPGEGPSVLANAKNANGSSRSWLDRLVIPGFTLRRAWMFSHILFAFSMGCTVLVESVEAATVLIGLVGITWALTLWAPWSLISSEISRRDAVLRAQQRRRGLTLDQPYDEDETPSSETSSGQLEVERDEQVADQAGIILGIHNMAIAAPQIIATVGSSIIFKFFQKPRGTPGDRSISIVMALGGITVLGAAWLVHRIDDDVAVPADELSGIMEAGASDGILTGGPPRPSLSQRTSFSSTRPSFSRSRNQSTESLSRYSQERAALVRASSFGGAEY

SEQ ID NO: 83521 - protein, 292 aa, Neptuniibacter caesariensis
MKPLFFNLDSDPQLAANLAEQINADTGQLDMRHFPDGESYLRVMNECDGRSVIIFCNLYQPDSKTLRLIFLADTLRSLGATRIGLITPYLAYMRQDKAFNPGECVSSRPFSALLSSHLDWLVTLDPHLHRYNALDEIYTLESTVVHAAPMIAEWISRSIDKPLLIGPDSESEQWVSHVAQLAGAPFQVLTKIRHGDYDVEVSLPEVERWHDHTPVLVDDIISSGRTMLETVRHLQKAQLKKACCIGVHGLFSDSAFNALSSEAEIVTCNSIPHQSNQIEISQALSIAAKELL

SEQ ID NO: 83522 - protein, 280 aa, Bradyrhizobium sp. ORS278
MGRLDGKIAVITGATSGIGLRTAEIFVAEGATVIAAGRRSAEGEALARRLGAACIFRQTDVTVDAQMRALIDVAVERFGRIDCLFNNAGGPAQTGGIERLDADRFDQAMAVLVRSVMLGMKYAAPHMKKQGGGSIINNGSIAGRLAGYSTSVVYSTAKAAVIHLTKCVAMELGESGVRVNSISPGLIATGIFGKALGLSTEAAEKTPETIRNAYATAQPIPRAGLPDDIAHAALFLASDESSFINGHDLVIDGAITGGRNWSQQQQGYAAMRKLLGDAVE

SEQ ID NO: 83523 - protein, 453 aa, Bradyrhizobium sp. ORS278
MVSEPIRLTSPRRNSLTHIPGDEGWPIIGKTFEVLADPKGHVERNARKYGPVYRSHMFGEVNVVLLGPEANELVLFDQAKLFSSAHGWGHILNLLFPRGLMLLDFEEHRMHRKALSVAFKAGPMKSYLSGLDHGIAARIAQWRERPGEMLFYPAIKQLTLDLAATSFLGTEIGPEVDTINRAFIDMVAAAVAPIRKPLPGTQMARGVKGRQRIVAYFSEQIPLRRARSDGDDLFSHLCRATDDEGALLSTQDIVDHMSFLMMAAHDTLTSSLTSFVAQLAANPAWQQKLRAEVYSLGLAKDEPMTSEHLEKMKLTEMAFQETLRLMPPVPSLPRRPVRDFTFKGFKIPAGTGVGVNPMYTHHMPEIWPEPQRFDPLRFTDEAQRGRHRFAWVPFGGGAHMCLGLHFAYMQAKCFARHFLSNVEVSLAPGYQPSWQVWPIPKPRDGLKVQLKAV

SEQ ID NO: 83524 - protein, 74 aa, Triticum aestivum
TPPVSADVLHQWKGFCALIANAYYTKGMAWLPVKTLQLEQMAVTGSSEEPSLVASRMQLVFSTLEVVSPQWPRV

SEQ ID NO: 83525 - protein, 251 aa, Vibrio sp. ANT-300
MRQALVMGNWKLNATKGSVEALINGLVDAAKDNATVEVAVCPPAVFIPQVEALTADTAITYGAQDCDVNTSGAFTGENSAVMLKEFGCKYTLVGHSERRVIHGESSEVVADKFAVTPENGLVPVLCIGETLEQFEAGETKAVVEAQLQAVVTKSGITSLNNAVIGYEPVWAIGTGKTATPEIAQEIPAHIRSWLAEQDAAVANKVQILYGGSVKPANSAELFGQADIDGGLVGGASLDAVEFSKVISGASA

SEQ ID NO: 83526 - protein, 572 aa, Listeria innocua Clip11262
MAKELKGIAASDGIAIAKAYLLVEPDLSYEKTEVTDVESEVKRFESALEVSRTELSTIREKAAKDLGEDKAQIFDAHLLVLNDPELTGPIEESIKNAKTNAETALQETTDMFIGMFESMDNEYMRERAADIKDVRKRVLSHLLGVTIPNPALIDEEVVVVAADLTPSDTAQLNRKFVKGFVTDIGGRTSHSAIMARSLEIPAVVGTKEVTASVAKNDIVIIDGLEGNVIIHPTEEQIAHYEKIKSDFALQQAEWEKLKNEKTVSKDGVHVELAANIGTPNDLEGVISNGGEAVGLYRTEFLYMGRDNFPTEEEQFEAYKAVVSGMDGKSVVVRTLDIGGDKTLPYLELPEEMNPFLGFRAIRLCFANEELFRTQLRALLRASVYGNLKIMFPMIATVNEFRQARDILLDEKAKLKAAGTEVSDSIELGIMIEIPAAAVLADQFAKEVDFFSIGTNDLIQYTMAADRMNERVSYLYQPYNPSILRLVKMVIDASHKEGKWTGMCGEMAGDQTAVPLLLGLGLDEFSMSASSILKSRSLIKRLDQSEMVKLAEEALNKSTAEEVVELVEKYTAE

SEQ ID NO: 83527 - protein, 266 aa, uncultured marine bacterium 442
MAWYTGNALYDTLLLVGFAYALLVFAASFVGTAAYGGRFGLKGKKQGIKLGSRMGWIIMELPGLMVFPVVYFMGTNAYEAVPLFFLAVWMMHYSNRALITPMLMRVQPGTPASFSFNVIIAGWITLFLHGYFNAAYLTEYGDQYTLDWFSDPRFVLGLIVYATGFGLNIHSDHILRNLRSKTPAPNEPRYKIPFGGAFRWVTCPQYLGEILSFTGFAIMTWNLGAVFVLAMTAGNLIPRALYTHRWFRKNFDEYPPERKAIFPKLL

SEQ ID NO: 83528 - protein, 193 aa, Colwellia psychrerythraea 34H
MKTTLYLARHGQTKWNKVQRFQGQLDSNLTQVGKQQSEQLALSLANQQIDLIVSSTLGRAVDSALICQRILNTPIARLNDLTERDLGSWQGQYIAAIKSDENYHEILHQFTEITPPSGESAISCGSRIYQALKELANNHCNKNILVIFHGEALRCFLAKLGHNSTDNAYELFDNACLLPLTYRHDDDSFQLAR

SEQ ID NO: 83529 - protein, 503 aa, Brassica napus
MASNGASPRPVDATDNSLERIKRQLATGSGRNLLQGPLYKRSETLRKWNERWVILDPTTGKMEYKTRRNEPAIKGTILFDDKSTITVSPVNFQGLPKYNGCCIYISTPQKKDYFLCAETPGAARAWVTTLHATQLVLKAHKEAVDSLSGSGSSTLGTVATVVAAANSTALECSKEIQAAMQVSLRNALKITANKPIDGPLDDLTIMKETLRVKDEELQNLARELRSRDSMIKEIADKLSETAEAAVAAASAAHTMDEQRKIVCVELERLSKDSERQQEAAISKLKELEEKTSTLSREKDQLVKERDSALKEAHLWRSELGKARERVVILEGSVVRAEEKARVAEANGEAKAKEASQRETAAWAEKQELLAYVNMLQTQLQRQQLETEQVFEEKTESTNGETSLPMTKETEKDVDKACLSVSKTASMPGENVVRMSEDQVVNAHAQAPVGENEWNDIQATEARVSDVREISAETERDSLDITVVTPESDVPRNDLPPESFHHQP

SEQ ID NO: 83530 - protein, 255 aa, Enterobacter cloacae
MRHPLVMGNWKLNGSRHMVNELVANLRKELAGVTGCAVAIAPPDMYLDLAKHAADGSHIILGAQNVDVNLSGAFTGETSAEMLKDIGAKYIIIGHSERRTYHKESDEFIAKKFAVLKEQGLIPVLCIGETEAENEAGKTEEVCARQIDAVLKTQGAAAFEGAVIAYEPVWAIGTGKSATPAQAQAVHKFIRDHIAKADAKVAEQVIIQYGGSVNASNAAELFTQPDIDGALVGGASLKADAFAVIVKAAEAAKQA

SEQ ID NO: 83531 - protein, 381 aa, Listeria innocua Clip11262
MTKSIRPELRDIEVSGIRTFNTRVTGIPDMIRLTLGEPDFPTPEHVKQAAITAIQENFTNYTPNAGMPELLEAASSYFEEKYDLTYSNKEIIVTVGATEAISVALQTILEPGDEVILPDPIYPGYEPLIKLNKARPVKVDTTESNFKLTPEQLRAHITPKTKALIIPYPSNPTGVSLSKQELRDLAEVLKETGIFVIADEIYSELTYHEEHVSIAPMLRDQTIVINGLSKSHAMIGWRIGFLLAPEKITTEMLKIHQYSVTCASSISQKAALEAITNGKDDAFQMRTEYKTRANFTQDRLEKMGFTVIPPDGAFYFFVKLPDDITENSFDWAVRLAEEAKVAVVPGNAFSEKGDRYFRLSYATSVNNLAEALDRMAQFLAK

SEQ ID NO: 83532 - protein, 409 aa, Bdellovibrio bacteriovorus HD100
MSNLDDIFASVRSQFPALTQKVHGKNLVYLDSGATTLKPQSVVDRIAHFYSYETSNVHRGAHYLGDVATGHFEAARQKVAEFLGARQSEEIIFVRGTTEGVNLVANSWGLSNLKAGDEILITVMEHHGNIVPWQMVAEKVGAKVVAADILDNGELDLEDFKKKLNSRTKMVAFTASSNVLGTNTDMKLLTKLAHEVGAKVLVDGAQIVSQLPVDVSDIDCDFFVFSAHKLFGPFGFGAVYGKKEILDQMPPYQGGGSMISKVTIEKTTFNDVPTRFEAGTPHVEGAVGLHAALTFVENIGLDKIHKYEMDLLNYATGRLLEIPDVKIYGTSQNKGAILSFNLKGAHHSDIGQILDQEGVAVRAGHHCTQPLMARLGVPGTVRASLSVYNNREDIDSMVKAVVKAREMLL

SEQ ID NO: 83533 - protein, 418 aa, Legionella pneumophila str. Paris
MTYDKIKVPAQGEAITVAADHSLHVPDNPIIPFIEGDGIGVDVTPPMIRVVDAAVQKAYGNKRKISWMEVYAGEKATKVYGGDQWLPKETLDAMKKYVVSIKGPLTTPVGGGIRSLNVAIRQDMDLYVCLRPIRYFNGVPSPVREPWKTDMVIFRENSEDIYAGIEWQADTPEAKKVIQFLTKEMGVKKIRFPEHCGIGVKPVSREGTTRLVKAAIQYAIDNDRSTVTLVHKGNIMKFTEGAFKDWGYQVARDSFGAKEYQGGPWMEFKNPKTGKQIIINDVIADAFLQQILLRPEDYSVIATLNLNGDYISDALAAQVGGIGIAPGANISDQMAVFEATHGTAPKYAGQNKVNPGSIILSAEMMLRHMGWYEAADLIIRGMEGAIEAKTVTYDFERGMQGATLVSSSGFADAMIKHM

SEQ ID NO: 83534 - protein, 294 aa, Burkholderia thailandensis E264
MKVTKAVFPVAGLGTRFLPATKASPKEMLPVVDKPLIQYAVEEAINAGITEMIFVTGRSKRAIEDHFDKSFEIESELEARGKEKLLELVRGIKPSHVDCFYVRQPAALGLGHAVLCAEKLVHGEPFAVILADDLLHGDQPVLKQLVDVFNHYHSSVIGVETIERDDSRSYGVVEGREWEEDIIKLSGIIEKPAPEHAPSNLGVVGRYVLMPSIFEHLRKIKPGAGGELQLTDAVQSLLTEEQVLAYRYYGTRFDCGSKLGYLKATIELALQHPEVGREFEAYLRNCLPALAAVA

SEQ ID NO: 83535 - protein, 289 aa, Bdellovibrio bacteriovorus HD100
MDLAIQIDQEIAARTQAVNQFVEKYLSDMELPAGSAISELRKSMLYSATNGGKRFRPVLSLLVGELFGAGKERILPFAAAVEMIHTYSLIHDDLPCMDNDDMRRGKPTNHKVFGEDFALLAGDALLTEAFMLIAENYGDNSFLVGHLTRLLSSAAGIRGMVGGQAIDLRAGDKQMSLEELTHLHRLKTGALIRVAVEGAAVIAGAKPTEIESLKKFGEGLGLAFQVADDVLDHGEKGQDLRSFTGILGLEGTKTYLKDVSASTLAELHKVSADAPLLEYLISFNQNRQV

SEQ ID NO: 83536 - protein, 294 aa, Escherichia vulneris
IVFRAAQKRSDIEIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDTYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDNFVKLV

SEQ ID NO: 83537 - protein, 187 aa, Clostridium thermocellum ATCC 27405
MSLIGTEVKPFTAEAYHNGKFITVTEQDFKGKWSIVVFYPADFTFVCPTELEDLQNNYEKFKALGAEVYSVSTDTHYTHKAWHDTSEAIKKITYVMIGDPSHTLSRNFDVLNEATGLADRGTFIIDPDGVIQYVEVSAENVGRNAEALIDKIKAAQYVRNHPGEVCPAKWKEGGATLKPSIDLVGKI

SEQ ID NO: 83538 - protein, 658 aa, Burkholderia sp. 383
MRCTPARDRLGPAMAGLRASMRVNGDPCNHAGVAWIVGGPFVVACGPAPTVSDTHRLRALAMRCLPGARCANAFANPVTPYSRIPRMQDSNESRASGVRLLKGILPIRRGGAIRDIFAGMSLASMDIPQVLGYARIAGMPAVTGLYTVFLPLIAFACFGASRHLVVAADSATATIFASRLSSMAPAGSAEYVALAGMVALLTAAMLLLARIFKLGFLADFLSRTVLVGFLAGVGVQVSIAMLGDMLGLAVPYPASRSLAQLDYVVTHLVHTNRPTFALAALVVVAILACKRFLPRVPMPMIAVAGSIAASSAFGFAAHGIAVLGPVAGGLPPLRWPSVTWQQFLDLVPVAASCFVMIIAQSAAAARVFAQQYDEEVDTNADILGLAAANAAAAVGGAFVVNGSPTQTAMADGAGVRSQIGHLAFAAVVAVVLLFFSTYLQYLPHAVLAGIVFTIALGLINVRSLAAIRKESPGEFTLALVTALAVVTVGVEHGILLAVALSLMRHVRHSYQPHTMVLEPVEGNGRWQPVPARRGAMTAPGLIVYRFGSDLFFANDHLFTAEVTELVDAAPMPTRWFVVDAGAITDIDYSAARTLADLVKMLQARGIGVLFGRVNRYLRADMDRHRITEIVGASCIFPTLHQALEAAGTTPAPQEPGIV

SEQ ID NO: 83539 - protein, 233 aa, Zea mays
MARIKPKQLLIQSKTKKAPSRISYSTIITWNLIVILVVLSLYATYSHWHQRSAQDFEMELHEAELAVRPEDPKMISRPRYAVMNTAKGPITIEIYKDASADVVDRFINLCKSNHFKGMPFRHIIKNFVIQGGDFDFDGASQEWITKAKASGKNDLSPKHEAFMIGTAKNPNTKGFDLFITTAPIPDLNDKLVVFGRVIKGEDIVQEIEEVDTDEHYQPKAAIGIIDIVLKQEP

SEQ ID NO: 83540 - protein, 689 aa, Picea sitchensis
MEWRPSSSYASSSSPATPGGSRQTPKVILLQHPPPSSTSSLIRPSPSHFAKWLSRIQRMPAMEWLELLLPCTRWIRTYKWREYLQADIMAGVTVGTMLVPQAMSYAKLAGLHPIYGLYSGFVPVFAYAIFGSSRQLAIGPVALVSLLVSNTLSSIVDSTDELYTELAILLALLVGILECVMGILRLGWLIRFISHSVISGFTTSSAIVIALSQAKYFLGYSITRTSKIIPLVKSIVAGADKFSWPPFVMGSIMLAILLTMKQLGKKRKKLRFLRVAGPLTAVILGTVYVKIFHPQSISVVGGIPEGLPSFSVPTCFDYVKRLIPTALLITGVAILESVGIAKALAAKNGYELDSNQELFGLGVANICGSFFSAYPTTGSFSRSAVNHESGAKTGLSGFIMGVIILCALQFLTPLFTDIPQCTLAAIVVSAVMGLIDYEEAIFLWRVDKRDFLLWVATSITTLFLGIEIGVLVGVGASLAFVIHESANPHIAVLGRLPGTTVYRNIKQYSEAYTYKGIVVVRIDAPIYFANISYIKERLQKYEVGFNGTTNSGIEGNKMFYVVIEMAPVTYIDSSAAQALKELYQEYKARNIQMALSNPNREVLSTLAMSGVLELVGKQWYFVRVHDAVQVCLSHMQGNLETLNTGGEEPKQDTVRKRGNTSLSNFFLGKKDAEELDTERQPLIIEIPED

SEQ ID NO: 83541 - protein, 363 aa, Escherichia coli CFT073
MSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDVELTHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 83542 - protein, 328 aa, Deinococcus radiodurans R1
MTQGSALPVLGAGGWGTALAVAAARAGQPARLWARRPDFAARLAEVRENREYLPGVLLPPEVAVTSDLPGAVAGADFALLVVPSVGVPELLAGLPRELGVVLCAKGLAPDGSRLSEYAAGLGFDRVAVLSGPNHAEEIGRGLPAATVVASRDPALAAAVQTALMSPSLRVYTSRDVPGVELGGVLKNVIAVAAGMGDGLHLGDNAKATLLTRGLREMNRYLRSLGAEEETVYGLSGLGDLIATATSPHSRNRAAGEAIARGESPQQGGKVVEGLRTAGLLDAWAAAHGHDLPIVRAVAQVTRGEWSPAEGVRHLMGREAKGETEAGEP

SEQ ID NO: 83543 - protein, 461 aa, Salmonella enterica subsp. arizonae serovar 62:z4,z23:--
MAEKKTELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVGLVALANLAAVRLYGEIEFWFAMIKVTTIIVMIIIGLGVIFFGFGNGGQAIGFGNLTGHGGFFAGGWKGFLTALCIVVASYQGVELIGITAGEAKNPQVTLRSAVGNVLWRILIFYVGAIFVIVTIFPWNEIGSNGSPFVLTFAKIGITAAAGIINFVVLTAALSGCNSGMYSCGRMLYALAKNRQLPAAVAKVSRHGVPVAGVALSILILLVGSCLNYIIPNPQRVFVYVYSASVLPGMVPWFVILISQLRFRQAHKEAIADHPFRSIMFPWANYLTMAFLVCVLIGMYFNEDTRMSLFVGVIFLLVVTLVYKVFCLNRHGTTHKVGE

SEQ ID NO: 83544 - protein, 296 aa, Vibrio fischeri
VLRALYESDKRDKIEVVAVNELSQPEAMAHLFQYDSTHGRFQHKVTHDQEYLYIDLPNGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 83545 - protein, 296 aa, Vibrio fischeri
VLRALYESDKRDKVEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTGVSNG

SEQ ID NO: 83546 - protein, 157 aa, Neptuniibacter caesariensis
MIKVGDKIPSVGISTVLGGDTKTISTDDFFAGKKVVMFALPGAFTPTCSASHLPGYVVKADEIYAHGVDVIACLSVNDSFVMKAWAEVQNADRITMVADGGAELSKAIGLHMETGAFGGTRSQRYAMIVEDGVVTALNVEQPKTFEVSSAETILQLL

SEQ ID NO: 83547 - protein, 216 aa, Glycine max
MAPPIETPTKVSSYQHSPNPRLNERILSSISRKHVAAHPWHDLEIGPEAPKIFNCVVEIGKGSKVKYELDKRTGLIMVDRILYSSVVYPHNYGFIPRTICEDGDPMDVLVIMQEPVLPGCFLRAKAIGLMPMIDQGEKDDKIIAVCADDPEYRHYNDIKELPPHRLAEIRRFFEDYKKNENKEVAVNDFLPASAAYEAIKHSMTLYAEYVVENLRR

SEQ ID NO: 83548 - protein, 403 aa, Cryptococcus neoformans var. neoformans JEC21
MASLETSPLLPSQASGHPSVSKPFDLLGSTRYLLLGSWINVLLICVPLSFTAEALGWSAAARFTTSFLAIVPLAKLLGECTEQLSMKLGQTLGGLLNATFGNAVELIVAIAALRQGKSNLVQRSLLGSVLSNLLLVLGMSFFAAGFFFYESTFQATAAQASSSLMTLACITLILPAAYHASEVDKSSSLVGTLLGKEVSDSSDRSLKGLLVLSRGTSVILLLTYFGYLYFQLRTHSGLFEAENEEAEEMEVAEMDQWSAGTWLLIITVITAFCADILVGSIDETAQQWNIPKRFIGLILLPLVGNAAEHVTSVWMACKGKMELTIGVSVGSSIQIAAGMIPLLVIIAWPLQKDLTLFFANFETIVLFVSVMLVNLLLQDGRSNYMEGVMLMSLYLVIALSYLV

SEQ ID NO: 83549 - protein, 263 aa, Neptuniibacter caesariensis
MKKAGLKFLALSCTGYFLLCAFLYFYQDNLLYFPKDREVANPENTYLLKTDVGNTVVTTEVRNQRKALIYFGGNAEDVSKRLEDFKQTFPNHSLYLLHYRGYGGSDGNPREESIYQDAQALYERVQKDHTEIVLMGRSLGTGIATRLAAEKAIENLILVTPYTSIEDLASERYWGVPVSLLLKDKYLSWQYAQLVKADTAVFLAEQDQVIAPANTLKLLEYFKPGVATLYRFEDKDHRTVATNPKYFELLKELTQAKDLEASR

SEQ ID NO: 83550 - protein, 583 aa, Zea mays
MDQYEVLEQIGKGAFGSALLVRHKVEKKKYVLKKIRLARQTDRTRRSAHQEMQLIATVRNPFIVEYKDSWVEKGCYVCIVIGYCEGGDMAEVIKRANGNHFSEEKLCKWLVQLLMALDYLHANHILHRDVKCSNIFIARDQSIRLGDFGLAKILTSDDLASSVVGTPSYMCPELLADIPYGCCIYEMTALRPAFKAFDMQALISKITKSIVSPLPTRYSGSLLFYSNKNISHNWHMQAAELLKHVHLQPYVLQVQLKSSPSRNMSPIYQALTDKVKKMTFPSDITDSARRVARRNSLGNERTVTFCKPSPERNSISSTRSIKEYTTTQSVKELSVDSSQIDDEVTSKAIRTKTTGILRTPKSTPAKTLTTRNRLDPPKTSYSRTNHSELTSRTPLNKSAVTARRASLPLPTYRAPNSRAASVLDQLDSPDVSVNAPRIDRIAEFPLASSEDPLAPMKKNLSSAPGHDGSCSTPPFINRSITKDKYTVQVLHRGDGDNASDSSGRNATAASSGGSNDSRQQRFDTSSYQQRAEALEGLLEFSAQLLQQERYEELGILLKPFGPEKASPRETAIWLTKSFKETAS

SEQ ID NO: 83551 - protein, 199 aa, Candidatus Blochmannia floridanus
MLVSYRAPDFTAPTILGNGEIVNDFNLFKYIQNKMAMIFFWPMDFTFVCPSELIACDKRYFEFQKRETEIIGISIDSVFVHNAWRKIPINKGGIGSVKYPMVSDIKREIIKDYGIEHTDKGVALRASFLIDKLGIIRHQVVNDLPFGRNFDEMIRMIDALLFNETHGLLCPAQWDQNKVGLHASQDSVEEYLTNHLSQL

SEQ ID NO: 83552 - protein, 540 aa, Prochlorococcus marinus str. AS9601
MSKISSKNIKRLSVPQSPVVLAILDGWGYRKEKSDNAIKSARTPIMDSLWHAYPHTLISASGSDVGLPDGQMGNSEVGHLTIGSGRIIQQELVRISNIVKKNQLSLVNELREMADSLKKNNSTLHITGLCSDGGVHSHIEHLLGLIKWASDNEIKKVAIHIITDGRDTPAKSASKYLNQIESCIKKFNTGEIASICGRYWIMDRNLLWDRTEKAYANLTDPDIQITNISPQDYIDKSYAKNITDEFIEPIRISENYLKDGDSLICFNFRPDRARQIIKALSIKEFSDFERKNYPNLDLVTFTQYDQNFPVKVAFPPESLNNFIGQIVSENGLKQYRTAETEKYPHVTYFFNGGVEIPLPGEERHLIPSPRVATYDLEPEMSAEELTISCSKAIKSGNYSFVVINFANPDMVGHTGNMDATIKAIEKVDKCIGKIVNATGEMGGSILITADHGNAEVMKGPEGEPWTAHTINKVPLILIEGEKRKIPNMGNQINLRDNAGLADIAPTLLQLLNLPIPTEMTGKSLIQEIELKGYNKVVQHV

SEQ ID NO: 83553 - protein, 416 aa, Burkholderia thailandensis E264
MRVEATVTPTAIRAAEWRALPAPPRPRAARSGSRRHRARIRRDPLDAPAPDSGKTARGDDGERPREREIDCASAGAAPVGPMPTGRRPGVGLVGALGRRRLRARTIWQNHGSAAVFLIRTDPGPKRAMPVISELFVYPIKSCAGIATVRAQLLVTGLEYDRNWMVTDPAGAMITQRTHPRLALVRTAIGERELVVNAPGMPELRTPLAATALAGAEPLAATVWRDTVSALDAGAHAARWFSDFLGSPARLARFAPDARRVVGAKWTGAFTSYAQFADGFPILVVGQSSLDDLNARLRRKGASAVPMNRFRPNVVLAGLDAYEEDYVDYLDVQTDNGGVRLSLVKLCTRCPVPTIDQRTGAPDPAWPNEPTDTMSAYRGSQQFGGALTFGKNAIVVNGEGAFLEVGQSADAEIAFRD

SEQ ID NO: 83554 - protein, 544 aa, Bdellovibrio bacteriovorus HD100
MKNFSFANRIQNINKMKSQDFDLVIIGGGINGAGVARDASARGMRVALIEARDFASGTSSKSSKLIHGGIRYLENMEFKLVFEALNERGRLFEMAPHLVHPLRFMIPLYQESRVGMGKMGLGMWLYDALSLFQAPEMHERLDAQASMERMPAIRPNNLLGSYIYSDAYMDDDRLVHETMRSANENGALCVNYVKATGVTFGPDGKIQAVKCEDQHSKEKFTIKARHVISSVGPWTDELGENIFKDWKKILRPTKGIHLTLPKHRLPLTSAVVMGAEKSDRIVFGIPRHEMIIIGTTDTDFKESPENVTTTPEDVKYLLSITDHYFPGANLTAHDIIASYAGVRPLVADGSSSEGKTSREHTILSDDRGITFVAGGKYTTYRLMCEQTVKAALKFFTFEERVTWGKSDTVKPLNPYTSIDAFQQAKVQADLWARETGHSVEDMRLLAERYGMEGEEILNKYSADMTYWQLEAAQAIDSTMCLHMRDFFARRVPLFLADRNHGVKHMEEIGKVFQEKLGWNEARLKEEMHMLTEYMAREVEWKKHF

SEQ ID NO: 83555 - protein, 256 aa, Burkholderia thailandensis E264
MTAPNLFDLSGKIAVVTGGSRGIGAEAAKLLGAFGAHVVVTSRRIDDCRAIANEIVAAGGSAEAAACHIGELDQIDALFAALEDRHGRLDVLVNNAATNPYYGPIVDTDLGAFQKTVDVNIRGYFFMSSRGAKLMGKGGGGSIVNVASVNGVIPGYGQGIYSITKAAVISMTKAFAIECAASGVRCNALLPGLTDTKFASALTQTPDVLKQVLAHVPMRRAAQPTEMAGAVLYLASAASSYTTGTVLNVDGGYLSA

SEQ ID NO: 83556 - protein, 485 aa, Zymomonas mobilis subsp. mobilis ZM4
MTNTVSTMILFGSTGDLSQRMLLPSLYGLDADGLLADDLRIVCTSRSEYDTDGFRDFAEKALDRFVASDRLNDDAKAKFLNKLFYATVDITDPTQFGKLADLCGPVEKGIAIYLSTAPSLFEGAIAGLKQAGLAGPTSRLALEKPLGQDLASSDHINDAVLKVFSEKQVYRIDHYLGKETVQNLLTLRFGNALFEPLWNSKGIDHVQISVAETVGLEGRIGYFDGSGSLRDMVQSHILQLVALVAMEPPAHMEANAVRDEKVKVFRALRPINNDTVFTHTVTGQYGAGVSGGKEVAGYIDELGQPSDTETFVAIKAHVDNWRWQGVPFYIRTGKRLPARRSEIVVQFKPVPHSIFSSSGGILQPNKLRIVLQPDETIQISMMVKEPGLDRNGAHMREVWLDLSLTDVFKDRKRRIAYERLMLDLIEGDATLFVRRDEVEAQWVWIDGIREGWKANSMKPKTYVSGTWGPSTAIALAERDGVTWYD

SEQ ID NO: 83557 - protein, 385 aa, Solanum tuberosum
MGVCLFLIWGSNGVSKIQTFVLVDLFASVGQMGSMGFGVSSPNPSDSRDENGGFKLPYSDLCMKYLSFSEGFKIVGNGEEEGVVKEKKKKGGLKIKLKVSNPSLRRLISGAIAGAISRTAVAPLGTIRTHLMVGSSGHSSTEVFNSIMKTEGWTGLFRGNFVNVIRVAPSKAVELFVYDTVNKNLSSKPGEQSKIPIPASLVAGACAGVSSTLLTYPLELVKTRLTIQRGVYNGLLDAFVKILKEGGPAELYRGLTPSVIGVIPYAATNYFAYDSLRKAYRKIFKEEKIGNIETLLIGSAAGAISSTATFPLEVARKHMQVGAVSGRAVYKNVIHALVSILEQDGIHGLYKGLGPSCMKLVPAAGISFMCYEACKRILIEAENEE

SEQ ID NO: 83558 - protein, 400 aa, Ustilago maydis 521
MLARSASRLGLSIPRWAGTSNVCRPTIFTCHVPSSVRDFHLESKDIPEFLSKAGASIASCVKIESSSNTLPICDQGVAVLISADRDPQSWPADADARTGNFFGPSILSARVSSLAPLDKTYFGRGGLGLLKLRQQKPASISHVAVRSNTSSLAESQLISLVHGLASKEAQNVIAAMWKVFDQYEGLWFSFTLVPAQGDTEVKVVAPYMEFDDFAVRRQPLLKPYFESRPRHTNTARAEDSGLFFVKLSDVDAPTLTQASDGKELPEGNIGCFGYGAGNAMATMDGLNVAGGRPANFLDGGGGANRTNAKLAVETLNRDPAVKAIFINTFGGITRTDIVSQGIIDAVKDDKITKPIVVRMKGTGSEDAAKVLQASGLEFAFHDDFNAAAAHAVRAANQGHL

SEQ ID NO: 83559 - protein, 330 aa, Saccharomyces cerevisiae YJM789
MLDPRILPYYDPAVERKIAVVTGGNTGIGWYTVLHLYLHGFVVYICGRNSHKISKAIQEILAEAKKRCHEDDDGSSPGAGPGPSIQRLGSLHYIHLDLTDLKCVERAALKILKLEDHIDVLVNNAGIMAVPLEMTKDGFEVQLQTNYISHFLFTMRLLPLLRHCRGRIISLSSIGHHLEFMYWKLSKTWDYKPNMLFTWFRYAMSKTALIQCTKMLAIKYPDVLCLSVHPGLVMNTNLFSYWTRLPIVGIFFWLLFQVVGFFFGVSNEQGSLASLKCALDPNLSVEKDNGKYFTTGGKESKSSYVSNNVDEAASTWIWTVHQLRDRGFDI

SEQ ID NO: 83560 - protein, 393 aa, Picea sitchensis
MAASVLKAGVRLGSSQWTGQSLTQNIDSHKQPKAQRVSMPIRAGSYAEELVQTAKTVASPGRGILAIDESNATCGKRLASIGLENNETNRQAYRQLLLTTPGLGEYISGSILFEETLYQSTTDGRKFVDCLREQNIMPGIKVDKGLVPLPGSNNESWCQGLDGLASRSAEYYKQGARFAKWRTVVSIPNGPSDLAVKEAAWGLARYAAISQDNGLVPIVEPEILLDGDHSIDRTLEVAEKVWAEVFFYLAENNVFFEGILLKPSMVTPGAEHKEKATPQQVADYTLKMLKRRVPPAVPGIMFLSGGQYEVEATLNLNAMNQSPNPWHVSFSYARALQNTSLKTWKGLPENIEAAQRALLIRAKANSLAQLGRYSAEGESEESKKGMFVKGYTY

SEQ ID NO: 83561 - protein, 405 aa, Pisum sativum
MASATFSVAKPAIKANGKGFSEFSGLRNSSRHLPFSRKSSDDFHSLVTFQTNAVGSSGGHKKSLVVEAKQLKVAINGFGRIGRNFLRCWHGRKDSPLDVIAINDTGGVKQASHLLKYDSTLGIFDADVKPVGTDGISVDGKVIKVVSDRNPANLPWKELGIDLVIEGTGVFVDREGAGRHITAGAKKVLITAPGKGDIPTYVVGVNADAYTHADDIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNEAFRESAAKELTGILSVCDEPLVSVDFRCTDVSSTVDSSLTMVMGDDLVKVIAWYDNEWGYSQRVVDLADIVANNWK

SEQ ID NO: 83562 - protein, 420 aa, Salmonella enterica subsp. arizonae serovar 62:z4,z23:--
MSFTTISVIGLGYIGLPTAAAFASRQKQVIGVDINQHAVDTINRGEIHIVEPALGNVVRTAVDGGFLRATTTPVEADAYLIAVPTPFKGEHDPDMAYVKAAAKSIAPVLKKGALVILESTSPVGATEQMAGWLAGMRPDLTFPQQAGEQADVNIAYCPERVLPGQVMVELIKNDRVIGGMTPVCSARASALYKIFLEGECVVTNSRTAEMCKLTENSFRDVNIAFANELSLICAEQGINVWELIRLANRHPRVNILQPGPGVGGHCIAVDPWFIVAQNPQQARLIRTAREVNDGKPHWVVDQVKAAVADCLAATDKRASEVKIACFGLAFKPNIDDLRESPAMGIAQSIARWHSGETLVVEPNIRQLPKKLDGLCTLAKLDAALAAADVLVMLVDHDEFKAIPGDAVHQRYVVDTKGVWR

SEQ ID NO: 83563 - protein, 623 aa, Physcomitrella patens subsp. patens
MTVVVVVTMVCVTPSMGAFIVEENSLMVLTPDSLKGTYQSAIGNFGVPQYGGTLSGFVVTPTVNFKACEAFPADHLRSKPGARPNFALVDRGDCYFATKVWHAQEAGAAAVLVADNAQEELITMDSPEDDPAASKYLSNISIPSTLITKDFADKLKKALADKELVTMKLDWRESLPHPDERVEYEFWTNSNDECGSKCDAQVDFVRDFKGFAQLLERGGYTQFTPHYITWYCPQVFIESKQCKAQCINNGRYCAPDPEQDFSKGYDGKQVVTENLRQLCVFKVTNESNPRQPWKWWDYVTDFQIRCPMKQNKYGPECAEEVIKSLSIDVEAVRKCMGNPDADQDNPILKHEQDAQVGSGTRGDVTILPTLIVNQRQYRGKLDKTAVLKAICSGYQETTDPAVCLSDSVETNECLDNNGGCWKSGSLTACKDTFRGRVCQCPLVSGVQFEGDGYTHCEANGLGHCKLGNGGCWEETGADDVRYSACQQENYHSGCHCPEGFQGNGSAGAGDIDECKEKTKCQCPECKCTNTWGSYNCECSGGLLYMQEHDTCISESSAAQSKLGLTVSLIVLAGLSILALGSYVVYKYRLRTYMDSEIRAIMAQYMPLDNQNESIQSHLQDDDV

SEQ ID NO: 83564 - protein, 355 aa, Arabidopsis thaliana
  misc_feature (22)..(22): Xaa can be any naturally occurring amino acid
MGDWAQLAQSVILGLIFSYLLXAKLISIVVTFKEDNLSLTRHPEESQLEIKPEGVDSRRLDSSCGGFGGEADSLVAEQGSSRSDSVAGDDSEEDDDWEGVESTELDEAFSAATLFVTTAAADRLSQKVPSDVQQQLYGLYKIATEGPCTAPQPSALKMTARAKWQAWQKLGAMPPEEAMEKYIEIVTQLYPTWLDGGVKAGSRGGDDAASNSRGTMGPVFSSLVYDEESENELKIDAIHGFAREGEVENLLKSIESGIPVNARDSEGRTPLHWAIDRGHLNIAKVLVDKNADVNAKDNEGQTPLHYAVVCDREAIAEFLVKQNANTAAKDEDGNSPLDLCESDWPWIRDSAKQAD

SEQ ID NO: 83565 - protein, 458 aa, Mesorhizobium loti MAFF303099
MRHQILSNRSGEDLRASDLAHHLHPFTDHTVLAAEGGPRVIKDGDGIYVWETEGRRLLDGMAGLWCVNVGYGRKELGEVARQQMDRLAFYNTFFKTSHEPVINLAERLAAVTPEGIDNFFFGNSGSEANDTAIRLVRSYWAAVERPERQVVISREYAYHGSTLAGASLCGLPGMHGVAGLPIPGIAHAAAPYAWAAGKDQDDPAYGRASADALEAKILEIGPKNVAAFIGEPVMGAGGVITPPPRYWARVQEICRKYDILLVCDEVICGFGRTGEWFGAQSFGIAPDIMCMAKGLSSGYIPISAVGVGTRVAEILRTRPGVLSHGFTSSGHPVAAAVALKNIELIEAEGLVNHVRDVAGPALARRLGALAMHPLVGQVRGIGAMWALELTSDKATRAPFAPLGSVATRVRNLCFERGLATRAVREGLVFAPPLIITEAQVDEMADILTSCLDTAVAEL

SEQ ID NO: 83566 - protein, 296 aa, Vibrio fischeri
VLRALYESDKRDKIEVVAVNELSQPEAMAHLFQYDSTHGRFQHKVTHDQEYLYIDLPDGSQDKVRILHQADLSLLPWQSLEVDLVLDCTGVYGSKSDGEKHITAGAQKVLFSHPGGSDLDNTIIYGVNHDTLLPEHRIVSNGSCTTNCIIPVIKAVDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 83567 - protein, 430 aa, Physcomitrella patens subsp. patens
MAICNISARQIIDSRGNPTVEVDLVTDRCYRSAVPSGASTGIYEALELRDGDKKVFGGKGVLKAVDNINNVLAKKLVGLDTRNQKEIDSVMLELDGSPNKGNLGANAILGLSLSVCRAGAGAKGVPLYRHIQEISGTKELVMPVPALNVINGGSHAGNKLAMQEFMILPVGASSFKEAMQMGCEVYHVLKGIIKKKYGQDACNVGDEGGFAPNIQDNREGLILLVDSIEKAGYTGKVKIGMDVAASEFLTADGKYDLDFKEQPNDGSKVLSGQALGDLYREFVRDFPIVSIEDPYDQDDWSSWTALTSSIDTQIVGDDLLVTNPKKISEAISKQACNALLLKVNQIGSVTESIQAALDSKAAGWGVMVSHRSGETEDTFIADLSVGLASGQIKTGAPCRSERLAKYNQLLRIEEELGNVRYAGQSFRQPL

SEQ ID NO: 83568 - protein, 482 aa, Deinococcus radiodurans R1
MKHFDRATKIVATVGPASRSTEVLGRMIDVGLNVVRLNFSHGDLEDHRQTVQMVRDLAVSKGVTIGILQDLQGPKIRVGRFAEGSVTLNPGQKFVITMDEVEGNAERVGSTYKGLAGDVTPGMTLLLDDGNMSLRVDHVRGNDIQTTVLIGGTLKNNKGINVPEADLTVPALSEKDVQDMEFGASLGVDWVALSFVRSRDDLLLARHYLARFGSRAKLMAKIEKPQAVDRFADILKEVDGVMVARGDLGVEMRPEQVPTIQKRIIRMCREAGKPVITATQMLESMINLPRPTRAEASDVANAIYDGTDAVMLSAESAAGQYPVESVAMMDRIAREAEASELYQLMQRQVVMDTEQAQDAIALAACNIGAKLEAPAIVTFTSTGGAATRISKNRPPLAIVALTPNEITRNQLALSWGVYPMLSEDPEDTDDMVRIANDELKKSGLADVGDRYVITAGVPFGVRGTTNMLRVEKLKAEDLSDRV

SEQ ID NO: 83569 - protein, 296 aa, Vibrio fischeri
VLRALYESDKRDKIEVVAVNELSQPEAMAHLFQYDSTHGRFQHKVTHDQEYLYIDLPDGSQDKVRILHQADLSLLPWQSLEVDLVLDCTGAYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 83570 - protein, 440 aa, Mesorhizobium loti MAFF303099
MSHVFHRSALSVPPMAVAADGHYIIDINGRRYLDASGGAAVSCIGHGDPRVVAAVAEQIARLDYAHSGAFTSPSAEELAAHICAEAGQGMARVYFVGSGSEAVEAAIKMARQCQIERRQPSRHVVISRRLSYHGNTLGALGRSGSETRRAPYAPMLQKRTQIAPCFPYHYAEPGETPEAYGLRAAEALEAEILRLGSENVAAFLAETVVGATSGAVVPATGYFRHIREICDRYGVLLICDEVMCGAHRTGPFLACSDEGVSPDIVTLAKGLGGGYLPIGAVVCRADVHDSFAQGSGAFTHGHTYMAHPVACAAALEVQRVIVDDRLAERVVRQGALLDAALRDRLSQHTYVGDIRGRGLLYAVELVADRETRVSFDPEMRLAARIGAQAKGRGLLVYPGSGTIDGLRGDHVLLAPAYSIDAQRVGEIADILTEAIDAALG

SEQ ID NO: 83571 - protein, 422 aa, Deinococcus radiodurans R1 [sequence omitted]

SEQ ID NO: 83572 - protein, 296 aa, Vibrio fischeri
VLRALYESNKRDKIEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 83573 - protein, 524 aa, Physcomitrella patens subsp. patens
MAARTAAAAAAALAVPSTSVRLSSGRAPRDSFRSGGCAQVGSRSSSLRGAGVVCPSNVTKITQRTRKVVVSPRNVSDSPVVGETCLDPDASRSVLGIILGGGAGSRLYPLTKKRAKPAVPLGANYRLIDIPVSNCINSNINKIYVLTQFNSASLNRHLSRAYASNMGGYKNEGFVEVLAAQQSPENPNWFQGTADAVRQYLWLFEEAQVLEYVILAGDHLYRMDYQHFIQIHRETNADITVAALPMDEARATAFGLMKINDQGRIIEFAEKPKGDELRAMQVDTTVLGLDAERAKEMPYIASMGIYVVSKEAMISLLRNDFPEANDFGSEVIPGATKMGMKVQAYLYDGYWEDIGTIEAFYNANLGITKKPVPDFSFYDRSSPIYTQARFLPPSKMLDADVTDSVIGEGCVIKNARIFHSVVGLRSWVSEGAVIEDALLMGADYYETDKQRNELLATGGIPMGIGKNSVVKRAIIDKNARIGENVKIVNKDSVQEAARETDGYFIKSGIVTIIKDAIIPHGSII

SEQ ID NO: 83574 - protein, 490 aa, Clostridium saccharobutylicum
MGKPTGFLEYDREVGRNREPKERLKDYKEFHQRLPLEKQCIQGARCMDCGVPFCQAGVLFSGMVSGCPLHNLIPEWNDLVYRGKWELAYERLNKTNPFPEFTGRVCPAPCEAGCTAGLNGPAITIKENERSIIDNAFENGFVKANTPLKRTGKKVAVIGSGPSGLAVANTLNKCGHKVTVFERSDRPGGLLMYGIPNMKLDKEVILRRVHLMAEEGIKFVNNANVGDNYDAKEILDEFDAVVLATGASQPRDLQAEGRDNVNGIHFAVDFLKANTKSLLDSDHEDNNYISAKDKNVIIIGGGDTGTDCVATSLRHGCKSVVQFEIMGEPAHERTESNPMPEWPKVLKVDYGQEEFIELYGKDPREYLTTVTAVHSDKDGNLESVDTVKVEWKKGDNGRMFPAHVEGSEKNWPAELILLAMGFTGSEDYLKNAFGIESDERSNVKAGNVDFMTNVPKVFATGDARRGQSLVVTAISEGIAAGIAVDKFLRA

SEQ ID NO: 83575 - protein, 282 aa, Legionella pneumophila str. Paris
MNVVIITGAASGIGHALSQVCLSNGKTIVMVDKNQDKLHTEAQSFMTKFSPEHVICFACDVTQPSEVERLAEYSCKQLGQVDWIFNNAGIIGNLLPAWELQENDINQVMQVNLHGMLNIIRSFMPYLFKQNFRSHIINMASLYALCTGSQMAAYSMSKHAVLALSESLYFDLNRLKKPVDVSVVFPSFTDTSLLASSGKLNHSPIHNQLNNLLAHSRPAIEVAEHIVREVEQKRFYILPDKEVKGYCEDRTKAILLQENPHRNSVEQLMCSLLKRQSSEANL

SEQ ID NO: 83576 - protein, 480 aa, Glycine max
MSTQNRRSSFSSSTTSSLAKRHVSASTTSSSLAAPANMAKKRPPLSNLTNTVAHRNSSSLVPCAAKFAKTKKEVVPACSGNKRPTLANVKPTSAAIFPKANSFPVRDEAPPPVATVTVPAPVVDVSPSKSDAMSVSMDESMSSCDSFKSPDIEYVDNIDVAAVDSIERKTFSNLNISDSTEGNICSRDILVELEKGENFVNVDNNYADPQLCATFACDIYKHLRASEAKKRPSTDFMERIQKEINPSMRAILIDWLVEVAEEYRLVPDTLYLTVNYIDRYLSGNVMNRQRLQLLGVASMMIASKYEEICAPQVEEFCYITDNTYFKEEVLQMESAVLNFLKFEMTAPTVKCFLRRFVRAAQGVDEVPSLQLECLTNYIAELSLMEYSMLGYAPSLIAASAIFLAKFILFPSKKPWTSTLQHYTLYKPSDLCVCVRDLHRLCCNSPNSNLPAIREKYSQHKYKYVAKKYCPPSIPPEFFQN

SEQ ID NO: 83577 - protein, 240 aa, Ustilago maydis 521
MTESRMKWVPLESNPELFSSWCSSMGLDTSKYAFHDIYGTDAELLAMVPQPVAAVLLLFPITPSMEQLRQAENATAQPSPSDSDILWFKQTIGNACGTIGLLHALANSSASTAIKPGSPLDTLFEKARATQDAHERADILVNSKELQTVHEATASQGQSQAPEDLDNVILHFVCFVRSKNGELVELDGSGGRKGPINRGKKVASQQDLLPVAVDYVKDNYMALNPEEVNFNLIALAPSFD

SEQ ID NO: 83578 - protein, 447 aa, Zea mays
TVDSVYELLGLLLRWSTTCAHCTVPRQAVLCFIEFFLQGRFIFGPDVRSLFLTIFLILAPVVVFCIFVARHLINDFPDHWGVSVMVIVIVFTIYDLTLLLLTSGRDPGIVPRNTHPPEPEAIDMNNDAGNGQTPQQLRLPRTKDVIVNGTIVKVKYCDTCMLYRPPRCSHCSICNNCVERFDHHCPWVGQCIGLRNYRFFYMFVFSTTLLCLYVFGFCFVYIVKIKDAEQSTFWKAMLKTPASIVLIIYCFICVWFVGGLSVFHFYLMSTNQTTYENFRYRYDRRDNPYNRGTVNNFMEIFCTSVAPSKNNFRARVPAEQGLQQARAPARGFMSPNMGKPIGELELGRKPISWDEPRSAADIRDLEVGLGSLLDEKEGRVAHASPDLSREALPELVEGRAGTHSRRSSWGHRSGTSASMDSLAAQMGTAESQWGSISSVHGTTSGAH

SEQ ID NO: 83579 - protein, 565 aa, Aspergillus nidulans FGSC A4
MAFQFSNNPESNETTNNPAPHVLGLPRPPSVGGISSRVTDMSEDGDQSQTNTMSSHVPHRHSVSRRGPPPARSSIASTSQITNRPGSSASRLSRTHIPSLAASGFFRPMSSQRLQAHRGRPATNHTVSTEDWGDQMNQNRRSLISNSTFPNSLSAADQEVPPSRGTEFTDPIIPDRIHSNASPTANTTTVRSESANLIRDRERPPHLNLKVDYKGTNENETPERSPLSFLSLQNRNAPADNRDSRAHARLSSADSSPQSIEKKPELAKSRNKGRNYEYFPSRGPWLWHNISPAIPVLFAYVFYLCFSSFIHASVVDPGVIPRNLHQMPPVDPSQDPLAIGPPTNDWVMVKLATSDVAAMDVPVKYCKTCSIWRPPRCYHCRVCDNCIETLDHHCVWLNNCVGRRNYRYFFAFVSTSTLLALFLLGASLAHILVYRSREGISFSDAIDKWRVPFAMVIYGALAAPYPASLWAYHLFLVGRGETTREYLNSHKFAKADRHRPFTQGNVIRNWIAVFGRPRPPTYMQFKEYYQEGDQRLSTVKRRFLPRNTEPQNDIEMQHVPPPNSA

SEQ ID NO: 83580 - protein, 392 aa, Nicotiana tabacum
NSSLQVSNKGFSEFSGLRTSSAIPFGRKTNDDLLSVVAFQTSVIGGGNSKRGVVEAKLKVAINGFGRIGRNFLRCWHGRKDSPLDVIAINDTGGVKQASHLLKYDSTLGIFDADVKPVGTDGISVDGKVIQVVSDRNPVNLPWGDLGIDLVIEGTGVFVDREGAGKHIQAGAKKVLITAPGKGDIPTYVVGVNADLYNPDEPIISNASCTTNCLAPFVKVLDQKFGIIKGTMTTTHSYTGDQRLLDASHRDLRRARAAALNIVPTSTGAAKAVALSSQALRGSSMALPLRVPTPNVSVVDLVVQVSKKTFAEEVNAAFREAADKELKGILDVCDEPLVSVDFRCSDVSSTVDASLTMVMGDDMVKVIAWYDNEWGYSQRVVDLADIVANQWK

SEQ ID NO: 83581 - protein, 451 aa, Pisum sativum
MATHAALASTRIPTNTRFPSKTSHSFPSQCASKRLEVGEFSGLKSTSCISYVHSARDSSFYDVVAAQLTSKANGSTAVKGVTVAKLKVAINGFGRIGRNFLRCWHGRKDSPLEVIVVNDSGGVKNASHLLKYDSMLGTFKAEVKILNNETITVDGKPIKVVSSRDPLKLPWAELGIDIVIEGTGVFVDGPGAGKHIQAGAKKVIITAPAKGADIPTYVIGVNEQDYGHEVADIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVVNVAKKGISAEDVNAAFRKAAEGPLKGILDVCDVPLVSVDFRCSDVSTTIDSSLTMVMGDDMVKVVAWYDNEWGYSQRVVDLAHLVANKWPGTPKVGSGDPLEDFCETNPADEECKVYE

SEQ ID NO: 83582 - protein, 310 aa, Halobacterium salinarum
MDLDHIITSKQLSRADIETVLDRAAEIDADPSAFADRYENTVLGLLFFEPSTRTKMSFDTAMKRLGGDIVDMGSVDSSSVKKGETLADTVRVIEGYADALVLRHPNQGAAQMASEFVDVPLLNAGDGAGHHPTQTLLDLYTIRENAGLEDLTIGIMGDLKYGRTVHSLSRALTNFDVDQHFISPESLQLPRDVVYDLEQESGTRVREHDSFEDVLPELDILYVTRIQRERFPDENEYQKVAGEYQLTATHLEAAKDDLTIMHPLPRVDEIAPEIDDTDHAAYFEQAHNGVPVRMALLDLVLSADGGVDDE

SEQ ID NO: 83583 - protein, 451 aa, Spinacia oleracea
MASHAALAPSRIPASTRLASKASQQYSFLTQCSFKRLDVADFSGLRSSNSVTFTREASFHDVIAAQLTTKPTGAAPVRGETVAKLKVAINGFGRIGRNFLRCWHGRKDSPLDVVVVNDSGGVKSATHLLKYDSILGTFKADVKIIDNETFSIDGKPIKVVSNRDPLKLPWAELGIDIVIEGTGVFVDGPGAGKHIQAGAKKVIITAPAKGSDIPTYVVGVNEKDYGHDVANIISNASCTTNCLAPFVKVLDEELGIVKGTMTTTHSYTGDQRLLDASHRDLRRARAAALNIVPTSTGAAKAVSLVLPQLKGKLNGIALRVPTPNVSVVDLVVNIEKVGVTAEDVNNAFRKAAAGPLKGVLDVCDIPLVSVDFRCSDFSSTIDSSLTMVMGGDMVKVVAWYDNEWGYSQRVVDLADLVANKWPGLEGSVASGDPLEDFCKDNPADEECKLYE

SEQ ID NO: 83584 - protein, 438 aa, Nicotiana tabacum
CLSKKFEVAEFAGLRSSGCVTFSNKESSFFDVVSAQLTPKTTRSTPVKGETVAKLKVAINGFGRIGRNFLRCWHGRKDSPLDVVVVNDSGGVKNASHLLKYDSMLGTFKADVKIVDNETISVDGKHIKVVSSRDPLKLPWAELGIDIVIEGTGVFVDGPGAGKHIQAGAKKVIITAPAKGADIPTYVVGVNEQDYSHEVADIISNASCTTNCLAPFVKVMDEELGIVKGTMTTTHSYTGDQRLLDASHRDLRRARAAALNIVPTSTGAAKAVSLVLPQLKGKLNGIALRVPTPNVSVVDLVVNVAKKGITAEDVNAAFRKAADGPLKGVLAVCDEPLVSVDFRCSDVSSTIDSSLTMVMGDDMVKVVAWYDNEWGYSQRVVDLAHLVANNWPGSCSTRKWRSHWMSFARQILLMRNAKSMNNRFCYVSSFEMDDFRSQ

SEQ ID NO: 83585 - protein, 337 aa, Antirrhinum majus
MAPIKIGINGFGRIGRLVARVALQRDDVELVAVNDPFISTDYMTYMFKYDSVHGAWKHHELKVKDEKTLLFGEKPVVVFGRRNPEEIPRASTGAEYIVESTGVFTDKDKAAAHLKGGAKKVIISAPSKDAPMFVVGVNEKEYKSDLHIVSNASCTTNCLAPLAKVINDRFGIVEGLMTTVHSITATQKTVDGPSAKDWRGGRAASFNIIPSSTGAAKAVGKVLPQLNGKLTGMSFRVPTVDVSVVDLTVRLEKKATYEQIKAAIKEESEGKLKGILGYTEDDVVSTDFVGDSRSSIFDAKAGIALNDNFVKLVSWYDNEWGYSTRVVDLIVHMASVQ

SEQ ID NO: 83586 - protein, 490 aa, Oryza sativa Japonica Group
MERALDSLTYKGSIPDAILQSRRDNKLFVVYISDPQKAIPSISVIGQNGVMLWCHEGYISSKDLKENIEKAWATLHLQGTAAAFLTASLASRMTEPVNTTPTTLPTQGGSSAAENPSTSSNQSTGTSGASGFANPTDSVAQPPRSTSRDETPSISEKESSNLDSSPGNRTVQERPDSDSAQVKGSLPDHPRSSNIEGCANPVQSGNTASLKQKNKVDDGFTKVSSESVPTRVASRGKSSKVAVDQDKATTTSTPIEPAPVRSNDIQLVVRIPDGPSLQIKLTKDDNLRKVKNFVDENRANGAGSYDLAMLYPRKVFTEQDMEATLHELGIETRQALTIVPHHKTIRAAKRQSSSSPHEGDNNMDADSSGGSGYFGYLRTALSFVNPLSYLRANAAPSNPDQLANQGSPQYRPSTGPWNRPGEDTASESRIPDSARQQAARDTSSGSTLRRRPRQFGGNVHSLRSDDQGPSDDRNVYWNGNSTEFGGEDKK

SEQ ID NO: 83587 - protein, 305 aa, Hordeum vulgare
VNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCPAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYEQIKAAIKEESEGNLKGILGYVDEDLVSTDFQGDSRSSIFDAKAGIALNDNFVKLVSWYDNEWGYSTRVVDLIRHMHSTK

SEQ ID NO: 83588 - protein, 336 aa, Saccharomyces cerevisiae YJM789
MSLQHEKVTIAPLVLLSALDHYERTQTKENKRCVGVILGDANSSTIRVTNSFALPFEEDEKNPDVWFLDHNYIENMNEMCKKINAKEKLIGWYHSGPKLRASDLKINELFKKYTQNNPLLLIVDVKQQGVGLPTDAYVAIEQVKDDGTSTEKTFLHLPCTIEAEEAEEIGVEHLLRDVRDQAAGGLSIRLTNQLKSLKGLQSKLKDVVEYLDKVINKELPINHTILGKLQDVFNLLPNLGTPDDDEIDVENHDRINISNNLQKALTVKTNDELMIIYISNLVRSIIAFDDLIENKIQNKKIQEQRVKDKQSKVSDDSESGDKEATAPLIQQKNKKN

SEQ ID NO: 83589 - protein, 205 aa, Bradyrhizobium sp. ORS278
MRDTMQLVPMVIEQSSRGERSFDIYSRLLRERIVFLNGEVNDTVSALVCAQLLFLEAENPKRPIHLYINSPGGVVTSGLAMYDTMQFVKAPVHTLCMGTARSMGSFLLMAGEPGERTALPNASLHVHQPLGGFQGQASDIMIHAREMEQTKRRMIRLYAEHCGRSYEDVERTLDRDHFMTADEAQDWGLIDRVVKQRDLKSLSSD

SEQ ID NO: 83590 - protein, 341 aa, Magnolia quinquepeta
MGGKKIKIGINGFGRIGRLVARVALQRDDVELVAVNDPFITTDYMTYMFKYDSVHGQWKHHELKVKDSKTLLFGEKPVTVFGVRNPEEIPWGETGAEFVVESTGVFTDKDKAAAHLKGGAKKVIISAPSKDAPMFVVGVNEHEYKSNIDIVSNASCTTNCLAPLAKVINDKFGIVEGLMTTVHSITATQKTVDGPSSKDWRGGRAAGFNIIPSSTGAAKAVGKVLPALNGKLTGMAFRVPTVDVSVVDLTVRLEKAASYEEIKAVIKAESEGKLKGILGYTEEDVVSTDFIGDNRSSIFDAKAGIALNEHFVKLVSWYDNEWGYSSRVIDLILIVHMASCQ

SEQ ID NO: 83591 - protein, 280 aa, Magnaporthe grisea 70-15
MASKASRWAVSQEDVAKAKQEREAKRRAKAAKAAARKAQEDTVAQSQLQSQPPAAENGPPAKRRRVTPAPDAAQNDDDDDGGRGTTNEHRLLRLPGPPFGKCRSVENYDKLNDIEEGAYGWVARAKELATGKIVALKRLKIDPKDRSGLPVTGLREIQILKDCSHRNVVEMHEVVVGDDTSKFENIFLVLEFLEHDLKSVLEDMPEPFLSSEVKTVLLQLAAGVDYLHENFILHRDLKTSNLLLNNRGQLKIADFGMARYSPCGIVHQSFCLGRSSTARR

SEQ ID NO: 83592 - protein, 410 aa, Picea sitchensis
MASATLSMAAVANCSSTHASLQASGKGFSEYSGLKSSIGFPSLRKYNEDLVSVVAFQTNAVGSSGQKRGVVEAKIKVAINGFGRIGRNFLRCWHGRKDSPLDVVVINDTGGVKQASHLLKYDSILGTFDTEVKIAGTDGISVGGKVIKVVSSRNPQNLPWKDYEIDLVIEGTGVFVDREGAGKHIQAGAKKVLITAPGKGDIPTYVVGVNEGKYSPTDDIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVEKKTFAEEVNAAFRESADKELNGILAVCDEPLVSIDFRCSDVSSTVDSSLTMVMGDDMVKVVAWYDNEWGYSQRVVDLADIVANNWKS

SEQ ID NO: 83593 - protein, 524 aa, Zea mays
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYITVRFLIGFSLATFVSCQYWMSTMFSSKIIGTVNGLAAGWGNMGGGATQLIMPLVYDVIRKCGATPFTAWRLAYFVPGLMHVVMGVLVLTLGQDLPDGNLRSLQKKGNVNKDSFSKVMWYAVINYRTWIFVLLYGYCMGVELTIDNVIAEYMYDRFDLDLRVAGTIAACFGMANIVARPMGGIMSDMGARYWGMRARLWNIWILQTAGGAFCLWLGRASTLPVSVVAMVLFSFCAQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 83594 - protein, 373 aa, Oryza sativa Japonica Group
MVKASMKPYFVAIIVQLIYTGMFVISKAAFNHGMNTYIFIFYRQAVGSLILLPAALLQRKSARQVMTLGVLIKLFFCALIGITLGVNLYHVSLKFTSATVASAVDSSLPAITFFLAVLLRTEYVKLRSSSGIAKVTSVALCLAGVFTIAFFTGPSISPINHHRAFASDAGSKNVVPRGVWIKWTFLMVIANMCWSLWIIFQAAVQKEYPDKMIVTLTQCLFSTVQSFVVAVVAERDFSKWKLRFDISLLAILYSGVMVTGVSYYLQTWCLEMRGPMFFASWTPLCFVFTIFCSSFFLGEIVHLGSILGGILLVGSLYTMLWGKSKEGNETDDVTDDDIEKSTHIYPREQQHTTTDQDKESTLTGSAALHVQEL

SEQ ID NO: 83595 - protein, 515 aa, Salmonella enterica subsp. arizonae serovar 62:z4,z23:--
MMAESQPLSAAPEGAEYLRAVLRAPVYEAAQVTPLQKMEKLSSRLDNVILVKREDRQPVHSFKLRGAYAMMAGLTEEQKAHGVITASAGNHAQGVAFSSARLGVKSLIVMPKATADIKVDAVRGFGGEVLLHGANFDEAKAKAIELAQQQGFIWVPPFDHPMVIAGQGTLALELLQQDSHLDRVFVPVGGGGLAAGVAVLIKQLMPQIKVIAVEAEDSACLKAALEAGHPVDLPRVGLFAEGVAVKRIGDETFRLCQEYLDDIVTVDSDAICAAMKDLFEDVRAVAEPSGALALAGMKKYIAQHNIHGERLAHVLSGANVNFHGLRYVSERCELGEQREALLAVTIPEEKGSFLKFCQLLGGRMVTEFNYRFADAKNACIFVGVRVSQGLEERKEILTQLRDGGYSVVDLSDDEMAKLHVRYMVGGRPSKPLQERLFSFEFPESPGALLKFLHTLGTHWNISLFHYRSHGTDYGRVLAAFELGDHEPDFETRLHELGYECHDESNNPAFRFFLAG

SEQ ID NO: 83596 - protein, 296 aa, Vibrio fischeri
VLRALYESDKRDKIEVVAVNELSQPEAMAHLFQYDSTHGRFQHKVTHDQEYLYIDLPDGSQDKVRILHQADLSLLPWQSLEVDLVLDCTGVYGSKSDGEKHIIAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 83597 - protein, 398 aa, Solibacter usitatus Ellin6076
MATTYFACFHAELCAALLLVGRPSKSLQPSPDSYHESMISAPGRVNLIGEHIDYHGLPVLPMALRRSIRVQFQLRGDRRIHAVSEPFGERTFEWTPALTPVARGDWENYLRAAAQAIAGQWGVLNGIDAAIESDLPPAAGLSSSSALIVAVTLALLRANRIAAGFEELMRILPDGEQFVGTRGGGMDHAASLASRAGCASLIEFTPLTVHHIPIPPEWAFLVAHSLHTAEKSGAIRERYNAVRAAGAAALSETGFPSYTAAIDACDERELARIAEPLEPLMRDTFLHVVTEAHRVRAAVCALRENQPARFGQILLEGHSSLRDRLCVSCPALDRLVDSAMDSGAIGARLTGAGFGGCAVIFCPRADLAKVREGLIERFYSGAAGHIYEAEPGPGAVNS

SEQ ID NO: 83598 - protein, 220 aa, Zea mays
  misc_feature (61)..(61): Xaa can be any naturally occurring amino acid
  misc_feature (84)..(84): Xaa can be any naturally occurring amino acid
  misc_feature (103)..(103): Xaa can be any naturally occurring amino acid
  misc_feature (122)..(122): Xaa can be any naturally occurring amino acid
  misc_feature (127)..(127): Xaa can be any naturally occurring amino acid
  misc_feature (147)..(147): Xaa can be any naturally occurring amino acid
RTTSHPLDSDVFGAAVVDSSASDGSPAYTSFPQWGAEYVNQEITAERYAVPIRHVSGGYSXPSPFSPEIDTSGGDGSILPPTSXKGRDEGILLHQRRRKNAMXIANKDVTRDCSYDDLIIAXADEFXKDFFEKRIHNCASNMANNRXRENIVVPRQERFHDRSNYWNWKSISDLVPHGIATIYNRRTRDNDLKPSITVVQGPQPVKLTDLSRMRHILLKL

SEQ ID NO: 83599 - protein, 1352 aa, Cryptococcus neoformans var. neoformans JEC21
MGLIWSSLAHLAQPCYLPRASARDSHPHRPLSHPTAAPDMWGSNASTAASESTDSLSPSPSQSAAVEFPLPVSSRPSPPSAAHPSQMSASSSSTSSQPLFDWPVSKPTSPRTRTDPFDTFDPVSSSSEDDPVPQETRRAGHHRSVTDPLLRDGQPLDMEFTTAGPPVQGYDFEQPPTFSRALSSPLPAKVGSLRHPMPFTIGGLGSRNVNSAHRPLPTTPLHSISVELADSLQSAIQTLLHLSPPHLLDSAKEQYSGCAVQIPATSLSALLTSMRSLNFLSAHAEELVDMGAGGDQIVLHREDFDIGELLQNVADMLSGEAAEKRIDFVLFHGDVAMKHVSVYGDSDGISYALSHVIRQILAVANYDDTIELGLQVIPQSPSLISAVGLPIASVDVSGGGGGKSASTSRSGSPSNSLSRSNSAQDGPLLCVFEIVHNIYQPPPSSASATPKAELNPFTHLAEESESLRPRLDTAFCKNLLRRQNAVLKVDVPPSSPLGSGMPRRAYMLSVLLPRGKPITEPAILSKEEQEVRQPFSSRLLAREPTLNELSEFAESLRGRKVFIHANLSSVFARHLTSYLAAWGMDISHLPTDGDEADKTKDLAAKRDSAYTGSMGVLDGSTSSAETPYSVKPIGMTAVQPGHFVIVDDDIAVLRRELARIRAGLLPIPLKPRLSKRPTMTSRTRSSPSVRQVPPRSPGAVLIHFTSLANYNRVKDVIASFVGAPGLTNAETYVQPEVMVIPKPVGPRRFLTALHTAVKQPMVDPFFSPIATSPRSPGGGYFGGLRTPTERESGFFDSVAEEPHEEADPRPDYGTVQKARSPLGEFPPSAAQIVRTNQGLHLSLPTPNEIVTTPAPEYFSGASKSPSSGASGIVMQSPDGRPFGMFFEPPIKNERRGSTHRTPSDSIRRKQANRRASASDEPFSSPSTALPPRRSSTISTAGNEEHRSSPIANVTDRPTHSRVNSRRKNNLPATEEPILAVGRAKGRERSETVTKGGDSGSRKGTPAASPRTEEKKELERGEKAVMPKSVAPLTAPAKKNAKVDVVVPPINVLIVEDNPINQNILSMFLRKKKIKNSSAKDGAEAVEKWRTGGFHLILMDIQLPVMDGIAATKEIRRLERHNNIGVFPSTPAAELPRGPNVADSPAPSSPFRSSVIIVALTASSLQSDRVAALAAGCNDFLTKPVSLKWLDKKIVEWGCMQALIDFDGWRRWKSSDTKNPSETKQGFSVGPQQAARSLASRLRIERKGSRSPAAPVSTPRLNLQSATPDRPETPADSTSQMPKAPPVAASDPPLSPKSLNKTINDVFEQADARLENAREEQGVSSRKENASLTDSTNTTITIAPSKTYPAPPS

SEQ ID NO: 83600 - protein, 108 aa, Prochlorococcus marinus str. AS9601
MPEYNIKVQFEQKTFSFLCSEDQDIISAAKMNGIDLPSSCCSGVCTDCASMILEGSVDQEDAMGLNDDLREKGFALLCVAYPKSDLNIVIGKEVEDDLYNDQFGKYQK

SEQ ID NO: 83601 - protein, 355 aa, Callistephus chinensis
MVISANTRVESLATSGSDLIPKEYIRTHDELTTITNIFDEEKSDQGPQVPIIDLHDINSNDPKTRDKCTYELRKAATEWGVMHLVNHGISSDLINRVKAAGKSFFDQPVEEKEKYCNDIASGKIQGYGSKLANNACGQLEWEDYFFHLAFPEEKRDLSIWPTTPHDYIPATTEYAKQLRALATKILAALSLGLGLEEGRLEKEVGGMEELLVQLKINYYPKCPQPDVALGVEAHTDVSALTFILHNMVPGLQLFYGGKWVTAKCVPDSIIMHIGDTIEILSNGKYKSILHRGLVNKEKVRISWAVFCEPPKDKIILKPLPETISEDEPPLFPPRTFQQHMEHKLFRKNNDAVDPK

SEQ ID NO: 83602 - protein, 337 aa, Mesembryanthemum crystallinum
MAKVKVGINGFGRIGRLVARVILQRDDCELVAVNDPFISTDYMTYMFKYDSVHGQCKSHEIKLKDEKTLLFGETPVAVFGCRNPEEIPWGQAGADFVVESTGVFTDKDKAAAHLKGGAKKVVISAPSKDAPMFVVGVNEHEYKSDLNIVSNASCTTNCLAPLAKVINDRFGIVEGLMTTVHAMTATQKTVDGPSMKDWRGGRAASFNIIPSSTGAAKAVGKVLPALNGKLTGMAFRVPTCDVSVVDLTVRIEKAASYEQIKAAIKEESEGKLKGILGYTEDDLVSTDFIGDNRSSIFDAKAGISLNDNFVKLVSWYDNEWGYSTRVVDLIMHISKCQ

SEQ ID NO: 83603 - protein, 388 aa, Vibrio cholerae
MQIAIAGTGYVGLSNAMLLAQHHNVIALDIIQQKVDLLNDKISPIVDKEIEFFLKEKKLNFYATIDKHFAYQEADFVIIATPTDYDPETNYFNTSSVEAVIQDVMNINPAAVMVIKSTVPVGFTKSVKEKYGCENIMFSPEFLREGKALYDNLHPSRIIVGERSERAQVFANLLVEGAVKKDIPVLFTDSTEAEAVKLFSNTYLAMRVAYFNELDTYAASHGLDTRQIIEGVGLDPRIGNHYNNPSFGYGGYCLPKDTKQLRANYQDVPNSIISAIVDANTTRKDFIAQSIIAKKPQRVGVYRLIMKAGSDNFRASSVQGIMKRIKAKGIEVVVYEPVLKEESFFNSAVIRDFEQFKQMCDVIVSNRMTPELEDVAEKVYTRDLFGSD

SEQ ID NO: 83604 - protein, 868 aa, Xylella fastidiosa 9a5c
MSASPTAERWIVLKFGGTSVSRRHRWDTIAMVVRKRLEEHGTRVLIVVSALSGVTNELTAIAQGVVDSAQRVAALEQRHRDFLAELGLDAQAVLGTRFTVLWDLLQDARAVTRSLDWQAELLGQGELLSSTLGAAYLGASGVDIGWMDARDWLTALPPQPNQSEWSQRLSVSCQWKSDVEWRTRFDAQRAQVLITQGFISRHQDGGTAILGRGGSDTSAAYFGALLGAACVEIWTDVPGMFSANPKEVPDARLLTRLDYYEAQEIATTGAKVLHPRSIKPCRDTGVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQVCKVKIIVPCAAITLVGRGMRSLLHKLSEVWATFGKERVHMISQSSNDLNLTFVIDETDADGLLAVLHFKLIESGAMPVQERAVFGSPWREIIGHVRTRVMPWWHSARMRLLAMRDEEGIGPCYVYHLPTVRERARQLNAVAAVDQRYYAIKANPHPAILRTLIEEGFGLECVSLGELRHVFAVVPHLVPSRVLFTPSFASRVEYEQAFLLGVNVTLDNVEALRLWPEVFRDRTLWLRIDLGYGDGHHEKVTTGGKTSKFGLSVTRIDEFIDVAKTLNIIVTGLHAHLGSGVERGDHWSRMYDELAGFASRIGSVSTLDIGGGLPIPYRPDDEPFDVEAWGVSLAEVKALHPKLQLVIEPGRFLVAEAGVLLTRVTQVIEKDGIRRVGLEAGMHTLIRPALYDAWHDVENLSRLDEIPHVLCDVVGPICESSDVFGRCRHLPAATASGDLMLIADAGAYGFSMASTYNLRGLPAEVVLDA

SEQ ID NO: 83605 - protein, 452 aa, Streptococcus thermophilus CNRZ1066
MKVIKFGGSSLASATQLEKVLNIVKSDPERRFVVVSAPGKRNDEDTKVTDALIKYYKHYIKGADVKADQEWIINRYQAMVDELGFKSKEMVKIAKAITDLATLPIEDNDFLHDTFLAAGEDNNAKLIAEYFRNNDIEARYVHPREAGILVSSEPGNARILPGSYDKLEELRESDEVLIIPGFFGVTSDNQICTFSRGGSDITGSIVAAGVKADLYENFTDVDGIFAAHPGVVHEPHSIPELTYKEMRELAYAGFSVLHDEALLPAYRGKIPLVIKNTNNPDHPGTRIILEHQGATVPVVGIASDDKFVSINMSKYLMNREVGFGRKVLQILEDLNIRWEHMPSGIDDLSIIIRERELTPIKEQEILSYLTRELGVDEVEIEHGLSILVIVGENMRDHIGVTATAAKALSEKNINLEMISQGSSEVSVMFVIETEQEKEAVRALYDAFFRSNN

SEQ ID NO: 83606 - protein, 336 aa, Petroselinum crispum
MKMKIGINGFGRIGRLVARVALMSDDIELVAVNDPFITTEYMTYMFKYDSVHGQWKKDELKVKDSKTLLFGDKPLTVFGVRNPEEDPWGEAGAEYVVESTGVFTDKDKAAAHLKGGAKKVVISAPSGNAPMFVVGVNEKEYKKDIDIVSNASCTTNCLAPLAKVLNDKFGIVEGLMTTVHSITATRKTVDGPSMKDWRGGRAASFNIIPSSTGAAKAVGKVLPALNGKLTGMAFRVPTVDVSVVDLTARLEKAATYDEIKAAIKHESETSLKGILGYTEDDVVSTDFVGDSRSSIFDAKAGIALNGNFVKVVSWYDNEWGYSNRVIDLIRHMASVA

SEQ ID NO: 83607 - protein, 337 aa, Petunia x hybrida
MAKIKIGINGFGRIGRLVARVALQRDDVELVAVNDPFISVEYMTYMFKYDSVHGQWKHHELKAKDDKTLLFGEKPVTVFGIRNPEEIPWGEAGADYVVESTGVFTDKDKAAAHLKGGAKKVIISAPSKDAPMFVVGVNEKEYKSDLTVVSNASCTTNCLAPLAKVINDRFGIVEGLMTTVHSMTATQKTVDGPSAKDWRGGRAASFNIIPSSTGAAKAVGKVLPALNGKLTGMAFRVPTVDVSVVDLTVRLEKEATYDEIKAAIKEESEGKLKGIPGHTEDDVVSTDFIGDNRSSIFDAKAGIALSKNFVKLVSWYDNEMGYSTRVVDLIKHIASVE

SEQ ID NO: 83608 - protein, 196 aa, Yarrowia lipolytica CLIB122
MNIWVAASDGQLDVVKNFIENDGLSPNAKDENGYTPVHAAASYGHMDLLRYLIDKGGDINVTDEDGDTALHTVEELEVAKKLVEEFKADFKAKNSDGQTPFEKLQEEDEFPELIHYLAGLQGIVLDTPTAVSDDKEMPDVKYSFENEADTEADPEKKKQIEEIMKSDNPEAGLQEFLRNAINEQQAEHGEEKRRKE

SEQ ID NO: 83609 - protein, 574 aa, Oryza sativa Japonica Group
MNARRLHKWAGTARLVLLLLAAAAAAAAAAVGRREVVTSPHGAVAADDGRCSRIGRDALRDGGNAVDAAVAASLCLGVVSPASSGVGGGAFMLVRLADGTALAYDSRETAPLAASQDMYGGNETLKARGALSIAVPGEIAGLYEAWKRHGKLPWKRLVMPAAKLARAFRVSPYLRKQMEATRDGILQNKGISGVYTSNGDILNVGDVCRNIRLARTLVAVAEKGPDVFYKGAVGDQLAKDIQEVGGIITMEDLKKYQVKIRRPLLENVLGLTVLSMPPPSAGGAGLMLVLNILTQYGLPAGFSGSLGIHRLIESLKHYFAIRMNLGDPEFVNVNEVVSDMMSPKFAADLKKTIYDNMTFDPKHYGGRWNILQDHGTSHLSIVDSERNAVSMTTTVNAYFGSLILSPSTGILLNNEMDDFSMPANTSANSPPPAPANFVRPLKRPLSSMTPTIILKDGNLKAAVGASGGSMIPAGTMEVLLNHFVKNMDPLSSVMAPRVYHQLIPNVVQYENWTTVTGDHFELDAATRADLRRKGHVLEPLAGGTISQLVVDDVERHGGLTAVSDPRKGGFPAGY

SEQ ID NO: 83610 - protein, 338 aa, Ranunculus acris
MTGKIKIGINGFGRIGRLVARVALARDDVELVAVNDPFITTDYMTYMFKYDTVHGQWKHHELKVKDEKTLLFGEKPVTVFGCRNPEEIPWGETGAEFVVESTGVFTTKEKASAHLKGGAKKVVISAPSADAPMFVVGVNHTEYKSDIDIVSNASCTTNCLAPLAKVINDRFGIVEGLMTTVHAMTATQKTVDGPSSKDWRGGRAASFNIIPSSTGAAKAVGKVLPALNGKLTGMAFRVPTVDVSVVGLTVRLEKKATYADIKAAIKEESEGKLKGILGYTEDDVVSTDFIGDNRSSIFDAKAGIALNDNCVKLVSWYDNEWGYSSRVVDLIVHMSKTQ

SEQ ID NO: 83611 - protein, 594 aa, Neisseria meningitidis
MALVELKVPDIGGHENVDIIAVEVNVGDTIAVDDTLITLETDKATMDVPAEVAGVVKEVKVKVGDKISEGGLIVVVEAEGTAAAPKAEAAAAPAQEAPKAAAPAPQAAQFGGSADAEYDVVVLGGGPGGYSAAFAAADEGLKVAIVERYKTLGGVCLNVGCIPSKALLHNAAVIDEVRHLAANGIKYPEPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDKPFTKLIFDAETGRIIGGGIVGPNGGDMIGEVCLAIEMGCDAADIGKTIHPHPTLGESIGMAAEVALGTCTDLPPQKKK

SEQ ID NO: 83612 - protein, 338 aa, Sinapis alba
MADKKIKIGINGFGRIGRLVARVILQRNDVELVAVNDPFITTEYMTYMFKYDSVHGQWKHNELKVKDEKTLLFGEKPVTVFGIRNPEDIPWGEAGADFVVESTGVFTDKDKAAAHLKGGAKKVVISAPSKDAPMFVVGVNEHEYKSDLNIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESQGKLKGILGYTEDDVVSTDFVGDNRSSIFDAKAGIALSDNFVKLVSWYDNEWGYSTRVVDLIIHMSKA

SEQ ID NO: 83613 - protein, 326 aa, Nicotiana tabacum
GRIGRLVARVALQRDDVELVAVNDPFISTDYMTYMFKYDSVHGQWKHHELKVKDEKTLLFGEKSVRVFGIRNPEEIPWAEAGADFVVESTGVFTDKDKAAAHLKGGAKKVVISAPSKDAPMFVVGVNEKEYKPEYDIVSNASCTTNCLAPLAKVINDRFGIVEGLMTTVHSLTATQKTVDGPSMKDWRGGRATSFNIIPSSTGAAKAVGKVLPALNGKLTGMAFRVPTVDVSVVDLTVRLEKEASYDDIKAAIKEESEGKLKGILGFTEDDVVSTDFVGDSRSSIFDAKAGIALSKNFVKLVSWYDNEWGYSSRVIDLICHMASVA

SEQ ID NO: 83614 - protein, 387 aa, Bacillus thuringiensis serovar konkukian str. 97-27
MEFEFFFQIALILLSTKLAGDLSVRLGQPSVLGKLIVGIVIGPAVLGWIENSELLTQLSNVGVILLMFMAGLETDLEELNANRNSSLAVALGGIILPFVGGYVSGLVMGMEQGNAVFLGLLLCATSVSISVQTLRDLGKMKTRESTTMLGAAVFDDILVVILLAFAMSFLGTDDVNLTMVILKKVVFFASIILIGWKGVPAIMRWLSPLRVSESIVSAALIICFSFAYFGELLGIAGIIGAFAAGIAISQTNYKHEVEKKVEPIAYAMFVPVFFVSIGMNITFDGIGDQIWFILALTVIAVLTKLIGCGLGARMTGFDAKSSAIIGSGMVSRGEVALIIAGTGLSSGLLAQDYFTAIVIVVILTTMITPPMLKYTFGAKDKAMKASK

SEQ ID NO: 83615 - protein, 190 aa, Glycine max
  misc_feature (28)..(28): Xaa can be any naturally occurring amino acid
  misc_feature (35)..(35): Xaa can be any naturally occurring amino acid
  misc_feature (62)..(62): Xaa can be any naturally occurring amino acid
  misc_feature (86)..(86): Xaa can be any naturally occurring amino acid
  misc_feature (100)..(100): Xaa can be any naturally occurring amino acid
  misc_feature (114)..(114): Xaa can be any naturally occurring amino acid
  misc_feature (166)..(166): Xaa can be any naturally occurring amino acid
  misc_feature (183)..(184): Xaa can be any naturally occurring amino acid
KLEGTLKQQPDDGRVPKTKIVCTLGPAXSRSVEMXTEKLLRAGMNVARFNFSYGTHDYHQEXTLNNLKTAMHNTGILCAVMLELRXVFSLNALCMVNGEXVIDFLFINASVLCXGPEIRTGFLKDGKPIQLKEGQEITITTDYDIKGDQEMISMSYKKLPVHLKPXNTILCSDGTITLTVLSXXDPDAGT

SEQ ID NO: 83616 - protein, 834 aa, Debaryomyces hansenii CBS767
MVNLSSSKFHITEPADEDIQLTLVNGNQKGHEDSCNRSSTPKFGSISRFFFNKEQSVSSDVSNADSTVSSNTDSLNHNHGSKSGVTNSEAREDEHDDAKQQPGLSKLKSFLRLSSNSLLLSNNGPNDNGEQNGPKGTDVITPNAESVTPVRSNEEKTKLKHESDRNEEGHNGNKDGSNVSTKQEASAGMMKKFMLGRKRSVSSPTSPATGNRKPQQSNLLINTESPKDIPEIITENTESPVISSNLYFAHQGLPPHMNNHNKNNHTLAASAANEDDISVALRHNDSVFSLNDGGPLKPPNVYQSKLSASDESGSEHEPIPEHTTESGLKTPEESTLQNKNKLEVPPHTLPHPGQASPFQKTLRRVASAPLVHRLLNDSNTRLPQTRAYVSNDDDFDITEHIGELKSGRPRTLSRGRMYSSASTKIMDAQVNQNSFKKIRLLGKGDVGKVYLVKENLSNRLYAMKILSKKEMIERNKIKRALAEQDILATSNHPFIVTLYHSFQSNDYLYLCMEYCMGGEFFRALQTRETKTISETDAKFYAAEVTAALEYLHLMGFIYRDLKPENILLHQSGHIMLSDFDLSKQSESTKNPEIFFSKTSHGLSSSNNHNGPTLDTKACIDGFRTNSFVGTEEYIAPEVIRGKGHTSAVDWWTLGIFIYEMLFGTTPFKGRDRKKTFGNVLKKEVKFLETRSISSSCKSLIKKLLIKDEAKRLGSKTGASDIKNHAFFKNTQWALLRHQKPPMIPVLSKNKRADKVERYDSEEDQITDSTTDVSENKDILNDPFANFSSVTLHYNELDSGDDQMVYNEADNTVYTSVAYTMTNDSSPKPKHFLKR

SEQ ID NO: 83617 - protein, 259 aa, Bacteroides fragilis NCTC 9343
MNRFENKIIIITGAAGGIGASTTRRIVSEGGKVVIADYSREKADQFAAELSNSGADVRPVYFSATELKSCKELITFTMKEYGQIDVLVNNVGGTNPRRDTNIETLDMDYFDEAFHLNLSCTMYLSQLVIPIMSTQGGGNIVNVASISGITADSNGTLYGASKAGVINLTKYIATQTGKKNIRCNAVAPGLILTPAALNNLNEEVRKIFLGQCATPYLGEPQDVAATIAFLASEDARYITGQTIVVDGGLTIHNPTINLV

SEQ ID NO: 83618 - protein, 527 aa, Mesorhizobium loti MAFF303099
MPVIRSSISTSSDPFRANAGRMRSLISDISEKAKSISLGGPDDARQRHLSRGKLLPRERLAQLLDTGSPFLEVGQFAAWGMYGDIIASAGMIAGVGRVESREVMIVVNDATVKGGTYYPLTVKKHLRAQEIARENNLPCIYLVDSGGANLPNQHEVFPDREHFGRIFYNQATMSAAGIPQIACVMGSCTAGGAYVPAMADESIMVRDQATIFLGGPPLVKAATGEDVSAEDLGGADVHTRQSGVADHYAQDDNHALAITRRIVRNLNRVKPSQLQLREPRPPLLNPLEILGVVPSDTRTPYDVREVITRVVDGSELDEFKANYGTTLVTGFAHIHGNGVLFSESALKGAHFIELCTQRKILLVFLQNITGFIVGRKYEAVGIAKDGAKLVAAVATAKVPKVTVIIGGSFGAGNYGMCGRAYSPRFLWMWPNARISVMGGEQAATVLALVKREGMERKGGSWSAEEEADFRRPILDKYEREGHPLYSSARLWDDGIIDPTKTREVLALSLSAALNAEIKDTKPGVWRM

SEQ ID NO: 83619 - protein, 355 aa, Physcomitrella patens subsp. patens
MSAYWGKYADELIRTAKFIGTPGKGILAADESTSTIGTRLQSINVENTEANRQALREMLFTAPGIHQFLSGVIMYEETLYQKTLAGKPFVKLLEEMGVMTGIKVDTGVVPLAGTNGETTTQGHDGLGARCKKYYEAGARFAKWRAVLKIGHTEPSELGIQQNAQGLARYAILCQENGLVPIVEPEVLSDGTHDIRKCAEVTERVLAACYKALNDQHVLLEGTLLKPNMVTPGSEAPKVSCDIIAKFTVRALQRTVPPAVPAVMFLSGGQSEEEATVNLNSMNALQTLKPWTLSFSYGRALQSSVLKTWGGEKKNWVAAQRVLYNRAKANSEAVLGKYKGDSGGDSGNLFVKDYKY

SEQ ID NO: 83620 - protein, 382 aa, Alkaliphilus metalliredigens QYMF
MGVYLDNAATSYPKPREVLDAVYDFMLNNGATSGRGAYERAMMADGLVYDTRKMIANLFNFHDPKKVIFTANITESLNLAIKGIVKKGDHVITSSLEHNAVWRCLKTLERDRGISLSVVPAAKEGYINPLDVKDLIRKNTTLIVLNHASNVFGTIQPIGEIGAIARENSIPLLVDAAQTAGVLPIDIKEDNIDLLAFTGHKSLLGPMGTGGLIVNWDGEIDPLKSGGTGGDSAYEYQPDYFPNRLETGTLNVSGIVGLRAALKFIQNEGIEKIFEKEKHLVGYALDRLEEVRGISIYGPKDPNKIVGVISFNLQEVSGEEVAYILDQEYGVMVRVGLHCAPGPHKMIGKEKEGTVRIGIGYFNTEEDIDLLVNALKKINQQV

SEQ ID NO: 83621 - protein, 309 aa, Salmonella enterica subsp. arizonae serovar 62:z4,z23:--
MKTAGNLIVLGSINADHILNLESFPTPGETVTGSHYQVAFGGKGANQAVAAGRSGANIAFIACTGDDDIGDSIRKQLVSDRIDIEPVSVIKGESTGVALIFVNGEGENVIGIHAGANAALSPALVDAQRERIAQADALLMQLESPLESVLAAARIAHQNHTTVALNPAPARELPDELLALVDIITPNETEAEKLTGVRVENDDDAAKAAQVLHVKGIRTVLITLGSRGVWASVNGEGRRVPGFKVEAVDTIAAGDTFNGAFITAILEAMPLPEAIRFAHAAAAIAVTRKGAQPSVPWREEIEAFLRQQG

SEQ ID NO: 83622 - protein, 220 aa, Gossypium barbadense
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRS

SEQ ID NO: 83623 - protein, 99 aa, Glycine max
  misc_feature (43)..(43): Xaa can be any naturally occurring amino acid
MAPSTISNPGAGFVDRAVPSMIATITGLRIMAGFPTRKTNKDXTFIDCNGGRVHCMHVWPPVGKKKCENLSYLTDLEDAQWAKEAEYLVREGMDINARN

SEQ ID NO: 83624 - protein, 167 aa, Neurospora crassa
MGNTTSSVLDNIVQGSNFDREEVDRLRMRFMKLDKDNSGTIEREEFLSLPQISTNPLATRMIAIFDEDGGGDVDFQEFVSGLSAFSSKGNKEQKLRFAFKVYDIDRDGYISNGELFIVLKMMVGSNLKDQQLQQIVDKTIMEADLDKDGKISFEEFTKMVENTECQH

SEQ ID NO: 83625 - protein, 175 aa, Candida albicans
KMEVLHQLTTNHTSSLSNLINNHPTSFSSILKEVDITNHSLTYIEKLWASYYIYMNNDILATGLLFFITHELMYFGRCLPWFIIDKTPWFNRYKIQPTKIPTNQEQWECFKTVLKQHFLVEALPIWLFHPVCAKLGITYDVPFPNWRIQAIQIAIFFICEDFWHFGFHSLFHQGW

SEQ ID NO: 83626 - protein, 330 aa, Rhodococcus sp. RHA1
MTTASKPKLKTSAMIASFVDEGQKTTSAPFGHALVKAARENDKIVGLSADLAKYTDMHIFAQEFPDRFFQMGMAEQLLLGAAAGMAETGLVPFASTYSVFAARRAYDFLCLDIAEPNLNVNIIGGLPGLTTGYGPSHQATEDMAIFRGIPNLTIVDPCDSIDIEQAVPQLAASDGPTYLRLLRGKVATVLDEYDYTFELGKAKVLRGGNDVVFVTSGLMTMRALQAADRLAAHNVDVAVVHTPTIKPFDAETVLAEVNTDRLVVTLENHTVIGGLFETVAAAVVTAGLGKRIVPIALPDQFLDAGALPTLHERYGLSTDRIVAKVLGELA

SEQ ID NO: 83627 - protein, 634 aa, Arabidopsis thaliana
MATTQSHTSDLTSEEQPASLDIMKEQTVPANNETSASFKSSQEAPVVVHPAKVAPLTGPYGLAGDFAGHLPSSILSPQAQGFYYRGYENPTGEWDEYSSYVNVEGLDITSPVGFNENASLVYQTGYGYNPQMPYGPYSPAASPLPSEGQLYSPQQFPFSGASPYYQQVVPPSMQYITSPTQPELTSLVGVDQQGDNIGPRQSYHPHPIGPFNGNQPNLGFPEWQQGFDGGIWSDWSKPSDMHRHSSSISPALSPQPLGSYGSYGQNIPMGSQRQRSFYGFGSGSNSYNRGYMHSGGRGQGSNYGSRLISNVGMGNQGWIGVDNSRGRGRVSDPSLGGAYNGTFDILNEQNRGPRASKPKTQVLEELDSAADSKKNNKGSAKEHEESNNADFVTDYTNAKLFIIKSYSEDNVHKSIKYNVWASTPNGNKKLDAAYREAKDEKEPCPLFLLFSVNASSQFCGVAEMVGPVDFEKSVDYWQQDKWSGQFPVKWHIIKDVPNSQFRHIILENNDNKPVTNSRDTQEVKLEQGIEMLKIFKNYDADTSILDDFGFYEEREKIIQDRKARRQPSLPSAGVVAGENEHKPASAALPTDFMKNMSKSFAQVVRLDEGSKEAVKASSSPDAITTAAVSSGQSN

SEQ ID NO: 83628 - protein, 587 aa, Nocardia farcinica IFM 10152
MAFSVQMPALGESVTEGTVTRWLKQEGDTVEVDEPLLEVSTDKVDTEIPSPAAGVLSKIVAQEDDVVEVGGELGVISEAGEAPAESAPAPEAPAAEAPAEESAAAEPEPEPAQAEQAPAQQPAASGDAAEGTPVQMPALGESVTEGTVTRWLKSVGDQVEVDEPLLEVSTDKVDTEIPAPVAGTLLEITAQEDDVVAVGGQLGVIGSGKPAAASAPAPAPAPETKAEPKPEPAPEPKPEPAPEPKPEPKPEPAPAPKAEQPAPAAQAQPQAPAPADSGATPYVTPLVRKLAEEHGVDLNSIKGSGVGGRIRKQDVLAAAEAKKAPAAAAAPAAKAPSAPAPAPQLAHLRGTTQKASRIRQITATKTRESLQTTAQLTQVHEADVTKIAALRAQAKAAFKEREGVNLTFLPFFAKAVVEALGVHPNVNASYNEDTKEITYHASVHLGIAVDTEQGLLSPVIHNASDLSLAGLARAIADIADRARNGGLKPDELAGGTFTITNIGSQGALFDTPILVPPQAAMLGTGAIVKRPVVVTDETGGESIGVRSMCYLPLTYDHRLIDGADAGRFLTTIRHRLEEAAFEADLGL

SEQ ID NO: 83629 - protein, 505 aa, Bdellovibrio bacteriovorus HD100
MTTTKFTDLPLIAPLQFSLKEAGYETPTPIQLAAIPVILEGHDLLGIAQTGTGKTAAFSLPILQNLSKHTRKIEPKSPRCLILTPTRELAIQIHENIEAYSKHLNMKHAVIFGGVGQNPQVRALQGGVDILIATPGRLMDLHGQKHLKLDRVEIFVLDEADRMLDMGFMQDIKKILPLLPQKRHNLFFSATMPHEIQTLANRILVNPKKVEVTPVSSTAEKVEQRVMFVDKPQKLDLLLHILKDESLSKVLVFVQMKYGANRVVDRLTKAGVAAAGIHGDKSQNQRQRALEEFKNGDVRVLVATDIAARGIDIDGITHVINLELPHIPESYVHRIGRTARAGATGISISFCTAEERSFLFAIEKTTRTKVTVVEDHPFHSTEIANAPVMTVGKAKAILEGQRLQNKAKNRGGGPRRQGGGAPQGGHGGKKAGGKPQGGNKPDHGGKTHTKSEHKSEGAASHKTHSKPAHAKPAHKPAHKSEGKSAGKSEHAPKKRSFWSRLRNKD

SEQ ID NO: 83630 - protein, 337 aa, Hordeum vulgare
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKVINDNFGIIEGLMTTVHAITATQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 83631 - protein, 231 aa, Arabidopsis thaliana
LQKELDYLVGAVSNPKRPFAAIVGGSKVSSKIGVIESLLEKCDILLLGGGMIFTFYKAQGLSVGSSLVEEDKLELATTLLAKAKARGVSLLLPTDVVIADKFAPDANSKIVPASAIPDGWMGLDIGPDSVKTFNEALDTTQTVIWNGPMGVFEFEKFAKGTEAVRNKLAELSKKGVTTIIGGGDSVAAVEKVGVAGVMSHISTGGGASLELLEGKVLPGVVALDEATPVTV

SEQ ID NO: 83632 - protein, 336 aa, Emericella nidulans
MAPKVGINGFGRIGRIVFRNAIEAGTVDVVAVNDPFIETHYAAYMLKYDSQHGQFKGTIETYDEGLIVNGKKIRFHTERDPANIPWGQDGAEYIVESTGVFTTQEKASAHLKGGAKKVVISAPSADAPMFVMGVNNETYKKDIQVLSNASCTTNCLAPLAKVINDNFGIIEGLMTTVHSYTATQKVVDGPSAKDWRGGRTAATNIIPSSTGAAKAVGKVIPSLNGKLTGMAMRVPTSNVSVVDLTVRTEKAVTYDQIKDAVKKASENELKGILGYTEDDIVSTDLNGDTRSSIFDAKAGIALNSNFIKLVSWYDNEWGYSRRVVDLISYISKVDAQ

SEQ ID NO: 83633 - protein, 336 aa, Bacillus coagulans
MAVKVGINGFGRIGRNVFRAAVKNPDIEVVAVNDLTANADGLAHLLKYDSVHGRLDAEVVVNDGVSVNGKEIIVKAERNPENLAWGEIGVDIVVESTGRFTKREDAAKHLEAGAKKVIISAPAKVENITVVMGVNQDKYDADAHHVISNASCTTICLAAFARVLHQIFGEVSRMMTTAHSYTNIQRILDAATHADLRGARAAAESIIDTTNGAAMAVALVLPELKGKLNGMAMRVATANVSVVDLVYELAKEVTVEEVNAALKAIAEGELKGILAYSIEPLVIRNYNGSTVSSTIDILSTMVIDGAMVKVVSWYDNETGYSHRVVALAAYINAKGL

SEQ ID NO: 83634 - protein, 399 aa, Arabidopsis thaliana
GDLTSADLKGKKVFVRADLNVPLDDNQTITDDTRIRAAIPTIKYLIENGAKVILSTHLGRPKGVTPKFSLAPLVPRLSELLGIEVTKADDCIGPEVESLVASLPEGGVLLLENVRFYKEEEKNDPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATELLAKAKAKGVSLLLPTDVVVADKFAPDANSKIVPASGIEDGWMGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEAIPVTV

SEQ ID NO: 83635 - protein, 335 aa, Bacillus megaterium
MAVKIGINGFGRIGRNVFRAALKNDNVEVVAINDLTDANMLAHLLKYDSVHGKLDAEVVVDGSNLVVNGKTIEISAERDPAQLSWGKQGVEIVVESTGFFTKRADAAKHLEAGAKKVIISAPASDEDITIVMGVNEDKYDAANHNVISNAPCTTNCLAPFAKVLNDKFGLKRGMMTTVHSYTNDQQILDLPHKDYRRARAAAENIIPTSTGAAKAVSLVLPELKGKLNGGAMRVPTPNVSLVDLVAELDKEVTVEDVNNALKEAAEGDLKGILGYSEEPLVSGDYNGNINSSTIDALSTMVMEGNMVKVISWYDNESGYSNRVVDLAQYIAAKGL

SEQ ID NO: 83636 - protein, 294 aa, Citrobacter freundii
IVFRAAQERSDIEIVAINDLLDADYMAYMLKYDSTHGRFNGTVEVKDGHLIVNGKKIRVTAERDPANLKWDEVGVDVVAEATGLFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAASYEEIKKAIKAASEGPMKGVLGYTEDDVVSTDFNGEVCTSVFDAKAGIALNDNFVKLV

SEQ ID NO: 83637 - protein, 470 aa, Moorella thermoacetica ATCC 39073
MDAKNTAAGSYGKVLAGLLAIIVYIILTNLPTPANLPPQGQKALAFMVAVVIVWVFEVIPIGISAALFLMIMDILKVFPMKDAMANFATTTLFFILSAFIIAITFINTGLGNRVSLMVSAIFGQKTDRVLLSFMLPTAIISSVLADIPTAVIFSSIAYPLLQKNGCLPGKSNFGKALMLGIPIAAAIGGIATPAGSGLNIMSISLLKNTAGVEINFLQWALIGFPMAILLTLAAWYIVLKFYPPEFDHVRGLEDIAKARQDLGPLTVNEKKFIAIFSVTLVLWFTQPWNHIDPSVVAIITASSFFLPGVKLATWDDVKGKLSWDVLLLLGTANSLAMAIWQLKGAAWLANTVLGGLAGVGLLIVLFAVTAFGIFSHLIIPVGGAVVAVAIPVLAVLAKNTGINPALLVIPIAYTASCVFLLPLDPIPLTTYHYKYWKFWDMMKPGFLISLVWLVLMVIFMYIGQGVGIIR

SEQ ID NO: 83638 - protein, 165 aa, Streptomyces coelicolor A3(2)
MADYPEPGVVFKDITPLLADPGAFAALTDALAEAAGRTGATKVVGLEARGFILGAPVALRAGLGFIPVRKAGKLPGATLSQAYDLEYGSAEIEVHAEDLTAGDRVLVVDDVLATGGTAEASLELIRRAGAEVAGLAVLMELGFLGGRARLEPALAGAPLEALLTV

SEQ ID NO: 83639 - protein, 518 aa, Pycnoporus cinnabarinus
MSRFQSLLSFVLVSLAAVANAAIGPVADLTLTNAAVSPDGFSREAVVVNGITPAPLIAGQKGDRFQLNVIDNLTNHTMLKTTSIHWHGFFQHGTNWADGVSFVNQCPIASGHSFLYDFQVPDQAGTFWYHSHLSTQYCDGLRGPFVVYDPNDPQASLYDIDNDDTVITLADWYHVAAKLGPRFPLGADATLINGLGRSPGTTTADLAVIKVTQGKRYRFRLVSLSCDPNHTFSIDGHTMTVIEADSVNTQPLEVDSIQIFAAQRYSFVLDASQPVDNYWIRANPAFGNVGFAGGINSAILRYDGAPEVEPTTTQTTSTKPLNEADLHPLTPMPVPGRPEAGGVDKPLNMVFNFNGTNFFINNHSFVPPSVPVLLQILSGAQAAQDLVPDGSVYVLPSNSSIEISFPATANAPGTPHPFHLHGHTFAVVRSAGSSEYNYDNPIFRDVVSTGQPGDNVTIRFQTNNPGPWFLHCHIDFHLEAGFAVVLAEDTPDTAAVNPVPQSWSDLCPIYDALDPSDL

SEQ ID NO: 83640 - protein, 95 aa, Arabidopsis thaliana
KWNPGPFPLVVFLSGASPNSISKSRSSKPNVFFSGDPLVGGEPLFFGSRTSFVVEVAPLEGMVFFPPHGAKCFLPKGRNFSKGVKYVFRSNVVFA

SEQ ID NO: 83641 - protein, 535 aa, Bradyrhizobium sp. ORS278
MEAHFQIFLILLAVLAGTALIARRANLAPAILLMLAGIALAFVPTMPAFALPPELVLLVVLPPLIYSSSVAMSWREFKRNLRPIVLLAVGCVIFTASMVAVATHVLLGLPWSLGFLLGAIVAPPDVVAPLAIARRLHLPRRVMVILEGEGLANDATALILYRFAVAAITTGTFSLPVAAGEFAAIVIGEIAFGIGVGWLMLRARHYSDDTRVEITLSLLTPYLAYWIPEHLGGSGVIATVACGLYMSWNGPLWISSATRLQGVFFWDLVVYLIEGMLFLLTGFQMRLIYEKSKVFPLDEIMIATALVVAIVVIARFAWTFPATILPRVLSRSLRARDPLPPWQQTFIIGFTGVRGTVSLATALALPLTLSTGDPFPYRDEILFIAFGVIFFTLIGLGLTLPLVVRWLGVSRAGRAEHVREHEQEIAARREVLDRALQSLETMTNDRELSDEVVRLLRARHEVRANQLPERLNPDEYDASALGIELTRELIGVERKTIHAMLRDGQITDETRRRIERDLDLEEASLANREYGQLPL

SEQ ID NO: 83642 - protein, 187 aa, Deinococcus radiodurans R1
MTDFAAQYDTRDHLLSILVLDEPRVLTRITALFGRRGYNIKSLSVGQTEHPGVSRMTIVVHGDRGVVQQAMHQLEKLHDVVKVVDHSLEKFVDRELVMVKVAITPESRVEVRQIAEDFRARIVDVGRHALTFEVTGDEGKITAFIEQMRPSGFWKPCGPGALPSRAAATPTSRARCSTAAKAKRCGP

SEQ ID NO: 83643 - protein, 429 aa, Mesorhizobium loti MAFF303099
MSDLPERLHDIIRRRNMVLGPGYQFSETIPVEFVSSFGAHLIDSDGNDYLDAFNNVQGVGHAHRHVADAVARQIAAINTDTRYPQEALVAYAERLLATFPAELSKLSLPCTGSEANDLAVRVARYHTGGEGIIVTRWAFHGRTREVASFSPMLGAGSPLGPNVRLIAAPDPRFCGPQQSLENYMRDQVRSAIVDLERHGYRLAALVADSAFTSDGIFTHPVGFLQAMVDEVHAAGGLHIADEVQSGFAQLGDSMWGFSRHGVVPDIVTMGKAIGNGFPISGVVFRPEVSDEFGQKVSYFNTLGGRSLSIAAASAVLDVFEQENVRERVAVNGAALQSGLETLARESPYVAEIRGSGLYLGVEIVKDRETLEPDPIRCESIIKDLRDRRVLISRTGSSGNVLKVRPPVAFTAADVSRFLETFAIVAKQRL

SEQ ID NO: 83644 - protein, 348 aa, Campylobacter lari RM2100
MKKMLMCAAMALSLGAGILEAKPKVAILATGGTIAGSIDSSVATTGYTAGVLGVDALIKAVPQIQDLAVISGDQIANIDSKDMTNEIWLKLAKEVNRLLKSDVDGVVITHGTDTMEESAYFLNLTVKSDKPVVLVGAMRPSTAISADGPKNLYNAVALAANPDAKNKGVMVVMNDRIQSARGVMKTHSLNVNAFSSPDMGDMGYIVDGKAFFYNTNTKLHTKKSPFDVSKLKELPKVDILYSYANDGSGVAAKALFENGTKGIVVAGTGAGSIHDYQKDVLKELLKKGLNVAVSSRVVAGRVAVSDADAKLGFIDTGDMSPQKARVLLMLALTKTSDPKKIQEYFLKY

SEQ ID NO: 83645 - protein, 123 aa, Physcomitrella patens subsp. patens
QVVDHYDNPRNVGSFDKNDPNVGTGLVGAPACGDVMKLQIKVDEKTGEIIDACFKTFGCGSAIASSSVASEWIKGKAMEEAVSIKNSDIAKHLSLPPVKLHCSMLAEDAIKAAVKDYKSKRAK

SEQ ID NO: 83646 - protein, 688 aa, Oryza sativa Japonica Group
MCRICFSGENEGSTKAAKMLPCKLCNKKYHRSCLKNWGEHRDLFHWSSWVCPSCRSCEVCRRPGDPNKLMFCKRCDGAYHCYCQQPSHKNVTHGPYLCPKHTRCHSCGSGVPGSGHSTRWFLGYTCCDACGRLFVKGNYCPVCLKVYRDSEVIPMVCCDVCEKWVHIECDGISEEKYQQFQSDQNLQYTCGACRGECSQIRDTEDAVRELWKRRDVVDHDLMASLRAAAALPSLEDVSPSHPNSDDEKLGAYVMKNDGRNTLKFSFKSNSTKPALDSSEQEKNAIKSSGSNKKHSKKKGNQNNKTVSEQDEIFLEKRNETKSLGSLGDQIADVTRDKSSFKNDADAFVLSSAQSAEKALKLQSAKAAAHNADMIPKVKIKGTKVPSLHFKDVGEENAAKSDTGKGTKLVIHIGSRHKSRSGSPKSEMSNSQKEQELVSMHGGKVDVTSQFKSSRSEIKEKSVMKLVRETGVQQNSLLGDLGASKKHATGKRSNAIVSAMENASESGTRSRSFGQKQSVNHLTENQGNASFSVNNSPDSLKPSLLKLKFKRPIFEQPSTQSSQPEEPGTWASPQEELNVAKGQRSKRKRPSLDKMDGSESKAPAAKRHEQSTGEEAMDANWILRKLGKDAIGKRIEVQLASDGKWHQGVVSNVINGTLCLQLDNGRSENIELGKRAIRLIAQRSKSGKR

SEQ ID NO: 83647 - protein, 306 aa, Bradyrhizobium sp. ORS278
MTATATDFTQRLDKTAEETEALLGELLSDAPLADEIARPKRLIESMRYSSLGGGKRLRPFLVVESAAVFGVPRRGALMAGAALECIHCYSLIHDDLPAMDNSDLRRGRPTLHKVYDDATAILAGDALLTIAFDIITRDEIHPDAGVRLALTRALARCAGVGGMAGGQILDLAGEGRFGDRDPVDVARVQQMKTGALLRFGCIAGALLGQASAAEYKALDDYGRALGEAFQIADDLLDVEGDAATLGKPAGADAELGKTTFVTQLGIEGAKQRVRDLLARGDAALSIFGAKGDVLRAAAHFVAERKS

SEQ ID NO: 83648 - protein, 147 aa, Campylobacter lari RM2100
MEKYNREEFEEVIVDIGRVTKVVKGGRRFRFTALVIVGNRKGLVGVGYGKAKEVPDAIRKAVDDAFKNIVEVKTKGSTIPHDVEVKYNASRILLKPASEGTGVIAGGSTRPIVELAGIKDILTKSLGSNNSANVVRATIKALTMLKG

SEQ ID NO: 83649 - protein, 457 aa, Alkaliphilus metalliredigens QYMF
MKVAVIGGGPGGYVAAIKAAMLGAEVTLIEKKRVGGTCLNVGCIPTKSLLASSDVLEVVRDAKNYGINIDGTIEPDLPAIMKRKEKIVEQLVKGIEFLFDKKGVKLINGFGKLVDKNKIEVTKEDGSKEEIEADKIILATGSVPIVPPIFPHDGKKIITSDEALFLEEIPKSMSIVGGGVIGCEFGQFFSKMGTKVTIVEMAEQLLPFEDKDVAKQLERSFKRDKIKMLTGQKINKCEVQDNKVIAYLEGDKTLEADIMLVSVGRKPYLENLGLEDLGIEMEKGKVVVNKNMETNIKGIYAIGDIVDTPFLAHVASKEGLIAAENALGKDKAISYRAVPRCIYTGPEVAAVGMTEKEAEAKGMIYHVGKFEFRGLGKAQAIGHFQGFVKVLVDDQDVIIGAAIVGPHATDLLAELSLAVELQLTAERVGDIIHPHPTLSEGIMEALHDVHKACIHAV

SEQ ID NO: 83650 - protein, 320 aa, Mycobacterium smegmatis str. MC2 155
MNPSAQVVLITTGGTISTSTDNAGVRRPTRRGAQLTAALTAPTAPTVSVVDLMTTDSSHLTPSDWDAIREAVAKATDGPGGPDGVVITHGTDSLEETALWLELTHTGDTPVVITGAQRSSDAPEADGPRNLADAIAVAASPDARGLGVLVCFAGTVRAPLGLHKRHTQELDAFSGTALGTVADGTVELTEDKTRPVLGALSAAAAPRVDIVAGYPGADAAALDACVAAGARGVVLEAMGSGNLGAALTEGVERHLRAGVEIVVSTRVPGGVIAPDYGPGRRLADAGAVVAPRLRPPQARVLLMAALAAQRPVREVFSSWG

SEQ ID NO: 83651 - protein, 662 aa, Arabidopsis thaliana
MTKMSNLPNDLAEEVLSRVSLTSLRNVRLTCKDWNTLSKGESFAKNHLGYQAIVAAKEKEFMMVLMMDFRVYLIRVNVHNDIESCIKPEGELISLGDEVDVSQVFHCDGLLLCITEDNEDNAKVVLWNPYWGQTRWIESTNNFHKLDMYTYALGYKKSSKSSRSYKILRFIDFSPTCSEFKIYNINSDSWKVLDVSPDWKIDSYIRGVSLKGNTYWIARERHGYGHTFLVCFDFTRERFRSRLPLPSQPCVLDTVSLSSVREEQLAVLFQCSSTLEMQIWVTTKIEPNAVLWNSKVFLAVDMHSLKFQFQVRASSFFIDEEKRVVVVFDKEKRYLASSRNKAYIVGVDGTWEQVDLGMSLMMVMISLHFSTPPLAFLKSDSNSRFLKNPNPNFIQFTPKSQLLFPQRLNFNTGTNLNRRTLSCYGIKDSSETTKSAPSLDSGDGGGGGGDGGDAGGDDDKGEVEEKNRLFPEWLDFTSDDAQTVFVAIAVSLAFRYFIAEPRYIPSLSMYPTFDVGDRLVAEKITMSKVSYYFRKPCANDIVIFKSPPVLQEVGYTDADVFIKRIVAKEGDLVEVHNGKLMVNGVARNEKFILEPPGYEMTPIRVPENSVFVMGDNRNNSYDSHVWGPLPLKNIIGRSVFRYWPPNRVSGTVLEGGCAVDKQ

SEQ ID NO: 83652 - protein, 225 aa, Rhodospirillum rubrum
MTRAIRIAPSLLSADFAISRPRCPSDGRTGADILHFDVMDNHYVPNLTVGPLVCAALRPHTSLPIDVHLMTRPVDPLIDSFAEAGADMITFHPEASDHVHRSVQMIRKRGLKAGVALNPASPLSLLDHILEDLDLVLIMSVNPGFGGQSFIPSALPKIAALANGRRRACRGDRVDGGVNPADARALARPGADILVRLAIFGASDRAKAIASIRGAAESGLGQEAA

SEQ ID NO: 83653 - protein, 257 aa, Burkholderia thailandensis E264
MANTLDKFRLDGRRALITGSGRGIGLTLARGLAEAGAAIVINDRDEERVAALAKRFRDDGFAADYAVFDVSEHALVRSAIDDFEARNGAIDILVNNAGIQRRAPLDAFEPGDWHALMRVNLDGVFNVAQAVARHMITRRCGKIINICSVQSELARPTIAPYAATKGAVRMLTKGMCADWARHGIQANGLAPGYFETELNRALVDDAAFSDWLCKRTPAGRWGRVDELCGAAIFLASAASDFVNGQTLFVDGGLTSAV

SEQ ID NO: 83654 - protein, 337 aa, Cryphonectria parasitica
MVVKVGINGFGRIGRIVFRNAHEHSDVEIVAVNDPFIEPHYAAYMLKYDSQHGNFKGDVTVEGSDLVVGGKKVRFYTERDPAAIPWSETGADYIVESTGVFTTTEKAKAHLKGGAKKVIISAPSADAPMYVMGVNEKTYDGSGMVISNASCTTNCLAPLAKVINDEFKIIEGLMTTVHSYTATQKTVDGPSAKDWRGGRTAAQNIIPSSTGAAKAVGKVIPELNGKLTGMSMRVPTSNVSVVDLTVRIEKGATYEQIKTAVKKAADGPLKGVLAYTEDDVVSTDMNGNPNSSIFDAKAGISLNDHFVKLVSWYDNEWGYSRRVLDLISHVAKVDGNA

SEQ ID NO: 83655 - protein, 337 aa, Cochliobolus lunatus
MVVKVGINGFGRIGRIVFRNAIEHNDVEIVAVNDPFIEPHYAAYMLKYDSTHGQFKGDIKVDGNNLTVNGKTVRFHMEKDPANIPWSETGAYYVVESTGVFTTTEKAKAHLKGGAKKVVISAPSADAPMFVMGVNHETYKSDIEVLSNSSCTTNCLAPLAKVIHDKYTIIEGLMTTIHSYTATQKVVDGPSAKDWRGGRTAAQNIIPSSTGAAKAVGKVIPELNGKLTGMAMRVPTANVSVVDLTVRIEKGASYDEIKQAVKEASEGPLSGILGYTEDDIVTTDLNGDNRSSIFDAKAGISLNKNFVKLVSWYDNEWGYSRRVLDLLVYIAKIDGNA

SEQ ID NO: 83656 - protein, 517 aa, Zea mays
MEPAYVVTLSFLFLFLLHHLLGRHRRRTNGKNKRTQLPPSPPAIPVLGHLHLLRKPIHAALARLAERYGPVFFLRLGSRQAVVVSSAACATECFTENDVCFANRPRFPTLLLVSFGGATLPMCRYGPYWRNLRRVATVQLLSAHRVSCMLPVISAEVRAMARRMYQSAAAAPAGAARVELKRRLFELSHSALMETIARTKTSRAVADDDTDMSPEAQEFMKALDVFLPLLSGANAWDYLPVLRWLDVFGVRNKILRAVSARDAFLRRLIDAERRRLEEGGENNDKKSMIGVLLSLQKSEPEVYTDTMIMALCSSMFAGGSETTATTAEWAMSLLLSHPDVLKKAQAEIDASVGHSRLLGADDLPRLGYLHCIVSETLRLYPVVPTLVPHESTADCTVGGHRVPSGTMLLVNVYAIHRDPAIWADPAAFRPERFEDGRADGLFVMPFGMGRRKCPGEALALRTLGLVLGTLIQCFDWDTVGGAEVDMAEGGGITLPRAVPLEAICKPRHAMLGVLKGL

SEQ ID NO: 83657 - protein, 294 aa, Enterobacter aerogenes
IVFRAAQKRSDIEIVGINDLLDAEYMAYMLKYDSTHGRFDGTVEVKDGHLVVNGKTIRVTAEKDPANLKWNEIGVDVVAEATGIFLTDETARKHITAGAKKVVLTGPSKDNTPMFVRGANFETYAGQDIVSNRSCTTNCLAPLAKVINDNFGIIEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGPMKGVLGYTEDDVVSTDFNGEVCTSVFDAKAGIALNDNFVKLV

SEQ ID NO: 83658 - protein, 294 aa, Escherichia blattae
IVFRAAQERSDIEIVAINDLLDAEYMAYMLKYDSTHGRFNGTVEVKDGHLIVNGKKIRVTAERDPANLKWNEAGVEVVAEATGLFLTDETARKHITAGAKKVVMTGPSKDSTPMFVRGANFDTYAGQDIVSNASCTTNCLAPLAKVVNDNFGIVEALMTTVHATTATQKTVDGPSHKDWRGGRGASQNIIPSSTGAAKAVGKVLPELNGKLTGMAFRVPTPNVSVVDLTVRLAKPATYEEIKKAMKAASEGAMKGVLGYTEDDVVSTDFNGETCTSVFDAKAGIALNDNFVKLV

SEQ ID NO: 83659 - protein, 402 aa, Oryza sativa Japonica Group
MASPMLSAATVPLQGGGLSEFSGLRSSSSLPLRRNATSDDFMNAVSFRTHAVGTSGGARRAPTEAKLKVAINGFGRIGRNFLRCWHGRGDSSPLDVIAINDTGGVKQASHLLKYDSTLGIFDADVKPVGDNAISVDGKVIKVVSDRNPSNLPWGELGIDLVIEGTGVFVDRDGAGKHIQAGAKKVLITAPGKGDIPTYVVGVNADQYSPDEPIISNASCTTNCLAPFVKILDQKFGIIKGTMTTTHSYTGDQRLLDASHRDLRRARAAALNIVPTSTGAAKAVALVLPNLKGKLNGIALRVPTPNVSVVDLVVQVSKKTLAEEVNQAFRDSAANELKGILEVCDVPLVSVDFRCSDVSCTIDASLSMVMGDDMVKVIAWYDNEWGYSQRVVDLADIVANQWK

SEQ ID NO: 83660 - protein, 294 aa, Escherichia fergusonii
IVFRAAQKRSDIEIVAINDLLDADYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKPATYEQIKAAVKAAAEGEMKGVLGYTEDDVVSTDFNGEVCTSVFDAKAGIALNDNFVKLV

SEQ ID NO: 83661 - protein, 294 aa, Escherichia hermannii
IVFRAAQTRSDIEIVAINDLLDAEYMAYMLKYDSTHGRFDGTVEVKDGHLVVNGKKIRVTAEKDPANLKWNEVGVDVVAEATGIFLTDETARKHITAGAKKVVLTGPSKDDTPMFVKGANFDKYNGQDIVSNASCTTNCLAPLAKVINDNFGIIEGLMTTVHATTATQKTVDGPSHKDWRGGRGAAQNIIPSSTGAAKAVGKVLPELNGKLTGMAFRVPTPNVSVVDLTVRLEKAASYEDIKKAIKAAAEGEMKGVLGYTEDDVVSTDFNGEVCTSVFDAKAGIALNDNFVKLV

SEQ ID NO: 83662 - protein, 410 aa, Streptococcus thermophilus
MSALDAYKIRQDFAILDQVVNDEPLVYLDNAATTQKPQVVLDTIMAYYREENANVHRGVHTLAERATAAYEASREKIRQFISAKSTKEILFTRGTTTGLNWVGRFAEQVLEPGDEVVISIMEHHSNIIPWQEACKKAGAKLVYAYLKDGQLDMEDLANKISEKTKFVSLAQVSNVLGCINPVKEIAQMAHRVGAYMVVDGAQSAPHMAIDVQDLDCDFFILSGHKMLGPTGIGVLYGKEEILNQMNPIEFGGEMIDFVYEQEATWKELPWKFEAGTPNIAGAIALGTAVDYLSALGMENVHAYEQELVDYVLPKLQAIEGLTVYGPEDSGKHAGVIAFNINGLHPHDVATALDYEGVAVRAGHHCAQPLINHLGISSAARASFYIYNTKEDCDKLVEAILATKEFFNGTL

SEQ ID NO: 83663 - protein, 303 aa, Klebsiella pneumoniae
INGFGRIGRIVFRAAQKRSDIEIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDNFVKLV

SEQ ID NO: 83664 - protein, 442 aa, Magnaporthe grisea 70-15
MTPSATNGDAAAASSRFHASSTKSAIAAENEYAAHNYHPIPVVFARAQGVNVWDPEGKHYLDLLSAYSAVNQGHCHPELIKALAEQAGRLTLSSRAFYNDVFPVWAAKVRDLFGYDMVLPMNTGAEAVETAIKIARKWAYKVKGVPQGKAHVFSVADNFHGRTMTAISLSTDPESRDNYGPYVPNIGAICPTTGRQIRYNNISDLEIVLEAHGAETAAFIVEPIQGEAGVVVPDDDYLAKVHALCKKHNVLFICDEIQTGIARTGKMLCCNWAGIKPDIVTLGKAISGGMYPVSCVLADKDVMMVVEPGTHGSTYGGNPLGCAVSIRALELVEEGKLADQADHLGRIFREGVEAFKSPIVQQVRGKGLLNAVVIDESAAGGRTAWDLCMLLKSKGLLAKPTHGNIIRFAPPLIITEEELKKALSIIGEALTELPTAEKGDGH

SEQ ID NO: 83665 - protein, 228 aa, Saccharomyces cerevisiae YJM789
MAELNDYSTMIDILLSDMDLETVTTKKVRMALKEVYAIDVESQGKAINKLIRKHLNLVKERPRFERSLEDLLKENVTLAIELTKEITVNKRSSGEEKNDSETKGTRVEKKKGTVSKSPISTRKVTLSKSLASLLGEHELTRTEVVRRLWAYIKAHNLQNPNNKKEILCDEKLELILGKSTNMFEMHKILASHMTEPKKISDCPPLIQEVRRKEKPIVSDSEQSDTKGI

SEQ ID NO: 83666 - protein, 629 aa, Helicobacter hepaticus ATCC 51449
MEVKTLDVANFLARIQKQESTFESLSKFSPTQLKELATCIRHRILEVVSSNGGHLSSTLGAVDLIIGMHLVFDANTNPFIFDVSHQAYAHKLLTGRWNDFSSLRQFGGLSGFCNPKESPSDYFIAGHSSTSISLAVGAAKALALKGSASMPVVMIGDGSMSAGLVYEALNELGDKKYPMVIILNDNKMSISKPIGAISNYLSQILTTSIYQKIRDTIKKVLTKMPDSATYLAKRFEESLKLITPGILFEELGLDYVGPIDGHNIELIIATLQRAKEMRKPVIIHAQTLKGKGYEIAEGRFEHWHGVGPFDVSTGSSLKSSAPQSPTAVFSESLESYLTDEKVVGVTAAMPSGTGLDKLIEKYPQRFWDVAICEAHAVTSMAAIAKEGFKPFVAIYSTFLQRAYDQIIHDVGILGLPVRFCIDRAGIVGEDGETHQGLFDIAYLRSIPHMVLFAPRDNASLQQAVAFAYRYNDSPCAFRYPRGSFTLEEGVFVSNEFVLGQAEMLKRGKKILLVGYGNGVGRAYKVYQALITEGYEPSLLDLRFVKPLDKHMLNEVFKTHTHICVFSDSYYMGGVASALLEFMAEENIKDVQLKSFEIKDRFVPHGNTALIEQSLGLDTPHLVSKIKEWI

SEQ ID NO: 83667 - protein, 394 aa, Triticum aestivum
  misc_feature (69)..(69): Xaa can be any naturally occurring amino acid
  misc_feature (260)..(260): Xaa can be any naturally occurring amino acid
  misc_feature (273)..(273): Xaa can be any naturally occurring amino acid
MHWNVVNKVQSYLNCGIHSTSQISFLAKMGVYLSTPKTDKLSEDGENDKLKFGLSSMQGWRASMEDADXMLLITIIIGCHSALLDLDNETAFFGVFDGHGGRVVAKFCAKYLHSQVLKSEAYSSGDLGTAVHKAFFRMDEMMRGQRGWRELSALGDKMNKFSGMIEGLIWSPRGSDSKNAEDDWALEEGPHSDFDGPTCGSTACVALVRNNQLVVANAGDSRCVISRAGQAYNLSRDHKPELVAERERILKAGGFIRMGXRINGSLNLARAIXGDMEFKQNKFLPPEKQIVTSNPDINVVELCNEDDFLVLACDGIWDCMSSQQLVDFIHEHINTESSLSAVCERVLDRCLAPSTMGGDGCDNMTMILVQFKKPVSDKKKADVGEQSAKGKEES

SEQ ID NO: 83668 - protein, 417 aa, Moorella thermoacetica ATCC 39073
MAKLLEYQGKEWLRKAGIPVPAGRAASTPEEARQIAAELGKPVAVKAQVQAGGRGKSGAVKLVNTPEEARAAAASILGTQIKGYPVRQVLVEEKLDIAHEYYVTIIVNSARDARCPMLMFSTEGGMDIESVPEEKIFKLHISPLFGLEVYDAVDLLVKAGIPNDQLMNFANFLVKFWGAYKKYDCFTLETNPLVMTASGDLVAADCKMDVDNSSVYRHPEMGIEIARDLGHEPTELDVIGWGIEKTDLRGSGFVMSMGFDEKSPGYIGYHPIGGGSAMMGMDALNNVNLKPANYADTSGNPVASKIYRVAKVILSQPNIDGYLLGGFMMANQEQWHHAHAVVKVLREILPKKPGLPCVLLLCGNKEEESLAILREGLKDVEGATRVEIYGREHVTDTDFIGQRLLALVKEYQEEKRK

SEQ ID NO: 83669 - protein, 364 aa, Erythrobacter sp. NAP1
MSEGANLPVASAERRAAQAVDALRHGWPLGFEDGPVLLPIETAIASSATAGHVLISAARAATLKLTNQLEAARSDVPHTPILIRGGEPIALPEARAIADPALDLANPLKGPFRAQAIEWADEAVAAMELARIAGILPAFMVDPEQGGEAHHLLASDLAAYTDAGQLDIVTRARLPVSACDTAEIVAFRSNADTREHVALIIGEQSGDREPLVRLHSECLTGDVLGSLKCDCGPQLDAGLHAMARHAREDSGWGVLLYMRQEGRGIGLVNKLRAYRLQDQGFDTVDANQRLGLPDEARDFPVAARMLHLLGARKVRLMTNNPKKVEALTKAGIEVSERVQHQLPDNPHNARYLATKRDRSGHLLT

SEQ ID NO: 83670 - protein, 407 aa, Moorella thermoacetica ATCC 39073
MSIQERALNLHREWQGKIETRPRVQVRNADDLTMAYTPGVAEPCKEIHKDPNLVDVYTRRWNLVAVVSDGSAVLGLGNIGARAAMPVMEGKSVLFKSFAGVDAFPICIDSQDVDEIVRTVQLLTPTFGGVNLEDIAAPRCFEIERRLKETTDIPIFHDDQHGTAVVVLSAIINACKITKRELSDLKVVINGAGAAGIACGKLLVDVGVSDVILCDSKGIICSKRDDLNAIKKEMLQITNKEDRCGTLADAMEGANCFIGLSVKDAVTPEMVRSMDKDSILFAMANPVPEILPDVARAAGAAVVGTGRSDFPNQVNNVLGFPGIFRGALDVKASDINDAMKIAAAHALADLVGDRLSADFVMPEAFDPRVAPAVAMAVARAAIESGVARDPKDPEWVKRHTEELIARQ

SEQ ID NO: 83671 - protein, 525 aa, Saccharomyces cerevisiae
MAAGEQVSNMFDTILVLDFGSQYSHLITRRLREFNIYAEMLPCTQKISELGWTPKGVILSGGPYSVYAEDAPHVDHAIFDLNVPILGICYGMQELAWINGKQVGRGDKREYGPATLKVIDDSNSLFKGMNDSTVWMSHGDKLHGLPTGYKTIATSDNSPYCGIVHETKPIYGIQFHPEVTHSTQGKTLLKNFAVDLCHAKQNWTMENFIDTEINRIRKLVGPTAEVIGAVSGGVDSTVASKLMTEAIGDRFHAILVDNGVLRLNEAANVKKTLVEGLGINLMVVDASEEFLSKLKGVTDPEKKRKIIGNTFIHVFEREAEKIKPRDGKEIQFLLQGTLYPDVIESISFKGPSQTIKTHHNVGGLLENMKLKLIEPLRELFKDEVRHLGELLGIPHDLVWRHPFPGPGIAIRVLGEVTKEQVEIARKADNIYIEEIKKAGLYNQISQAFACLLPVKSVGVMGDQRTYDQVIALRAIETTDFMTADWFPFEHSFLKKVASRIVNEVDGVARVTYDITSKPPATVEWE

SEQ ID NO: 83672 - protein, 305 aa, Enterococcus faecalis V583
MIVQSILDTIGATPLFEFTSEQYPMPEGTKIYAKLEYLNPGGSVKDRLGVHLLKEAMKTGKINQATTIIEPTAGNTGIGLGLAASQLGLKTIFVVPEKFSQEKQQLMQALGAKIVPSPTEQGIVGAITSAQDLAKEIPNSYVPLQFENPDNPAAYYEGLGPEIVQDLGGKITSFVAGLGSGGTFAGVGRYLKEQNSKTQLWGVEPEGSILNGGPAHGHEIEGIGVEFVPPFLKQIPVDGFYTISDEDGFFWVKQLAKKSALLVGSSSGAAFAAALREARRLPAGSTIVTIFPDGSDRYLSKNIYS

SEQ ID NO: 83673 - protein, 312 aa, Triticum aestivum
PCRSRRASPVEAAAAVGDPAAPAALVGPSLHVLTALSDQNNKRIVLALQSGLKSEILWALNALTVLSFKEKDDLRRDTTPLAKVPGLLDALLQVIDDWRDIAMPRDHTKPPRVRTLGVNTTISGFGLENVGKVYSDSTTPPNDQSKIESSTITKKRSAGFLFDEDGLFNIDDEGRTERQQCAVAASNIIRNFSFMPENETIMVQHRHCLETIFQCLEDQNAEDDELITNMLEALVNLAPVLDLRILSSSKPSYIKMTEKSAVHAIMGMLSSSIKAWHCAAAELIGRLIINPDNESFLVPVISQIYREIGLIC

SEQ ID NO: 83674 - protein, 250 aa, Candida glycerinogenes
MASTFFVGGNFKMNGSKASIKTIVENINNSSIPSNVEVVLCPPAPYLSYTADLNKQANVQVGAQNCYPKASGAFTGEVSPLAVKDSGAEWVITGHSERRQYFNESDEFVAEKTKFAIDQGLKVILCIGESIDEKKAGKTLDVCKRELSAVIKAVAPEDWPPLSLPYEPVWAIGTGLAATAQDAQDIHAEIRKYLASQLGESTAQAVRILYGGSANGKDAPEFKDKADVDGFLVGGASLKPEFVDIIKSRT

SEQ ID NO: 83675 - protein, 122 aa, Shewanella oneidensis MR-1
MSITKDQILEAFAAMSVMEVVELIEAMEEKFGVSAAAAVVSGGGEAAAAVEEQTEFNVILTAHGDNKVAVIKAIRGATGLGLKEAKAMSEAAPVAVKEGVSKEEAEALKKELVEAGASVEIK

SEQ ID NO: 83676 - protein, 391 aa, Shewanella sp. MR-7
MAIINMSDLDLQGKRVLIREDLNVPVSNGVVTSDARLRASLPTIELALAKGAAVMVMSHLGRPTEGEYNSEFSMQPVVDYLAKALSCTVRLATDYLDGVEVAVGEVVVFENVRFNKGEKKNDEALSKKMAALCDVYVMDAFGTAHRAEASTNGVGLHAPIACAGPLLAQELEALGKALDNPARPLVAIVGGSKVSTKLTVLESLSGIVDQLVVGGGIANTFIAAAGHNVGKSLYEADLIDEAKRLVANAQSRGGDIPVPTDVVVAGEFSPTAAATLKAVNEVGDSDMIFDIGPDSAEALAKIIESAGTIVWNGPVGVFEFDQFGEGTKRIAQAIADSKAFSIAGGGDTLAAVDKYDIADKVSYISTGGGAFLEFLEGKELPAVAMLKQRGA

SEQ ID NO: 83677 - protein, 1424 aa, delta proteobacterium MLMS-1
MTEDTSKQVCKPAAIDSDALRANLQETAVDCIELPAKWGILLEVVADYKGIHATLEELLYEIAHPYRNWRLILPRYRSFVLKHLDHYRRHPRGPEACLRLLEILLLALAENQRQETLLLQSAEVLAALFDKLVSIIKPADLPTFHQTLQESCNRLAELDEELLRPLVAGQHSLKKTIGRLVSKCDGESEVKICELTAPARLLKRVLILNYRNWLAEEDPQPWFASECEEICQGWEAGQLFAEISHDRLRQHLATAEATDCEHDELALPKLLELPDHMDIVRLYREIPDRLSSRPGQPQETESDDRFAENRKLLFLFRIMDTGGLALIHEETLREINRGLVQLIRRQTFEEIERFLLTTLALLKSNVRRYPHTSLQCIQIIGTEVFRRGNSRLVETFLWEAVRFGFQYANVTGIGEDWQPLANPAHLANIRVWLNLIGQEPKWCSTLFSALIINLKLSGTCLKDTDLFQRDISELLNQPIEPVYNLVTQFAKQVPVFYNDIGAEGTLREVSTEMDEIHQRRDKLIHFLRKQSHVESSNLIVDFIESIILFWRDRDKNVLAPYLPEEVLREIAPEGEYVDDLHRLSKRIWALNHIHRPTDLLNWDYNQRRHYLEAQEDIPAGERRRFDLLVRMYRLCHQKYNLGTEELRQHLKQAAAGDFPEMEQLLADLEICDTFECLSALLEHLERLKEIILSEERFTAQESIYHKRHIAIDIPSVYGRYQERKFDALSLTFRLENLANTYLEKLPETVNLNIITKATFIRILKCLRLYLRALKIDGITSRKLTTYMSLLSNSLGIKRFSYTQFLDIFRGLSEGVKDVIYTYYTNIHENNLSIIIPQIGHDNLLPKYRYLWRGQDPVGNVNRLSESFMRDLIAGTFGLQHLDNFITRIHQTLEAQREVLDEDHLDLLMTYNPDRAISPLQPRHSRNANLILLGNKGYNLSLLAIDGQPVPPGLTVTTEVFRCWPVIRQFTKCRDDFMTRLRFGLNQIEERTGRRFGDPAAPLLLSVRSGAAISMPGMMATIHNVGLNEDIVGEFACQEGRGFLAWDNFRRFIQSWAMAQGVERERFQGLMNAAKERCNVRYKRDFTAEQIRELTLEYQKTARSLGIGIPEDPWLQLTGAVEMVISSWNTPKTRDYRQIMDISDDWGTAVIIQTMVYGNLGVESGSGVLFTAHPYRKVSRVALWGDYAVGDQGEDIVSGLVTTEPISVEQAELDGREVENTLELRFPEIYQQLLSISRHLVYDKRWNAQEIEFTFEGPRTEDLYLLQTRDMITIKKKESFNVFADADTAEAAVTAHGVGVSGSAISGLVVFNAEDIARLRAERPEAQLILIRQDTVPDDIKEIAAADGLLTARGGQTSHAAVVATRLEKTCVVGCSQLKVFETEQRCEINGFTFQCGDHLSIDGRKGLVLQGDHPTRKEMQILPL

SEQ ID NO: 83678 - protein, 294 aa, Sulfolobus solfataricus P2
MIIMIIIGGSATNGIDESLSKILSIPLVKVENKIFPDGESYIRVPSSIRDEEVLLVQTTDYPQDKHLIELFLIAETIRDLGAKKLTAIVPYLAYSRQDRRFKDGEAISIKTILHILSEVGVNTLVVVEPHKPEELSYFKGELKIVHPYHQIARKIKEIIEDPFILAPDRGALDRARKIAEEINAPYSYIEKERDRTTGEVRIKEAPNINLKGKDVVIIDDIISTGGTIVQATRLAYSLGAKSVTAAAIHLLLVGGAKERLREVGVKTLIGTNTINVNDKDIITIDVSQSIALSL

SEQ ID NO: 83679 - protein, 338 aa, Shewanella sp. MR-7
MIRVAINGYGRIGRSILRALYESGKRQQIQIVAINELAKPEAIVHLTQYDTTHGRFQPRVKLVDDQMLIGDDVIKILHEPDPAKLPWREMDIDIVYEATGAILDRNSCEAHIHAGAKQVLISHPSSADVDGTIVYGVNQDLLRAEHTVVSNASCTTNCIVPVIDVLDKHFGVKSGAITTIHSAMNDQQVIDAYHDDLRRTRAAGQSIIPVDTKLARGIERILPHMKDKFEAISVRVPTINVTAIDLSVTLDKTVDIATVNQVLELAANGRFNGILGYTDEPLVSCDFNHDPRSSIVDGTQTRVSAGQLVKLLLWCDNEWGFANRMLDTSLAMIAAKQS

SEQ ID NO: 83680 - protein, 262 aa, Brassica napus
MSQQEQPRRPQEPVKYGDVFEVSGELADKTVAPEDANMMQAAETRVFGHTQKGGTAAVMQSAATANKRGGFVQQGDATDVAAEHGVTVAQTDVPGARVTTEFVGGQVVGQYVEPMPVGTTAATDAETLGLSLQSAITIGEALEAAVQTAGNKPVDQSDAAAIQAAEVRASGTSVIAPGGIAASARSAANHNATVDRDEDKIKLVDVLAGATGKLQADKAVTRQDAEGVVSAELRNNPYLTIHPGGVAASVTAAARLNEKADI

SEQ ID NO: 83681 - protein, 334 aa, delta proteobacterium MLMS-1
MGIKVAINGFGRIGRSIFRAIELDPTFKEIEIVAINDLTPPATLAHLLKYDSVMGIYPHEVKAGDGEIRVDDHPVRVYNQRDPKELPWGELGVEYVIEATGLFTDSDKAQAHLDAGAKKVVISAPAKGQVKTIVMGVNEEDYDPATDHIVSNASCTTNCLAPVAKVIVERFGIKSGLMTTVHAYTGDQRLLDFPHNDLRRARAAAMSMIPNKTGAAAAVALVLPELKGKFDGLAVRVPTPNVSLVDVVMELEQETTVTEVNEALKQATNRYLGYSEEPLVSIDYQGDPRSSVVDAISTKVLGSTVKILSWYDNEWGYSNRVLDLILHMEENRTL

SEQ ID NO: 83682 - protein, 343 aa, Zea mays
MGLLIPARPEQCTLSRIVSLITVGVVIVVCTYVTSSPAGGDAGKEEFFSIWHRRSSDFVPDDLEVALRGAAYANRTLILTMLNKAYSEEGGLLDLFLESLREGDGTEQLIDHVLFVAMDQQAFRRCRSLGGLKCYLLRPTDSADDLSSEQIYMSDGFIRMMWRRIRFLGDVLKHGYSFVFTDMDVMWLRNPFPKLDRGEGEDLLISADKFNGMPHDYAGNELNTGFFFVVSNDRTVALFDEWHAARQVSAGMKEQDVLNRMKRRGAFRRLRVGARVLDTARFSGFCQDSRDAAQVATVHANCCRTKRAKVADLKAVLRAAEGLNRTRMEIKWPAHSECVKSWL

SEQ ID NO: 83683 - protein, 492 aa, Rhodococcus sp. RHA1
MTTTESVPGVTEVRHLIGGDWAAASDGATFETRDPHDGSLLATVPRGTADDGEAAITAARTAFDDGPWPRMSPKERAKILHAVADKVDEHREELALIETRDGGKSINQSLHAEIPRVAHNLRFFADYVSMAANEAYPDGDLLSYVLYPPAGVVSAISPWNAPLMLATWKIAPALAFGNTTVLKPAPQTPLTAHRFAQLALEAGLPEGVLNVVHGFGGEAVAGPLTADPRVDRITFTGSSATGVRILQAAAVNHTPVSAEMGGKSANIVFGDADLDVAVPMSIRAIFGGNGQVCLSGSRLLVQNSIMGEFLDRFTEEAKKLTVGDPKDPSNFLGPLIEQRHLEKVHGYVELAQEEGGKVVTGGSRLTDDARAKGFYYPPTVITGLTNDSRTAREEIFGPVETVLGFDTEDEALRIANDSPYGLAGILFTDNLNRAHRMAARWKAGTVWINTFFERDLRLPFGGEGSSGLGREGGQYSREFFTEPRAVTIRLRS

SEQ ID NO: 83684 - protein, 237 aa, Triticum aestivum
  misc_feature (226)..(226): Xaa can be any naturally occurring amino acid
HRHHSATRSRGPRARERGERGADRPAMRKTAVGSASAGAGWPCGLNLNVVFLLSMVATNLLSLYHLSIRASPTTPALQSGSDFDQQQVLQQLSAIRATVSHLRSATPPPPPELVLYSRLAPVASACSAHPDLLHRFMSYVPFAACPDDVHTLAEPLILRGCHPLPRRRCFSPTPDAGSVQLPTDPFAPLPDSAVRWPTDAKKCRSFSCLPASLGFDVARTEAGQFXRVAGPLDLTVP

SEQ ID NO: 83685 - protein, 466 aa, Burkholderia thailandensis E264
MSDTKTTTLLVIGGGPGGYVAAIRAGQLGVRTILVERDRLGGTCLNIGCIPSKALIHAAGEFDKVRGFAGDSPLGIRTEAPAIDIARTVAWKDGIVKKLTGGVGALLKKNGVEVVHGDARVVDGKTVEVDMGDGARMRIECEHLLLAAGSEPVELPAMPFGGNVISSTEALSPRVLPKRLVVVGAGYIGLELGIAYRKLGVDVTVVEARERILPIYDAELTKPVAASLKRLGVRVHLGHEVLGLNARGDAVRVRDDRHEQTELAADQVLVTVGRRPRTQGWGLETLQLDRAGAALKIDDACRTSMRNVWAIGDLTGEPMLAHRAMAQGEMVAEIVAGKKRHFVPAAIAAICFTDPEVVSAGLAPDEAERAFGECLSASFPFAANGRALTLEGADGFVRVVARRDDHLIVGWQAVGVGVSELAAAFSQSLEMGARLEDVGGTIHAHPTLGEAVMEAALRALGHALHI

SEQ ID NO: 83686 - protein, 466 aa, Xylella fastidiosa 9a5c
MNQGKIVQIIGAIVDVEFPRNNVPKVYNALKIDGTAIILEVQQQLGDGIVRTIALGSTDGLKRNLIATDTGHAITVPVGTGTLGRIMDVLGNPIDEAGPITYTDQWEIHRNAPSYEDQASTTELLETGIKVIDLMCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDSSGKGKDVLLFIDNIYRYTLAGTEVSALLGRMPSAVGYQPTLAEEMGVLQERITSTANGSITSIQAVYVPADDLTDPSPATTFGHLDSTVTLSRSIAALGIYPAVDPLDSSSRQMDPLIIGEEHYNTTQRVQQTLQKYKDLKDIIAILGMDELSEDDKLAVSRARKIERFFSQPFHVAEVFTGAPGKYVPLKETIRGFKAIVDGEYDHLPEQAFYMVGNIEEVIEKANKMTA

SEQ ID NO: 83687 - protein, 354 aa, Burkholderia sp. 383
MKAAVWHGRHDIRVEQVPVPERPPAGWVTIRVHWCGICGSDLHEYVAGPVFIPVDAPHPLTGLKGQCILGHEFSGEIAELGAGVTGFAVGDRVTADACQHCGTCWYCKHGLYNICENLAFTGLMNNGAFAEYVNVPAELLYKLPDDFPTEAGALIEPLAVGLHAVKKAGNIVGQTVVVVGAGTIGLCTIMCAKAAGAGRVIALEMSAARKQKALEVGASVVIDPKTSDAIAEVKALTGGYGADVSFECIGHTTTAKLAIDVIRKAGKSVMVGIFEEPAPFNFFDIVSTEKEVIGSLAYNGEFADVIRFIADGRIDVQPLITGRIALGDIVSHGFEELVNHKERNVKIIVQPALA

SEQ ID NO: 83688 - protein, 176 aa, Parvularcula bermudensis HTCC2503
MDITKIAAGKDVPKDINVIIEVPLGGEPIKYEIDKDSGAMMVDRFLYTSMRYPCNYGFVPHTLSGDGDPVDVMCLGQRPLVPGAVLRARPIGVLLMEDEAGVDEKILAAPHQKLTRFYDNIETYEDVQPILLERIWHFFEHYKDLEPNKFVKVREWQSKEMAEQLISQGLENAKKG

SEQ ID NO: 83689 - protein, 411 aa, Saccharomyces cerevisiae YJM789
MSSAPTKATFCIQNGPSFEGISFGANKSVAGETVFTTSLVGYPESMTDPSYRGQILVFTQPLIGNYGVPSGEARDEYNLLKYFESPHIHVVGIVVAEYAYQYSHWTAVESLAQWCQREGVAAITGVDTRELVQYLREQGSSLGRITLADHDPVPYVNPMKTNLVAQVTTKKPFHVSALPGKAKANVALIDCGVKENIIRCLVKRGANVTVFPYDYRIQDVASEFDGIFLSNGPGNPELCQATISNVRELLNNPVYDCIPIFGICLGHQLLALASGASTHKLKYGNRAHNIPAMDLTTGQCHITSQNHGYAVDPETLPKDQWKPYFVNLNDKSNEGMIHLQRPIFSTQFHPEAKGGPLDTAILFDKFFDNIEKYQLQSQAKSSISLKVTYSTDKSRLQSINVTKLAKERVLF

SEQ ID NO: 83690 - protein, 196 aa, Azospirillum brasilense
MLLLIDNYDSFTYNLVHYLGELGAELDVRRNDSLTVEEAMALRPEGIVLSPGPCDPDKAGICLPLIDAAAKAAVPLMGVCLGHQAIGQPFGGTVVRAPVPMHGKVDRMFHQGRGVLKDLPSPFRATRYHSLIVERATLPACLEVTGETEDGLIMALSHRELPIHGVQFHPESIESEHGHKILENFLNTTRRLETAA

SEQ ID NO: 83691 - protein, 401 aa, Helicobacter hepaticus ATCC 51449
MLIVQKYGGTSMGDCDRIHNVAKRVIKSKAQGHKLVVVVSAMGGETDRLINFTQHFTPLPNTREVDMALSAGERVSAALLAIALESMGVKAISLSGRGAGIITDEFHTKARISYIDTTKIFHLLNEDYVVVVAGFQGISQQGEVTTLGRGGSDLSAVALAGALNATVCEIYSDVDGIYTTDPRIVKNARKLEKISYDEMLELASMGAKVLLNRSVELAKKLNVNLICASSFSEAQGTLITKEEDIMEKPVVSGVALDKNQARVSLADVQDRPGIAADIFGLLADNNINVDMIVQTIGRDGKTDIDFTIPKTEVTLTQQVLEKFKDDLGNIEYDNNIAKVSIVGVGMKSHSGVASTAFKALAQDDINIMMISTSEIKISMIINAQFAELAVCKLHSVYELDK

SEQ ID NO: 83692 - protein, 316 aa, Bacillus licheniformis ATCC 14580
MSKYEDDNLKIFSLNSNPGLAKEIADIVGVELGKSSVKRFSDGEVQINIEESIRGCDCYVIQSTSAPVNEHIMELLIMVDALKRASAKTINIVMPYYGYARQDRKARSREPITAKLVANLLETAGATRVIALDLHAPQIQGFFDIPIDHLMGVPILGNYFEEKNFKDIVIVSPDHGGVTRARKLADRLKAPIAIIDKRRPKPNVAEVMNIIGHIEGKTAILIDDIIDTAGTITLAANALVESGAEEVYACCTHPVLSGPAIERIDNSKIKELVVTNSIELPEEKKIAKFKQLSVAPLLAEAIIRVHEKQSVSFLFD

SEQ ID NO: 83693 - protein, 122 aa, Moorella thermoacetica ATCC 39073
MGQDKIILAGLEFYGFHGNHPAEQQLGQPFIVDLELYLDLEPAGRTDALEATVNYGQVYRLVQEIVTGRPYKLLEALAAAISDGILAGFPVDEVLVRVKKPRAPLPGSFDYAAVEIRRRRKE

SEQ ID NO: 83694 - protein, 654 aa, Oryza sativa
  misc_feature (47)..(47): Xaa can be any naturally occurring amino acid
MGGGVEERKVVDLEDGDGEEGEDAAAVAAGSSRETRMLPRMPVRVLXLAEGDDSTRHIICALLRKCGYRVAAASDGVKAWDILKEKSFNIDLVLTEVELPLMSGFLLLSTIMEHDACKNIPVIMMSSNDSVSMVFKCMLKGAADFLVKPIRKNELRNLWQHVWRKQLSSGVLDVQHTQQEDNLTERHEQKTGVTKAEHVTENVVHKNMECSEQESDAQSSCTRSELEADSRQTNNLLEYKQPMGRHFSKPDHKNTEKNGGTKIHASNDGNLIPRREEDASLRRMTCSNDINCEKASRDMELVHIIDNQQKNNTHMEMDVARANSRGNDDKCFSIPAHQLELSLRRSDYSRLESQEKNERRTLNHSTSSPFSLYNCRTASSTINAGDAQACSTSATHIDLENKNGDSKTPSQDKRETNQPPIRVVPFPVPVGGLTFDGQPFWNGAPVASLFYPQSAPPIWNSKTSTWQDATTQAISLQQNGPKDTDTKQVENVEEQTARSHLSANRKHLRIEIPTDEPRHVSPTTGESGSSTVLDSARKTLSGSVCDSSSNHMIAPTESSNVVPENPDGLRHLSQREAALNKFRLKRKDRCFEKKLPNRSLLIPFLFDDEPAERRRSGKLVRAYGDDRRAALASPAGGAPEGDAKPCHDVRGLAR

SEQ ID NO: 83695 - protein, 387 aa, Enterococcus faecalis V583
MEFLGILCLILITTTLAGVACKRVGIPAVIGQLLVGIVLGPAMLNIVHQDVFVHDFSEIGVIMLMFIAGMECELELLKKYAKPSVMVAILGIVLPVGFTMLIGQLFAFSWKEAFFLGLVLAATSVSISVEVLRELNVLSSKEGATILGASVVDDIVVVIILSVAVGMIGASTGGNTEVSFIVKLIEQGLFFIGIFFLVRFIAPYLLRLSQKMNIGSSVIIMSLIICLGMAYLADLVGLSSVVGAFFAGIAVGQTDAKTEIDFNIEAIGYAVFIPVFFASIGLSVTFNTLGKDLPFILVMTIMAILTKLLGGAWGAKMVGFSNTSSLMVGAGMVSRGEMALIIAQIGYQSKLLSEAYYTSMIVVIILTTLVAPFLLKYFVKKQESALQ

SEQ ID NO: 83696 - protein, 557 aa, Physcomitrella patens subsp. patens
MADQTTSAVGHGGRTVPGMSMHGVTGKEPVYAFSVIQGTVEDPDAEKFALPVDSEHKAKTIRVYSFAKPHMRAFHLAWVSFFTCFLATFASPPLMPIIRDNLNLTKTDVGHAAIASVSGNCSFVYAGSILSRLLMGTVCDVVGPRYGCAFLIMIISPAVYSMALVSDAASFIIVRFFTGFALATFVSCQFWMSSMFNSKIVGTANGLAAGWGNLGGGATQLIMPLVFALIRDSFNSTPFVAWRLAFFLPGAMQTIMGLLVLFLGQDLPDGNYSQLQKQGVKVKDSFLKVLMYAITNYRTWVFFLLYGFTFGVELTVNNNIAEYFYDRFDLNLSTAGIIASLFGLMNFFARPSGGIISDTVARRFGMKGRLCTLWICHSLGAVFCIVLGRMDSLTAAIAVLIVFAVFIQASSGAVFGIIPFISRRSLGVISGFTGAGGNVGSVVLQTVFFTSGSYRTEEGIQFMGVMVICVAALTVFIYFPQWGGIFFPPSKSTEEDYYASEWSAEEQEQGKHATSMKFASNARSERGKRGLNSPDLTIHPVTDSKATPVSDVELNKV

SEQ ID NO: 83697 - protein, 196 aa, Methanothermobacter marburgensis str. Marburg
MNKLILIIDNYDSFTHNLYQMAGEIMMEMDSADIMVVRNDEVDIDYVRGLDPERIIISPGPGNPIKREDFGICSEVIGEFTDRPILGVCLGHQGIFHYFGGVVGYGEPVHGKISEVFHDGSELFRGVPNPFRATRYHSLRCECSGVPEDILVSASAPDGTIMAIRHRQYPVYGLQFHPESAGTPHGRDILENFLRM

SEQ ID NO: 83698 - protein, 294 aa, Hordeum vulgare subsp. vulgare
MAMASSTTASIAAASLRALAGASPAPLRKPFLVLLSPALPRRLGLGLRAARPRGPLAPLAASDSFETSAAVDVAEPEDEALEAVAEEEPAVAVAEEEFDVAAEEEVGEYVEPPEEAKVYVGNLPYDVDSERLAQLFEQAGVVEVSEVIYNRETDQSRGFGFVTMSTIEEAEKAVEMFHRYDVNGRLLTVNKAAPRGARVERPPRDSGSSFRIYVGNLPWQVDDSRLVELFSEHGKVVDAKVVYDRDTGRSRGFGFVTMASQEELDDAIAALDGQSLEGRALRVNVAEERPPRRF

SEQ ID NO: 83699 - protein, 765 aa, Phycomyces blakesleeanus
MATLLIDNYDSFTYNVYQYLCSQGADVVVYRNDKITVDEIVKLNPVNIVISPGPGHPSHDAGVSRDVISYFAGKLPILGICMGEQCIFEVFGGTVSYAGDILHGKTSTIKHDNRGLFKNVPQDNQVTRYHSLAGMPSTLPEVLEVTATTDDGVIMGVRHKKYTVEGVQFHPESILCEHGHTMISNFLSLRGGNWDENPAAGVLAQKVPAAATEKAAQEASPAISTPPTCSTILSRIYAQRVKDVQAAKEVPGQSQADLQKLLNLHIAPPLRDVVNRLKESSPALMAEVKRASPSKGNIDITVNAAEQALQYALAGASVISVLTEPKWFRGSLNDLRQVREACPLLPNRPCILRKTFLLDTYQILEARLYGADTVLLIVAMMSDEDLRELYQYSVSLGMEPLVEVNNAEEMARANAVGAKLIGVNNRGLHSFDVDMETTSRLAEMVPEGTILCALSGISTRADVETYVSQGVHGLLVGEALMRAWNLKEFVAELLGYKKKDPVPHTPVSRQVQVKICGISSVEAAVEAATAGADLVGLIFAEKSKRQVTVAKAREIVDALHKLPTRSSQLPVKSQKSIDWFDVQTEMVEQRVPWRPLVVGVFVNQSIEYMSQVAVEAGLDLIQLHGTESAEIARFLPVPVIKAFHMDASSFHAGQIPYVTQPGNNQLLLLDAKVPSLPMDRQGGLGQKFDWTIAQDIVNVKRPGCSKEQTFPVILAGGLDPSNISEAIQQVRPWAVDVSSGVETDGKKDLKKIRAFVEKAKSINLQ

SEQ ID NO: 83700 - protein, 500 aa, Streptococcus pyogenes MGAS10394
MNKRVKIVATLGPAVEIRGGKKYGEDGYWAGQLDVEESAKKIAELIEAGANVFRFNFSHGDHKEQGDRMATVRLAEEIARQKVGFLLDTKGPEMRTELFADDAKEFSYVTGEKIRVATTQGIQSTRDVIALNVAGSLDIYDEVEVGHTILIDDGKLGLKVIDKDIATRQFIVEVENDGIIAKQKGVNIPNTKIPFPALAERDNADIRFGLEQGLNFIAISFVRTAKDVEEVREICRETGNDHVQLFAKIENQQGIDNLDEIIEAADGIMIARGDMGIEVPFEMVPVFQKMIITKVNAAGKAVITATNMLETMTEKPRATRSEVSDVFNAVIDGTDATMLSGESANGKYPVESVRTMATIDRNAQTLLNEYGRLDSSAFPRTNKTDVIASAVKDATHSMDIKLVVTITETGNTARAISKFRPDADILAVTFDEKVQRALMINWGVIPVLAEKPASTDDMFEVAERVAVEAGLVQSGDNIVIVAGVPVGSGGTNTMRVRTVK

SEQ ID NO: 83701 - protein, 399 aa, uncultured archaeon
MFFFIWEESVKMLSKRLSRIEESATIKMGQIAKKLQEEGKEVLSFTLGEPDFKTPEHICEAAKHALDLGYTHYTSSAGIDELREKIAKKTTEENKVDCAMENVIVTPGAKQAIYELMMSVLDYGDEVILLDPAWVTFEAAVKLAGGTPKWVKRIEEEVKYESLEAASSENTKLIVINSPNNPAGYVLSENELKEIAEFAVEHDLLVLSDEIYEKILYGRRHISIASFDSMQERTVIINGLSKTYAMTGWRIGYAVAPTAIQKGMLKIQQHSVSCASSIAQYAALAAFEESQECVNEMVAEFERRRDVIVKRLNNVGLRCLDPEGAFYAFVNTSNYGNGAEFTERLLKDAYVVVTPGSAFGAAGKDYIRFSFAASMENILAGMDRIEAMCTLPSSSKYSR

SEQ ID NO: 83702 - protein, 416 aa, Dechloromonas aromatica RCB
MIFTLGINHHSAPLAIRERVAFGADKLPHALADLTRERPVREVAILSTCNRTEIYCSAESPDVVIDWLAHYHQVGREEIAPYIYTHDQPEAIRHAFRVASGLDSMVIGEPQILGQMKDAVRAAEENGTLGTQLHKLFQRSFSVAKEVRSTTAIGANIVSMAAAGVHLAERIFESIAGQRILFIGAGEMIELCAAHFCAGKPKQVTIANRTLERGRALAEQYGGTAIRLDELGEHLAQHDIVVSCTASPLPIIGLGMVERAIKTRRHRPIFMVDLAVPRDIEEEVGELDDVFLYTVDDLAQVVESGLESRQAAVVEAEDIIANRVKDFLGWLESRDTVPVIRSLRDSAERMRRHEIEHAMKLLAKGEAPEKVLEHLSHRLTNKFLHAPTQTLNSAEGGERADLQGAAARLFHLHAAD

SEQ ID NO: 83703 - protein, 764 aa, Sulfolobus solfataricus P2
MQSVKGLRRDLRKMSFIDLPLIVGLSLVSILIRSLSANWPLAVNEFDPWYLFYNALLIAQVHGNWYAVPPDVLGWFPWGYFIELGNTIGLPFLVALASLPFYGTYGANAVYTVAIFSDILLAGLGVIASYLSIESITNSRLAGYMAAAIIAVSPALTYKNLLGGLPKTSWGAVFILFAIFLLNQGLKKKNIWYGIPAGIVLFLAEISWGGYTYIDLSLLVAAFLLILLNRNDEITANLYTIMVVVTSFLTSLAPNNIGFMSGLAHGFSLLLISAVLYLDLYLSRTLPKEIVDSRNLIVIAVLIFILTLGLSGLSILRPTSAPIPSRYYAIINPFYQVTVPIDKTVAEYIPQPITAMIQDFGIALFLSVIGMYYLIRRGNLVGLWLLVLGVASIFGTSEQPYLFNYTAYMVATLGGLGVYYISDNLLKGVKNGNGNKILVGFILALVGISLVADAGLATLASNEPPAITNAATSFLTTNYSWVSAANWIRTHSPQNAFVLSWWDYGYWLEVLTNRSVIDENNTLNGTQIRLMAEMFLNNETFAANVLENDFHLYPYGSPNYTIPVYIVAYDAVTFVYAGSQAQWYVGYPPSFPGAFFGYTTSLGDIGKAMGAMTTIAGYPLDEYVNLTEINNTITQIINTYATTNPTIAQTLASQVSQAEPFAWTPKAYNSLIVQMFIESLYQIGYGQPIAPFTTQIVPTSSGYTITGSPLPRVQLMYFQPAYIALFPVGNGGAGGLYYTVYIMVMVYQFTQPGTVLKPTVMVNS

SEQ ID NO: 83704 - protein, 175 aa, Glycine max
  misc_feature (84)..(84): Xaa can be any naturally occurring amino acid
ASSMISSPAVTTVNRAGARMVAPFSALKNMDGFPTTNTNNDITSIGINGGTPQCMQEWPTLGYKKYDTLSYLPDLDDALLTKEXKYLLKNGWIPCLEFQLEHGFAYRDHDRSPRYYDGRYWTMRNLPMFGCTDAYHVIKDLQEVNTVYPNGFIRIIEFNNFLQEQRISFIAYKTP

SEQ ID NO: 83705 - protein, 193 aa, Oryza sativa Japonica Group
MTKDGSVMEHGEISSKAPLVAPVAAGVNRAVAVVDTFLRFIAIIGTIGSAIAMGTTNETLPFFTQFIQFEAKYSDLPSFTFFVAANAVVCTYLVLSIPLSIVHILRPRARYSRLFLVFFDTAMLALLTAGASAAAAIVYLAHKGNVRANWFSICQQFDSFCERISGSLIGSFAAMVLLVVLITLSAFALARRH

SEQ ID NO: 83706 - protein, 250 aa, Triticum aestivum
  misc_feature (121)..(121): Xaa can be any naturally occurring amino acid
SGGKIDVTSHFKSSKSSKKEKSVMKLVGETGVQQRSSLLGDLGTSKKHATGKRSSALISGMENASESGTRSRSFGHKQPIPSQLTESQGTASFPVNNSPDSLKPSLLKLKFKRPTFGAAKXQVSQPEEPATWASQQEDLNVAKGQRSKRKRPSTDKMDGSEGSTPSKRHGQSTGDEAMDATWILRKLGNDAIGKRIEIQLASDGKWHQGVVSNVISGMLCVQLDNGSSENLELGKQAVRLIAQRSKGGKR

SEQ ID NO: 83707 - protein, 193 aa, Triticum aestivum
KKPGCLLLSKLYTYIVQPWPPTLMASSATSVVLFQGVKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATRVINEVEEVKKEYPDAYVRIIGFDNMRQVQCVSFIAFKPPGCEESGKA

SEQ ID NO: 83708 - protein, 634 aa, Burkholderia thailandensis E264
MYDLLKTIDDPADLRRLDRRQLQPLADELRAFVLDSVSKTGGHLSSNLGTVELTIALHYVFNTPDDRIVWDVGHQTYPHKILTGRRDGMKTLRQFDGISGFPRRSESEYDTFGTAHSSTSISAALGMAIGSKLNGDDRFSIAVIGDGAMTAGMAFEAMNNAGVSEDAKLLVILNDNDMSISPPVGALNRHLARLMSGRFYAAARAGVERVLSVAPPVLELARKLEEHAKGMVVPATLFEEFGFNYIGPIDGHDLDSLIPTLQNIKELRGPQFLHVVTKKGQGYKLAEADPVLYHGPGKFNPAEGIKPSATPAKKTYTQVFGEWLCDAAELDARVVGITPAMREGSGMVEFEKRFPERYYDVGIAEQHAVTFAGGLATEGLKPVVAIYSTFLQRAYDQLIHDVALQNLPVVFAIDRAGLVGADGATHAGAYDLAFLRCIPNMTVMAASDENECRQMLHTALQQPNPTAVRYPRGAGTGVATVKAFTEIPLGKGEVRRRTSQPDGKRVAILAFGTMVAPSLAAADALDATVANMRFVKPIDAELVRELAQTHDYLVTVEEGCVMGGAGSACVEAMMEGGAVRPVLQLGLPDRFVDHGDPAKLLAMCGLDGDGIAKSIRERFLNHAANVASPAKRVA

SEQ ID NO: 83709 - protein, 511 aa, Saccharomyces cerevisiae YJM789
MAYVLTETSAGYALLKASDKKIYKSSSLIQDLDSSDKVLKEFKIAAFSKFNSAANALEEANSIIEGKVSSQLEKLLEEIKKDKKSTLIVSETKLANAINKLGLNFNVVSDAVTLDIYRAIKEYLPELLPGMSDNDLSKMSLGLAHSIGRHKLKFSADKVDVMIIQAIALLDDLDKELNTYAMRCKEWYGWHFPELAKIVTDSVAYARIILTMGIRSKASETDLSEILPEEIEERVKTAAEVSMGTEITQTDLDNINALAEQIVEFAAYREQLSNYLSARMKAIAPNLTQLVGELVGARLIAHSGSLISLAKSPASTIQILGAEKALFRALKTKHDTPKYGLLYHASLVGQATGKNKGKIARVLAAKAAVSLRYDALAEDRDDSGDIGLESRAKVENRLSQLEGRDLRTTPKVVREAKKVEMTEARAYNADADTAKAASDSESDSDDEEEEKKEKKEKKEKKRKRDDDEDSKDSKKAKKEKKDKKEKKEKKEKKEKKEKKEKKSKKEKKEKK

SEQ ID NO: 83710 - protein, 123 aa, Zea mays
RPDLVLPIPFEADDKGYAFTLKDGSLYSFRFPFTVSNNIVSGLKYTNTVWKTGVRVENQKMMLGTFSPQLEPYVYEGEEETTPAGIFARGSYSAKLKFFDDDGKCYLETSYYFEIRKEWPATQ

SEQ ID NO: 83711 - protein, 549 aa, Candidatus Kuenenia stuttgartiensis
MLNKINPIKTKSWNSLAEHFKDIQHIHMKTLFAKDPDRFKKFSIRFNDILVDYSKNIITDETLRHLIALARETGLEDAIEKMFSGNAINETENRAVLHTALRNRENTPIYADGKNVMPQVNAVLKKMEAFSRNVISGEWKGFSGRKITDIVNIGIGGSDLGPVMVTECLRPYAKKGLSVHFVSNIDGTHIVETLKTLNPETTLFMIASKTFTTQETMTNAFSAREWFLQCAKDHAHVARHFVAISTNTEKVEAFGIHRDNMFVFWDWVGGRYSLWSAIGLSIACFIGYENFSELLHGAFEMDNHFRTAPFEKNIPVILALIGIWYNNFFGAQTEAILPYDQYMHRFPAYFQQGNMESNGKSTDRSGDKVNYQTGPVIWGEPGTNGQHAFYQLIHQGTKLIPADFLAPAISHNPLGEHHNILLSNFFAQTEALLKGKTRDEVLEELKKECKSDNEIQRLAPHKVFEGNRPTNSILFKKLTPTVLGSLIALYEHKIFVQGVIWNIFSFDQWGVELGKQLAKKILPELTDNKPIATHDSSTNGLINAYKEMR

SEQ ID NO: 83712 - protein, 437 aa, Magnaporthe grisea 70-15
MSEKKRKRTEDGSSQKTSKKAAIDDVVSSSALPQNIKVSSLVRPKLSPPVIATAPGLSVSPSVQFNPYTKLRKASSKSRNAPVLGDILLHSSSHRSLDYTAREEQSQNGEGFLRHYIGVFDPKTGELEVVEARKVTVRGSVRSQQAPAEAMSAIESKTNMDMRTDLGQAFGTKKAKKALVSKVENAITAINNASSRDSGAGEAALMASIKTAAANMPTRDELQAAVDGAKPVPKGNYDAAEIQDVYDPDQIIGSDVLNAIPVRDWQTANKNDENVQLTSRYVANRLPRVGEHAESLKRLRILRYLYFLMTFIKIAKPGKNGVRKLPPRDKLREALSPAPDVVLDSLRHKFADGTQMRKIHADLIMTTCCVLASIIDSFEVDTFDLREDLQLEQKQLNSYFAEIGARTKPVVNGDKKTTIAKLALPLQFPKVSMGRRK

SEQ ID NO: 83713 - protein, 309 aa, Yarrowia lipolytica CLIB122
MSSILESINSTVTPAASYIGTYAKLSDAHADTLNIVERVWASYFVWWGNDLIACGIFIFLLHEILYFGRCVPWMILDQIPYFHKWKIQGEAKVPSVAEQWECMKSVLISHFMVEAIPIWGFYPVCKYAGISIDVPFPSWMKICAHLALFFVLEDTWHYWLHRGLHYGPFYKHIHKQHHRYAAPFGLTAEYAHPVEVALLGVGTVGIPIAWVMLTGDLHLFTVSVWIALRLFQAIDAHSGYEFPVSLHHFLPIWAGADHHDDHHRYFTGNYASSFRWWDFVLDTEAGPAAKAERQQRLAAKAAKKAKKQQ

SEQ ID NO: 83714 - protein, 320 aa, Burkholderia xenovorans LB400
MTTQQQPLISGFGVETQPEEVMAGIDLHGKVAIVTGGHSGIGLETTKALVKAGAKVVVGARGVDKAMESLAGLENVDVVELNLADPDSVDNFATSYLRTHNSCDILVNNAGIMATPLTRDSRGYELQFATNHLGHFQLTVQLWDALAVAGSARVVALSSLGHRFSAINFDDLNYLTRPYDPWRAYGQSKTANALFAVHLDRLGKGAGIRGFAVHPGRIPTTNLSRHMTDEEKKAATQAVQVGPDYVPSPLKSIAQGASTSLWAATSAQLSGKGGVYCADCDISPIVADDSPDVRGVRRWAIDPDQAVRLWDVSLDLVARR

SEQ ID NO: 83715 - protein, 252 aa, Zea mays
MYKNQLQELAQRSCFNLPSYTCLREGPDHAPRFKAAVNFNGEQFESPGFFSTLRQAEHAAAEVALAALARRGPSYSLAARILDETGVYKNLLQEVAQRVGAPLPLYTTERSGVGHLPVFTCTVELAGITFTGDHAKNKKQAEKNAASAAWSALKQLVREEVNSSNETENSDEQEQIRIARALLNYRLKEKMAMANYPHVSPFPKKFPMQPERKPSFGQSSQSSYSKILPLFRPKSNSRSRTESPASTDGASQ

SEQ ID NO: 83716 - protein, 682 aa, Moorella thermoacetica ATCC 39073
MELFPIIPAGGILALLVALYMTSSVLKEDTGPKEMQTIAAAIREGAMAFLNRQYRTIAGLALIVAVLLALLTRQYHTAVAFITGAFASALSGYIGMYVAVNANLRVAAGARNSLNKALTVAFRGGAVTGLAVTALSLLGVTSLFYAFGGATNPTRAPLDIVGFGFGASFVALFAQLSGGIYTKAADVGADLVGKVEAGIPEDDPRNPAVIADLVGDNVGDCAGRGADLFESTAAENIGAMILGIALVPFFGVKGIVFPLVARAAGIIASIIGMFFVRAEENQDPMAALNRGYIVTSILAIIFLYPISRYMLSGPGVNFIYFYGAGIIGIVLSFIFVLITQYYTSYDYRPVKEIARASITGPATNIISGVAVGFESTALPVVFISLAILGAYWLGLKSGLPGGGLYGTAVATMGMLSTAAYILAMDTYGPITDNAGGIVEMSGAPEEVRRRTDRLDASGNTTKALTKGYAIGSAALATFLLFSAYIDEVKIALNIKGNFPVDIGKPEVFVGAFIAAMMVLLFSSTAIRAVGNAAQYVILEVRRQFKEIPGIMEGTAKPEYGACVDIVTRGALKEMVLPGLIVVITPIIVGLVLKAEAAAAFLMVGTITGVIVALFLNNGGGAWDNAKKYIELGNFGGKGSEAHKAGVVGDTVGDPFKDTAGPSLHVLVKLISTITLVLAGLFI

SEQ ID NO: 83717 - protein, 411 aa, Mycobacterium avium subsp. silvaticum
MSSVSISIRPRSICSSQAVSRFSSPGWELIARNRENGLIDFTTDRQRGIEHADVIFIAVPTPMGESGAADLTYVFSVADDIGSYIDRYKVIVDKSTVPVGTADQITAIIRSKTDQEFDVVSNPEFLKQGKAIADFMQPDRVVIGSDSKRALRIMEELYEPFLRTFHPLIAIDVRSAEMAKYAANCFLATKISFINEMSNLCEKAGADISAVREAIGADKRIGYDFLFPGIGYGGSCLPKDVRALLYTADCLGSDMHLLRAVERVNDEQKAALVSKIITRFGGSEKNLDGLRIGLWGLSFKPQTDDVRAAPSLVIAEKLVEFGATVCAFDPEAMEQTKKVLGDSIEYAGNMYDAVQGADALLLLTEWKQFQRPSWSRVRSAMRGCVVFDGRNIYDPERMKDEGFEYYGMGRI

SEQ ID NO: 83718 - protein, 421 aa, Corynebacterium crenatum
MALVVQKYGGSSLESAERIRNVAERIVATKKAGNDVVVVCSAMGDTTDELLELAAAVNPVPPAREMDMLLTAGERISNALVAMAIESLGAEAQSFTGSQAGVLTTERHGNARIVDVTPGRVREALDEGKICIVAGFQGVNKETRDVTTLGRGGSDTTAVALAAALNADVCEIYSDVDGVYTADPRIVPNAQKLEKLSFEEMLELAAVGSKILVLRSVEYARAFNVPLRVRSSYSNDPGTLIAGSMEDIPVEEAVLTGVATDKSEAKVTVLGISDKPGEAAKVFRALADAEINIDMVLQNVSSVEDGTTDITFTCPRSDGRRAMEILKKPQVQGNWTNVLYDDQVGKVSLVGAGMKSHPGVTAEFMEALRDVNVNIELISTSEIRISVLIREDDLDAAARALHEQFQLGGEDEAVVYAGTGR

SEQ ID NO: 83719 - protein, 340 aa, Moorella thermoacetica ATCC 39073
MAKIITFGEIMLRLSTPEYQRFVQAESFNVTYGGGEANVACSVVNYGAEAAFVTKVPANPLGQAAINHLRRYGVDTSHILQGGERLGIYFLETGASQRPSKVVYDRKYASIAGVQPGEFDWARIFSGASWFHFTGITPALGENVAAVTLEAARKAKEMGLTVSCDLNYRKNLWTPEQARATMTELMTYVDVAIGNEEDAEKVFGIKAAASDVTKGEINEEGYRQVARELLNRFNLQKVAITLRESFSAFDNGWSALIYDGQEFYRSRRYQIHIVDRVGGGDAFAGGLIYALTEGFAPAEALEFAVAASCLKHTIPGDFNHVTREEVLSLMRGDASGRVQR

SEQ ID NO: 83720 - protein, 514 aa, Oryza sativa Indica Group
MAVQILPTLSKLVDVEVEFLDQYMGSTSRPVDDEVLDAATGVHYSALRLEELNMNGSVSGEDQPTTSGVENGHQEPFVIGVAGGASSGKSTVCKMIIDQLRDQRVVVVTQESFYYGLSDEELVHVHDYNFDHPDAFDTELLLSCMENLKHGKAVDIPNYNFKTYKSVASARKVNPSDVIILEGILVFHDSRVRDLMNMKIFVDTDADVRLTRRIRRDTIEKGRDIKTVLDQYSKFVKPAFEDFILPTKKYADIIIPRGGDNDVAIDLIVQHIRTKLGQHDLCKVHPNLYVIQTTYQIRGMHTIIRDAATTTHDFIFYADRLIRLVVEHGLGHLPFKEKQVITPTGSVYTGVEFSKRLCGISVIRSGESMENALRACCKGIKIGKILIHREGDNGKQLIYHNVPKDIANRHVLLLDPILGTGNSAVQAISLLLKKGVQETNIIFLNLISAPQGVHVVSKRFPRVKIVTSEIDFGLNDDFRVIPGMGEFGDRYFGTDDYQSSTPFFCDEKNRVRLL

SEQ ID NO: 83721 - protein, 487 aa, Deinococcus radiodurans R1
MTTTDLRTTYSSVTRSQAYFDGEWRNAPRNFEVRHPGNGEVIGEVADCTPTDARQAIDAAEVALREWRQVNPYERGKILRRWHDLMFEHKEELAQLMTLEMGKPISETRGEVHYAASFIEWCAEEAGRIAGERINLRFPHKRGLTISEPVGIVYAVTPWNFPAGMITRKAAPALAAGCVMILKPAELSPMTALYLTELWLKAGGPANTFQVLPTNDASALTQPFMNDSRVRKLTFTGSTEVGRLLYQQAAGTIKRVSLELGGHAPFLVFDDADLERAASEVVASKFRNSGQTCVCTNRVYVQRGVAEEFIRLLTEKTAALQLGDPFDEATQVGPVVEQAGLDKVQRQVQDALTKGAQATTGGQVSSGLFFQPTVLVDVAPDSLILREETFGPVAPVTIFDTEEEGLRLANDSEYGLAAYAYTRDLGRAFRIAEGLEYGIVGINDGLPSSAAPHVPFGGMKNSGVGREGGHWGLEEYLETKFVSLGLS

SEQ ID NO: 83722 - protein, 179 aa, Triticum aestivum
  misc_feature (81)..(81): Xaa can be any naturally occurring amino acid
  misc_feature (101)..(101): Xaa can be any naturally occurring amino acid
  misc_feature (116)..(116): Xaa can be any naturally occurring amino acid
MAPAVMASSATTVAPFQGLKSTAGLPVSRRSGSAGLSSVSNGGRIRCMQVWPIEGIKKFETLSYLPPLSTEALLKQVDYLXIRSKWVPCLEFSKVGFVFRXEHNSSPGYYDGRYWXTMWKLPMFGVQPNATQVLSEVEEVKKEYPDAYVRVIGFDNMRQVQCVSFIAFRPPGCEESGKA

SEQ ID NO: 83723 - protein, 441 aa, Zea mays
MTRRWPPFSARVAAAVFLLLLSPAATFQLGLGPAIAAWINGSPPPSPDAAAAAAAAASGPRSQEYAALQALKVAVTDDPKGALASWQGANVCAYKGVYCSAPPDGAAAAGASTVVAGIDLNRANLRGTLPDAVSLLAHLTFLHLNSNRLGGAVPDTLRDLQYLTELDLSNNLFSGPFPASTLLIPSLVYLDLRFNAFSGEVPPEVFAKELDAVFLNDNQFEGQIPDTLWASPATVITLANNHFTGAVPAAYEFGAGAGAGAGGRVREVLFLNNNLTGCVPEALGFLPSMQVLDLSYNALSGHLPGTLSCLSGIEVLNLAHNQLTGELPDLLCDLRRITNLSVSFNFFSGISQRCDRQLGSRGVFDFVGNCVPGRDMQRPQPECDEFPGEGGLSCLRIPGARPAGCGDAGVTIGVGVGVGIGGLPFGLPGAAAGGVVTVTVP

SEQ ID NO: 83724 - protein, 392 aa, Deinococcus radiodurans R1
MKAIVWQGVNKVGVETVPDPTLLLPTDAIVKITSTAICGSDLHLLDGYIPSMETGDILGHEFMGEVVEVGSEVRKLKVGDRVVVPFNIACGVCDPCKRGFFSACDNSNPNHRMAEALYGATSGGALFGYSHMYGGYAGGQAQYVRVPFADVGPFKIESGLKDEQVLFLTDIFPTGYQAAEQCNIVPGRDVVAVFGAGPVGQFAARSAQMLGAAHVIVIDRVPERLAMAEAAGCQTINYEKEDVLLSLREATGGRGPDHVIDAVGMEAHGHGPGSTMDKVQQNLKLTFDRITALRWAILSCAKGGTVSMPGVYGGLVDKMPIGAAFAKGLIFRMGQTHTHRHIPSLLGRIEAGQIDPSFVITHRASLDQAPELYKTFRDKQDCCIKVVLNPWA

SEQ ID NO: 83725 - protein, 228 aa, Erythrobacter sp. NAP1
MENDTQSAVSRLAEVESNIARMCKPARREPADVTLIAVSKTHPAHKIEPLLEAGHRVFGENRVQEAQEKWPQLREAYSGVELHLIGQLQSNKAEDAVELFDVIHSLDRSSLLKALAKAMDKSGKRVPCFVQVNIGDEDQKGGCPISELPEFLEKVRAANVPIAGLMCLPPADTEAAPFFAFLAKLAKDNGLTGDEGSLSMGMSGDYETAVQLGATHVRVGTALFGARG

SEQ ID NO: 83726 - protein, 409 aa, uncultured archaeon
MNEKLKEFLTIDDFDLYGKTVLFRADINSVIIDGQVQMKERIVENAKTIQALLDKKAKVVILAHQGRAGQADFLPLEQHAQLLRNFMDLKYIDDIMGPSARAAIKGLDRGEVLLLDNVRMLAEETLNKTPEEHSHSFFVRSLAPLADVYINDAFSVAHRSHASVVGFPTVLDAGIGRLMERELITLERAVYQIKSPCVYILGGVKPEEVFDIMEVTLKRKRVDTILTTGALGTLFLYARGIIEPGEEQKADKHFMWKVEQAKRFLEMGKDIIKYPEDVAVAVDGERREIPVAQLKPNQPAYDIGEKTAEGYSEQIKNARTVIMKGPAGLYENKAFAKGTRDIFEAISHSKAYSLLGGGHTSAAISEVGIDRKTMSNAHVSLAGGAFLRYFVDKHLPGIEVLKNSSFKKS

SEQ ID NO: 83727 - protein, 566 aa, Mycobacterium tuberculosis
MDVSHHHHHHGMATARPAKARNEGQWALGHREPLNANEELKKAGNPLDVRERIENIYAKQGFDSIDKTDLRGRFRWWGLYTQREQGYDGTWTGDDNIDKLEAKYFMMRVRCDGGALSAAALRTLGQISTEFARDTADISDRQNVQYHWIEVENVPEIWRRLDDVGLQTTEACGDCPRVVLGSPLAGESLDEVLDPTWAIEEIVRRYIGKPDFADLPRKYKTAISGLQDVAHEINDVAFIGVNHPEHGPGLDLWVGGGLSTNPMLAQRVGAWVPLGEVPEVWAAVTSVFRDYGYRRLRAKARLKFLIKDWGIAKFREVLETEYLKRPLIDGPAPEPVKHPIDHVGVQRLKNGLNAVGVAPIAGRVSGTILTAVADLMARAGSDRIRFTPYQKLVILDIPDALLDDLIAGLDALGLQSRPSHWRRNLMACSGIEFCKLSFAETRVRAQHLVPELERRLEDINSQLDVPITVNINGCPNSCARIQIADIGFKGQMIDDGHGGSVEGFQVHLGGHLGLDAGFGRKLRQHKVTSDELGDYIDRVVRNFVKHRSEGERFAQWVIRAEEDDLR

SEQ ID NO: 83728 - protein, 274 aa, Coxiella burnetii RSA 493
MTKEDQIYAWGNSSALSCFGFPADAHIYTPRPVRLPQHLLSPLLLVTDRIIQLTAGHNHILALTRNGCVFAWGNNWFGQLGLGNREAIAQPTLLLFPDLSSSDRIIQLAAGGYHSFARTEKNRVFGWGGNYTHQLGLVNGVDRTQPTELYFPGLSNADDCIIEIGASSDSSFALTKQGVFVWGDNALGQLGLNYKNHKISIERPTYRPLDKRIPPLKFMRSLHIKAQEKTAQITILGSQGKFDEDAKKYVDYCKIEISGIHNLEYLLYNVLVER

SEQ ID NO: 83729 - protein, 472 aa, Rhodococcus sp. RHA1
MASDLTRTTAPSQHADAPGRHSHRLGIIAVVATFGGLLFGYDTGVINGALEPLEEDLHLTSFTEGLVVSILIFGAAIGALVGGRMSDRFGRRHNILVLAIIFMIGTIGCVLSPTWEVLALFRFILGLAVGGASATVPVYLSEISPTERRGSVVSRNEVMIVVGQFAAFVINAVIFNIWGEHENVWRFMLLVAVIPAIFLFAGMLRMPESPRWLMSQDRHDEALAVLLQVRSPERARAELEEVRALAEEEKLSQTGGAADLSVKWIRRLIFIGVGLGVFQQATGINSVMYYGTQLLGDAGFSSNAAIVANTLNGLFSVLGVLTGVALINRIDRRKMLIGGFTLTTTFHVLVGLSAFLLPDGTLKAYLILTFVVLFVFSMQATIGPLVWLMLSEIFPLKIRSFAIGVCIFALWIANAVVALLFPPVVTALGIGATFFIFAGLGVLALVFIKTQVPETRGRSLEELEDQFRHDYS

SEQ ID NO: 83730 - protein, 436 aa, Burkholderia thailandensis E264
MKAAGDPLRLLARRAHPRRIQGPIIEAPLPDVAIGELCAIRAAAGSDTTIGRAQVVGFGRDTAILSALGSTAGLSRQVALVPTGERMTIDVSPALLGAVVDAAGGVVETLGTAGALRGAAPRRSAIDAAPPDYAARRPIERRLATGVRAIDGLLTCGVGQRFGIFAAAGCGKTSLMNMMIEHAAADVYVVALIGERGREVSEFVERMRRSGSRDRTVVVYATSDRASVDRCNAALVATTIAEYFRDLGCDVMLFLDSMTRYARALRDLALATGEAPARRGYPASVFEQLPRLLERPGRTHAGSITAFYTVLLENEEEPDPIGDEIRSIVDGHVYLSRQLGAKGHFPAIDVLKSASRLFDEIADAPHRSLAKRFRQHLARIDEMQVFLDLGEYRRGENPENDDALDRRPALDAFLKQEIDEASAFGDTLERMREAAS

SEQ ID NO: 83731 - protein, 167 aa, Shewanella oneidensis MR-1
MAKLEAQQKDDLQEKLIAVNRVSKVVKGGRIFSFTALTVVGDGNGKVGYGYGKAREVPAAIQKAMEKARRNMVTVELNAGTLHHPVKGRHTGSRVYMQPASQGTGIIAGGAMRAVLEVAGVHNVLSKAYGSTNPINIVRATVDALVHMKSPSQIAAKRGLNVDEIRG

SEQ ID NO: 83732 - protein, 305 aa, Bacteroides fragilis YCH46
MVFSGTNSRYLAEKICASLNCPLGNMNITHFADGEFAVSYEESIRGAHVFLVQSTFPNSDNLMELLLMIDAAKRASAKSVVAVVPYFGWARQDRKDKPRVSIGAKLVADLLSVAGIDRLITMDLHADQIQGFFNIPVDHLYASAVFLPYIQSLKLDELVIATPDVGGSKRASTFSKYLGVPLVLCNKSREKANEVASMQIIGDVKGKNVVLIDDIVDTAGTITKAANIMLEAGANSVRAIASHCVMSDPASFRVQESGLTEMVFTDSIPYSKKCVKVKQLSIADMFAETIKRVMNNESISSQYII

SEQ ID NO: 83733 - protein, 220 aa, Rhodococcus sp. RHA1
MTATLTYRDTIAVLDLGDDENRFSPEWLDTVDRLLDDAHEHGAQALVTTATGKFYSNGLDLDWLMANGDRGDWYVGRVQALFSRILTLPLPTVAAVNGHAFGAGAMLGIAHDYRVMRSDRGYYCFPEVDIHIPFTPGMAALIQAKLTPQTAITAMTTGRRYGGPDAQTSGLVDGTAPEGAVLGAAVDLIAPLAGKDAGTLGAIKSTMFAPAVAALASGRS

SEQ ID NO: 83734 - protein, 647 aa, Sulfolobus solfataricus P2
MGEREAKGARDLGISSDKQLRRSLGKFELLYLSLGGIIGSGWLFASLSTAAYAGGAAILSWIIAGILVMFVGLAYAEIGAAIPKSGGITRYPHYTHGGLVGYIITWAYFLSAASVPAIEAAAAIEYIGSYYPQLITSGTFDGTTVTILTPLGIGLAGLLLIFFFFLNYFGVNILGKVTHGAGWWKLLVPTITFLALLALDLHSANFTLGGGFFPSAQYVKGGSSGIYGFSAVLFAIPSTGVIFAYLGFRQAVEYGGEGKNPSKDIPFAVLGSLLIAIALYTLLQVSFIGGIDWSKLYLVNKTTGILIPVVPGNWSALSTAVTASNVSISSGPFLVLTQIAPVSGLAAAFFTALAVLLTIDAVVSPSGTGWIYTGTSTRTLYAFASNGYLPEIFLKIGKTKIPTYSLIAALIVGFIFLLPFPSWYALVGFISSATVLTYIMGGIGLAVLRKHAKELNRPFRVPASVIIAPIATLAAGLIVYWSSFAILFYVFTGIFLGLPLFFIFYSNRILGINKAYSIVVGVINLVIDLVMAFLLFDETSGLGAANNLFFGIYIVVIAAMLIGDMLFLLKTVPPDVKREINAGWWLIYFILAIYIISYFGGFGLYTIIPFPYDTIVAAIVILIGYFWAIRSGFRTQAIQDIIQATRE

SEQ ID NO: 83735 - protein, 441 aa, Burkholderia sp. 383
MTDKATRIDLFSFRTAPMRAFHLTWMAFFVCFFAWFACAPLMPLIAREFHLTAAQVANINIAAVAATIAVRLLVGPLCDRFGPRRVYVGLLLLGAIPVFAVSFTHDYLSFLICRLGIGAIGAGFVITQYHTSVMFAPNVVGTANATTAGWGNAGAGATQALMPLLVAAGLMLGFGEDSSWRIALVVPGVAMLVMAWAYWRFTQDCPQGDIVALRKAGVTVDSGKKGGWASFFAACGNYRVWMLFVTYGACFGVEVFIHNIAALYYVDHFSLSLKDAGFAVGLFGLLALFARALGGWLSDKIAARRSLDVRATLLCALIVGEGLGLIWFSHAQSIGVALVAMLTFGLFTHMACGATYALVPFIDRKALGGVAGIVGAGGNVGAVAASFLLKGVGDVQHTLSLLGLAVTATALCAMAVRFSEEHKAREAELRDRALAASSVAN

SEQ ID NO: 83736 - protein, 125 aa, Oryza sativa
MAPPGGGGPGAPEAGKVSFKFFLPSAPKLPFKVFRVPKGAPFPPVLKFPPEEFKVPPQTSPFFPTDGVGPPPHQSAGNVFLKHGPELPPLPPDKVGALAAPLLDSIVIIENLPPIKSMLGACLLV

SEQ ID NO: 83737 - protein, 425 aa, Helicobacter hepaticus ATCC 51449
MVYIEAIDAQEVMDSRGNPTVRAAVRLSDGTRAAAIVPSGASTGKREALELRDGDKERYLGKGVLKACANIKTEIAAQLDGVSPYDQSKIDLILKKIDGTENYSELGANATLGVSMAIARASAQSLRLPLYRYLGGSNALTLPTPMLNIINGGSHADNTVDFQEYMIMPLGFDTFAESLRASAEIYHHLKAILKGSGHITSIGDEGGFAPNLKNNEEPIEIILKAIEQAGYKPLDEIAIALDVASSELVDENGMYHLAGEGKVLDSAGMIAYYENLVAKYPIVSIEDGLSEDDWEGWKLLTQKLGNKIQLVGDDLFVTNKKILQEGIEKNIANAILIKPNQIGSVSETMQSVRLAQRNNYKCIMSHRSGESEDTFIADFAVALNTGEIKTGSTARSERIAKYNRLLEIEREISDAEYIGKTLFKR

SEQ ID NO: 83738 - protein, 652 aa, Magnaporthe grisea 70-15
MFYGDELCLNTAGGVKLVQPRPPRGPPTPSMSTPAADFDQTLTGSPPPPPTPAASPGPSHSQLDWSNADVGEDFFLAKVRQHFQHSTGPQRTRILADLLNLCTSQQLSFVHQFVSPLLKKDPFTSLPDELCLRILSFIDDPKVLARASQVSRRWRDLLSDDMTWKNLCVKHDYERRLSEVQPPVGICLTRPAALPLSGSYSDSANRSFPGALPTPSVRMSASSSFDGASSSRPTLKTYKSHFKQRYLVDAAWRTGGRNVTRNITQEGGVVTSLHLTPKYIIVALDNAKIHVFDTEGNAQRTLQGHVMGVWAMVPWDDLLVSGGCDRDVRVWDLSTGACLHTLRGHTSTVRCLKMSDSTTAISGSRDTTLRIWDIRSGLCRNVLVGHQASVRCLEIKGDIVVSGSYDTTAKVWSISEGRCIHTLSGHYSQIYAIAFDGARVATGSLDTSVRIWNAATGECQAVLQGHTSLVGQLQMRGETLVTGGSDGSVRVWSLSKFCPIHRLAAHDNSVTSLQFDDTRVVSGGSDGRVKIWDLKTGHLVRELVAQCDAVWRVAFEDEKCIAMASRNGRTIMELFSFSPPDEMLYERPVSLPQRPHEASDRPMSALPLDYTKTNTLIPGLPRRDCPDVDIRDAGPSTAPLQQCNSTFFHEED

SEQ ID NO: 83739 - protein, 390 aa, Zea mays
  misc_feature (345)..(345): Xaa can be any naturally occurring amino acid
MAGSAVAVVLLSAVALLCLYHLLFLSLSVPDPAAAAAVPRRAGGHHGSNVPSGSGTANVVLRFGLSGQPLRLHDPASAAGLPDIDTFRGKLERLLPPDDHDPGWSRRFDAELGPVHRYFGPDAPLDVRQRIAYLFAILDRSPRGVGVGVGVGELEAWLRWQAAARLDAVTRREMAPHDTDRDGAVTLREFFADWINMGHDKMGWWMHKFASADRDGDGSLNAVEFNDFLHPEDSSQESVMLWLLKDKLSEMDHDGDGRLSQEEFVAQSHIIISGARHADDGGHAHDLERAEAAKKFTELDADKDNYLTVEEARCVLQSLVTGEFSYATSHAKFLMKVVASSNRTXADVNHDGKLSLEEMLDDYISFYSPVYMDDHYASEGEVDSDSRDEL

SEQ ID NO: 83740 - protein, 139 aa, Picea sitchensis
MKLKATTKMKKPQLKALVVEFYANWCEVCRELAPDVYKVEQEYKDRVNFVMLNVDNSKWEEELDEFGVEGIPHFAFLDKEGNEEGNVVGRIPRQYLSENVAALARGDAKIPYSRVVGQFSNPESRQVRPVVNPRSHGTP

SEQ ID NO: 83741 - protein, 279 aa, Wolbachia endosymbiont of Drosophila simulans
GLGNKFLSHIREVDAIVHLLRCFTDDDISHVHSKIDPISDAEVVEMELILADIDSIEKRLPQLEKKAKQGDKELKRQLELMQEVLATLKLGKPARSLENIDEDEMKSLQLLTTKPVMYVCNVEDTNVITGNELSKKVERMAEENKSKFYCISAKLEADIANLDSEEEKQSFLSEFGLQESGLDGVARIMYEVLSMITFFTVGPKEARAWPVKIGSTADKAAGVIHTDFEKGFIKAETISFADYIKYGSESACKDAGKIRFEGRDYIMQDGDIMHFRFNV

SEQ ID NO: 83742 - protein, 416 aa, Candida glabrata CBS 138
MSLSSKLTVQDLELKDKRVFIRVDFNVPLDGKKITSNQRIVAALPTIKYVLEHNPRYVVLASHLGRPNGERNEKYSLAPVAEELQSLLGKPVTFLNDCVGSEVDSAVKASAPGSVILLENLRYHIEEEGSRKVDGQKVKASAEDVAKFRKELCSLADVYINDAFGTAHRAHSSMVGFDLPQRAAGFLLTKELQYFGKALENPTRPFLAILGGAKVADKIQLIDNLLDKVDSIIIGGGMAFTFKKVLENAEIGDSIFDKAGAEIVPKLMEKAKAKGVEVVLPVDFVIADAFSADANTKIVSDKEGIPAGWQGLDNGPESRKLFAATIAKAKTIVWNGPPGVFEFEKFASGTKAMLDEVVKSSTSGNTVIIGGGDTATVAKKYGVTDKISHVSTGGGASLELLEGKELPGVAFLSEKN

SEQ ID NO: 83743 - protein, 283 aa, Hordeum vulgare subsp. vulgare
MATSAMTLAMSAATEASLFHPAFAAQHKLAPASASLPLIFSRAPLLRSTRPRVPLTPLVTSSDAAEAGLDWADAEEAEETVTEEEPVVAASGGDAGYTAEPPEEAKVYVGNLPYDVDSERLAQLFDQAGVVEVAEVIYNKESGQSRGFGFVTMSTIEEADKAIETFNRYNISGRLLNVNRAAQRGSRVERPPRQFASSFRAYVGNLPWQAEDSRLVQMFSEHGEVVNATIVYDRETGRSRGFGFVTMASKEDLDSAISALDGQEMDGRPLRVNVAAERPQRGF

SEQ ID NO: 83744 - protein, 261 aa, Xanthomonas axonopodis pv. citri str. 306
MELRETVIAIARDAGDAIMEVYAQDFSVEIKDDASPLTQADLAANRVIVEGLRRVTPDVPVLSEESAHVAWEQRQYWTSYWLVDPLDGTREFVKRNGEFSVNIALIHMGAPVLGVVQAPVDGRVWYAARGENAFRRDGDRDEMLHTRTPAAMPLRVAASRSHRDARTAAALERMGEIDVVAQGSSLKFCRIAEGDLDVYPRFGPTSEWDTAAGQCVLHAAGGVLLAGASGKPFRYNRRDTLLNGDFIALGDPNLPWRDWLA

SEQ ID NO: 83745 - protein, 336 aa, uncultured archaeon
MMKVAINGWGRIGRLVFRAVLQDHSALDFVAINSRSADASWIEHLLTYDSVHGKQEGAIRAEKDTLFVDGKEIKILSESDPENLPWRDLGVDVVVESTGQFRDRKGASKHLKAGCKKVIITAPGKEPDVTLVPGVNDAMYNPATHNIISLASCTTNCLAPVAKVLEDEFGINRGFMTTVHAYTGDQKILDGRHKDLRRARAAAMSIVPTTTGAAAALGIVLPSLAGKMDGISLRVPTTNVSVVDLVAELGSEVTREAVNSAFEEASKTSLTGILAVSHLPLVSIDYNGSSFSAIVDAEYTTVVGGRLVKVLAWYDNEWGYSCRVLDMIKRLEAEGV

SEQ ID NO: 83746 - protein, 592 aa, Blastopirellula marina DSM 3645
MSLIVQKFGGTSVADCDKIVAAARKAIRAQKEGHQVVMVVSAMGKNTDVLVDLAAQINERPPAREMDMLLSTGEQVSVALMAMAIHSLGAKAVSLTGAQIGIRTDSTHTKARIISIETERVKELLAAGNIVIAAGFQGIDENLNITTLGRGGSDTTAVALAAVLDADACEIYTDVDGVYTTDPRLLAEARRVLQISYDEMLELASLGAGVMHSRSVEFAKKFGVPIHVRSSFTDITGTMIVDQPESLTRPVSGAAMTKNEARITIEGVPDVPGISHELFHSIATKAISVDMVVQNIGADGRANISFTVPREELDQTLEAVRNAANILQYASVAHDEQVSKISVVGLGMAEQSGVADKMFRVLADANINIQMITTSEIKISVLVSREDAQRALAAVHSGFQLDVTPSDAPESVAAVPRECERDAAEVVSRLRTMEDLTIDSIVLDDSQSVIALRRIPDHPGIAARVFEAIAAEGILVDMIVQNVGRGDAANLSLTVPKEDCEQALVVAKKIGAELGAEEILCKADAAKLSVSGIGLRSHTGVGIRMFRALSDSGINVELINTSEVMVNVIVEGKQGQAGLAALNKAFADVLVS

SEQ ID NO: 83747 - protein, 479 aa, Shewanella sp. MR-7
MPARVTHHRIFALSNSDTQPSMAFSTLKLKPELLENLTTMGYHEMTPIQAQSLPAILAGEDVIGQGKTGSGKTAAFGLGLLNKLDVKRFRIQTLVLCPTRELADQVAQEIRTLARGIHNVKVLTLCGGVPMGPQIGSLEHGAHIIVGTPGRIVDHLERNRLDLSNLNMLVLDEADRMLEMGFQPQLDAIIEQSPRERQTLLFSATFPEQIQSIAKQIMYDPVMVKVAVTHEKSTIEQHFYHLDDDKARMQALQLLLLDRKPESAVVFCNTKRETQKVADELSDAGFSVIALHGDLEQRDRDETLLQFANKSACVLVATDVAARGLDIDALDAVFNYHVAFDTEVHIHRIGRTGRAGSKGAAFTFFDDQDGYKIALLEEYLERDIQSEALPSLSLLGTAPNAPTMITLQIDGGKKEKLRPGDILGALTGENGIEGSQVGKILVTDYRAYVAVNRKVAKKALSKITSGRIKGKSYRAWLMK

SEQ ID NO: 83748 - protein, 728 aa, Salinibacter ruber DSM 13855
MDEQRYLVTARKYRPSLFTEVVAQEHVTETLKNAIRMERLAHAYLFSGPRGVGKTTAARILAKAINCETPREEREDGAEPCCECDSCESFEAGRSLNVFEMDAASNNKVDDIRELREKVRIPPQGDQKKVYILDEVHMLSKQAFNALLKTLEEPPAHALFIFATTEPHKVLPTILSRCQRFDFRRIPVPEIVQRLREICETEGVEADEESLMLLARKGNGALRDALSAFDQALSLCGATLEYGELTQALGVVDQDLYFRLTDHVAAQDTAGMIELVRHVVRSGYDLQEMLVGLAEHLRNLLVAHSLGGEALEEVAESTRTRYADEAERFDEADLLRLLTMAADTEDDIKQSPQPRLTLETTLLKMAQLRRSADLRAVLEKIDRLEQMAEDGDLPEAVPGDGVTASETASAPPAPPESEKSENTETGGAAGREASPDAAAEPRPGYGPESTAPPNAPEDAPSTKDAESDPKNETPDGAPADVVDEAGNETLSASDEDDAPNDDAPNDEAPNDEAPDADAQGPDDGDEPPSSDAPADGTDASGADPSVGYNDIFGAPALGDDESSEGGSASGTTDARASESASTSDGSDASAAAVAEPAVAAGADADGVATEWPQVVQSVKDTHISLGSLLGEAEPVEYVDGTLTVAVPRALHRDTLRDRRRVLLRHVTDTVAPTVDDLRFVVEDTSDAAAADADTSDEPLSPREQLSQLRDTYPALDVLFSEFGAEPVW

SEQ ID NO: 83749 - protein, 565 aa, Coxiella burnetii RSA 493
MLDITFKTDKNNKPYLETGITGKALLTIPQLNKGTAFTEEERDTFGLRGKLPNRVETLDDQVARAYLQYKSFDMQLNRNFYLNHLLDTNQVLFHRLVKNHVQEMLPTIYTPIVGNAVRAFNKRFMHPRGLYISYEDRNQIKKILNNRSHPIIDLIVVSDGEGVLGIGDQGVGAMAIPVAKLMVYTAIGGINPIRTLPILLDAGTNNEELLNDPLYLGWRHPRLSGNEYAEFIEKFIEAVQATFPQVFLHWEDFGRTNAYRNLIKYREITCSFNDDIQGTGCVALAAILAALKITRSTLPEQRIAVFGAGTAGMGITDTLFRALSQNGLSEKEARNPFWLIDRNGLLTEYSEEVTSAQQPYLRKKEEIASWKIKNPQQISLLEVIENVKPTILIGASAQSHAFDQTIVKAMAKHVEKPIIFPLSNPTDRSEAEPADLHRWSHGKALIATGSPFEDIIFDNQIFPVNQCNNYLAFPGIGLGAIAVKANRVSDNMLWSASQALSRYANESTHRLLPSIAQAQEASRQVAIAVAKTAIEEGLAKFSLDQVETLVDQQIWEPHYLSYRKR

SEQ ID NO: 83750 - protein, 348 aa, Legionella pneumophila subsp. pneumophila str. Philadelphia 1
MNMNTAPKQYGFYMPAEWYPHERCWMAWPCHHETWSKIGLDKAKMAYARVAKAIAQFEPVTLLVNPGDEDSAENLCKGHNIEIISLPINDSWTRDTGATFLINNERQLAGVDWIHNAWGGNYADCSLDNLIASHLIKYTEAQYFHAPLVMEGGSFHVDGEGTILTSKECLLNSNRNPHLSQQEIEQYLINYLGAERIIWLNMGLIGDETDGHVDEIATFIAPGKVLCLITKDKEDPNYHRLQENFEILKSSKDARGRTFEVYTVEQPPATYLNGERLTLSYINFYMANQGIVMPAFGYESFDRLAYQLFVQIFPGYQITQIDALDVFSGGGGIHCITQQQPKSHKLVE

SEQ ID NO: 83751 - protein, 338 aa, Streptomyces coelicolor A3(2)
MGESVLLTSTPPEHKESVIVSSAPQSRPWDVHRLPSAEGRNFLVTGGNAGIGYFTAEQLAATGALVVIGSRNPAKADAALASIRSRVPGARVRHLHLDLADLSTLKSAVDGLALDLGRLDAVVHNAGGALDDPPRRETEDGHELMFGTNHLGHYALTRWLAPLLSAAPAGRVVTVGSFAARSERLDLDDLQSTRDYRPKRTYGRSKLAQMCFGFELDRRLRAAGSTVLSAVAHPGGALDSLTPPRPPVGAPTPGERLRGLPAALMVQGKDAGAWPVVRAVLDSDVQGGQLWGPRVFGLRGQPRREPVPAHMADPAVAARLWAASAELTGTTDPHLGFR

SEQ ID NO: 83752 - protein, 501 aa, Bacteroides fragilis YCH46
MMNQELLMSPNRLVTFLQKPAAEFTKADIINYIQQNEIRMVNFMYPAADGRLKTLNFVINNASYLDAILTCGERVDGSSLFPFIEAGSSDLYVIPRFRTAFVDPFAEIPTLVMLCSFFNKDGEPLESSPEYTLHKACKAFTDVTGMEFQAMGELEYYVISEDDGLFPATDQRGYHESGPYAKFNDFRTQCMSYIAQTGGQIKYGHSEVGNFMLDGKVYEQNEIEFLPVNAENAADQLMIAKWVIRNLAYQYGYDITFAPKITVGKAGSGLHIHMRMMKDGQNQMLKDGVLSDTARKAIAGMMQLAPSITAFGNTNPTSYFRLVPHQEAPTNVCWGDRNRSVLVRVPLGWSAQTDMCALANPLESDSNYDTTQKQTVEMRSPDGSADLYQLLAGLAVACRHGFEIENALAIAEQTYVNVNIHQKENADKLKALAQLPDSCAASADCLQKQRTVFEQYNVFSPAMIDGIISRLRSYNDATLRKDIQDKPEEMLALVSKFFHCG

SEQ ID NO: 83753 - protein, 446 aa, Helicobacter hepaticus ATCC 51449
MHITIIGSGYVGLVAGACFAQMGNNVVCLDVDSKKILQLQKGDIPIYEPGLESLVRENTALGTLCFTTDKKEAISNAEVIFIAVGTPMGDDGSADLSYVRNVAMDIGTYIEREYVVIVDKSTVPVGTAREVRKLIESTLLKRHITSVAFDVVSNPEFLKEGMAIKDFMSPDRVVIGTDSTRALDTMKTLYAPFLLKSDRFISMGIESAEMTKYAANAMLATKISFINEMSQICERVGANINDVRLGIGSDARIGYSFIYPGCGYGGSCFPKDVRALEKTAKDFGYDACILGAVQRVNNEQKMLLVEKIVRYFGEDLSGLSFALWGLSFKPETDDMREASSLVLIEQLSKRGAKIKAYDPKAYGQAQFYLKDYMQSLTLEESKYEALKDCAALVIVTEWREFRSPDFNEIAKLLMNPIIFDGRNIYQHLDMESKGFEYYQIGVKHNN

SEQ ID NO: 83754 - protein, 300 aa, Clarkia breweri
MLLVPLKPNLRHPSFFRRKSASPTATMATLSTYWDSINDKIDGHLKAAVPVRKPLSVFEPLHHLTLAAPRSSAPALCIAACELVGGSSSQAMDAAAALHLIHASLSVHKRLYRGGSGSGFGSNIELLTGDGMLPLAFELLANSEGAGDESRSRRILRVIVEISKAAGSEGLLKGEYNELQLGRLAGFTGGDWRDAFWMDHVCGKKEGGLHACAAACGGILGGGTEEEIEKLRKLGYLVGMIRGIVSVKGGAAGEDEEWMKVVEEMAETALKLLTGFSGELKSKITNICQYEDLFPLIKSY

SEQ ID NO: 83755 - protein, 127 aa, Bacillus licheniformis ATCC 14580
MIKEAFIIDKVHVEGMEFYGYHGVFKEENKLGQRFRVDLTAFLDLSEAGKTDNIEATINYAELYKLCKEVVEGEPVNLVETLAETIAAQVLENFEAVQECTVKVVKPDPPIPGHYKSVAIEMTRKRK

SEQ ID NO: 83756 - protein, 364 aa, Picea sitchensis
MTGRTLSGNSYYGKYSEELIATANYIATPGKGILAADESTGTIGKRLSSINVENVEVNRRSLRELLFTTPGALQYLSGVIFFEETLYQSTASGKPFVEVLQEAGVVPGIKVDKGTVDLAATNGETTTQGLDGLAQRCQQYYKAGARFAKWRAVLKIGPTEPSELSIEQNAQGLARYAIICQENGLVPIVEPEILTDGSHDIHKCAAVTENVVAAVYKALNDHHVLLEGTLLKPNMVLPGTDGPKAPPEEIAEHTVRALQRTVPAAVPGIVFLSGGQSEEEATLNLNAINACKTKKPWTLSFSFGRALQQSTLKTWAGKAENLGAAQKAFLARCKANSEATLGKYAGGAGAGLATESLYVKDYKY

SEQ ID NO: 83757 - protein, 226 aa, Brassica napus
MGHCISSLFSSSPSKTGLHHSHASTNNHSNGTEFSSSTTTTAATSNSSAGRRSQFSEAISESSGGIITDSGQLLESPNLKVYTFLELSTATKNFRPDSMLGQGGFGKVYRGWIDAKTLLPSKAASGMIVAVKRLNSESVQGYSEWRSEINFLGTLSHPNLVKLLGYCREDKELLLVYEFMPKGSLENHLFRRGEPFPWDLRIKIVIGAARGLAFLHGLPREVIYRD

SEQ ID NO: 83758 - protein, 257 aa, Wolbachia endosymbiont of Drosophila simulans
MENKTVINLFFEDSTRTLASFEIAAKSLGANVVTLPIRSSSINKGEDLKDMIKTLNAMNPDYIIIRHKSSGIINTLAKYVNCSLINAGDGSSEHPTQALADYLVISNHKKQIKDLKVVICGDILHSRVARSNIRLLKMFGAEINLVAPPTLICKHFPEVDSVHYSLIEGIKDADVIMLLRLQKERMNNSSSEKEYFYLYGLDSQKLSYAKPDAIVMHPGPINRGIEISSDVADCVILQQVEFGLAIRKAVLHYYRPC

SEQ ID NO: 83759 - protein, 569 aa, Mycobacterium avium 104
MLAALAIFFRGERPMTTARPAKARNEGQWALGNREPLNPNEEMKQAGAPLAVRERIETIYAKNGFDSIDKSDLRGRFRWWGLYTQREQGYDGSWTGDENIEKLEARYFMMRVRCDGGAISAAALRTLGQISVDFARDTADITDRENIQYHWIEVENVPEIWRRLDAVGLRTTEACGDCPRVILGSPLAGESLEEVIDPSWAIAEIARRYIGQPEFADLPRKYKTAISGLQDVAHEVNDVAFIGVNHPEHGPGLDLWVGGGLSTNPMLAQRVGAWVPLHEVPEVWAAVTSVFRDYGYRRLRSKARLKFLVKDWGIEKFREVLETEYLKRPLIDGPAPEPVAHPIDHVGVQRLKNGLNAVGVAPIAGRVSGTILLAVADLAQQAGCDRIRFTPYQKLVLLDIPDDKLDEVVAGLEALGLQSQPSHWRRNLMACSGIEFCKLSFAETRVRAQGLVPELERRLADVNRQLDVPITINLNGCPNSCARIQVADIGLKGQMVDDGEGGSVEGFQVHLGGSLGQDSGFGRKLRQHKVTSDELGDYIERVARNFLKYRGEGERFAQWAMRADEDDLR

SEQ ID NO: 83760 - protein, 321 aa, Zea mays
MELFARAKVVRLKSHHDKFLYADEDEAHVTQERDGSSANARWAVEPAPHNPGAIRLRSRYGHYLTASGEPFLLGMTGRKVTQTAPAAPRPANASVDWEPVRDGFQARLRTRAGHFLRANGGLPPWRNSVTHDVPHRTATQDWVLWDVEVVQLLTPAPPDRAGSAPLAKLPDSPPAPELANPPQPHHRPSKSYAAPPPPPTLEPEAPPPRLSKLESSDSFSAPLHKVEGRAIHYHIADDLGNVQDGTVGHSFTFNGSNLEELAHKLQEETGLDNIIICTRSPINGKLTPLRLQLPPNNAAMHIVLVQESSKVARSFARPYGS

SEQ ID NO: 83761 - protein, 507 aa, Rhodococcus erythropolis
MTVYARPGTADAIMSFQSRYDNWIGNEWVAPVKGQYFEIPTPVTGQNFCDVARSTAEDIELALDAAHAAAPAWGKTSVAERAIILNKIADRMEENLESIALAESWDNGKPIRETLNADIPLAIDHFRYFAGAIRAQEGSLSEINSDTVAYHFHEPLGVVGQIIPWNFPILMAVWKLAPALAAGNAIVLKPAEQTPVSILHLIGIIGDLLPAGVLNIVNGFGVEAGKPLASSPRIKKIAFTGETTTGRLIMQYASQNLIPVTLELGGKSPNIFFSDVLASNDDYQDKALEGFTMFALNQGEVCTCPSRSLIQEDIFDEFLAMAAIRTKAVRQGDPLDTDTMIGAQASNDQLEKILSYIEIGKAEGAKVITGGERAELGGDLSGGYYVQPTVFTGNNKMRIFQEEIFGPVVSVTSFKDYDEAIEIANDTLYGLGAGVWSRDGGVAYRAGRDIQAGRVWTNTYHQYPAHAAFGGYKQSGIGRENHLMMLSHYQQTKNLLVSYAQKAQGFF

SEQ ID NO: 83762 - protein, 535 aa, Erythrobacter sp. NAP1
MTAPVLTTKLDREAPEAKSRFQHNKALADDLRGAVADAALGGPERSRERHVSRGKLLPRERVERLLDPGSPFLEIGQLAANGMYEGDINAASIICGIGRVSGRQVMIVCNDATVKGGTYYPMTVKKHLRAQEIAQENRLPCIYLVDSGGANLPHQAEVFPDRDHFGRIFFNQANMSALGIPQIACVMGSCTAGGAYVPAMSDETVIVRNQGTIFLAGPPLVKAATGEEISAEDLGGGDLHAKKSGVVDHLAENDEHALTIVRDIVSQLGANTNAAENIAVQEPRAPKFDADDLYSIIPDDVRAPYDVKEVIARLVDGSEFHEFKQHYGSTLVCGFAHIWGMPVAILANNGVLFSESAQKGAHFIELACQRRIPLLFLQNISGFMVGGKYEAEGIAKHGAKLVTAVATATVPKITVVIGGSFGAGNYGMAGRAYSPRFLFTWPNARISVMGGEQAASVLATVHRDADSWTEEEAEAFKAPIRQKYEDEGNPYYATARLWDDGVIDPAQTRDVLGLAFAATLEAPIADRPAFGVFRM

SEQ ID NO: 83763 - protein, 454 aa, Deinococcus radiodurans R1
MTATQAKPRQPDLKTSLPGPKTAEIMARDQATLSTSYMRPYPFVPDFGKGVWLTDVDGNTMLDFFAGIAVSTTGHAHPHVVQAVQRQIEKFTHVCLTDYPQEITTSLAERLVKHVERPGEKWRVFFSNSGAEAVEAAVKLARNHTGRQHIISTMGSFHGRTYGAITLTGSKTKYKRGFGPLLPAVSHVPYPNPFRPPLGSTPENCGQAVIDHIESLFVGILPADEVAAIIVEPMQGEGGYIVPPADFLPGLRALCDKHGIMLIFDEVQAGMGRTGKMFSFQHFDVQPDIITSAKGIASGMPLGALLAKESVMTWPVGSHGSTYGGNPVAAAASHATLDLLEGQVKHEGCGDSLMDNAAQVGDFILGELKGMQDEFPFIGDVRGRGLFIGIEFVKPDGSPDGALRDQASMMMFEKGLLNLDCGEAVIRISPPLILTREEAATGLDIMRGVFQELK

SEQ ID NO: 83764 - protein, 588 aa, Coccidioides immitis RS
MRSPFGGSNRAAEAGTEKYQPDIEASDRENDNSDGIRSPTEAEDVSKEVQDGVRNMEAATSVWTKWHLIAAYVNIWLIYFVTSMQEVVLRSLNPYVTSSFSLHSLTAATTVMSSIIGGLSKIPLAKILDTWGRPQGLALTLFIWVIGYIMMAACKNVQTYAAAQVFSAVGSQGVSYCMTVFIADTSSLKNRSLMLAFATSPYVATTWVGGPISKSIIEVAGWRWGFGIFSIVVPVVVSPLCLIFLLNHRKAKKAGIVSTPGSGRKLNLQNIKKYAIDVDLVGVIILASGMALFLLPFSLWSFQAEKWKAPMIICMIIFGGLLLIFFTIYEKYLARVTFIPFNLLMDRTVFFAAVYFFFVFFCGAVWGGYFFSMLQVVWELDITNATYVSNIYRVGSCLWALVVGVLIRWTGRFKWLAVYFAVPLMMLGVGLMIHFRQPGVNIGYIVMTQIFVAFAGGTCVITGEMAMMAPSDHQHIAVIIAILNLFSSIGGAVGGTVSTAIWTSQFPAALHKHLPPGTDVSRIYASIITQLSYKPGTAIRDGISRAYGDAQRYMLITSVCLLAGALICAAAWRDIKLKDIKQVKGRVV

SEQ ID NO: 83765 - protein, 153 aa, Arabidopsis thaliana
MSSKMIVLMSSDGQSFEVEEAVAIQSQTIAHMVEDDCVADGIPLANVESKILVKVIEYCKKHHVDEANPISEEDLNNWDEKFMDLEQSTIFELILAANYLNIKSLLDLTCQTVADMIKGKTPEEIRSTFNIENDFTPEEEEAVRKENQWAFEG

SEQ ID NO: 83766 - protein, 132 aa, Coprinopsis cinerea okayama7#130
MSTSVKKTEEEWRAVLSPEQFRILRQKGTEPPGTGEYNKHKAEGVYNCAGCGTPLYKSSTKFDSGCGWPAFFDAIPGAVSRHTDNSFGMARTEITCTACGGHLGHVFKGEGFPTPTDERHCVNSISLKFKEE

SEQ ID NO: 83767 - protein, 433 aa, Xylella fastidiosa 9a5c
MSSMVADKQGEPTLARIAVVGLGYVGLPLAVAFGRQRPTLGFDIDICRVQQLCAGHDITCEIELEELQAARHLRYSSDPRELSDCQIFIITVPTPIDVAEQPDLGPLRSASMLVASVLKPGDLVIYESTVYPGTTEEVCVPLLEVGSGLCFNVDFHCGYSPERINPGDRKRRLQDICKIISGSTPDITAVVDALYSQIIVAGTWCAPSIRVAEAAKVVENIQRDVNIALVNELALIFNRLGIDTLDVLEAAETKWNFLPFRPGLVGGHCIGVDPYYLLHKSESVGYYPDLIHTARRVNSRVSWHVVDRVVALLGELSVPMTRAVVLVLGVTFKEDCPDLRNSRALDLVRMFRTLGAQVDVCDPCADPQQALEHEAVTLCTEPKAGAYDAIVLAVAHAQYRMYDVATIAALGKPQAVVYDVKSVWPRAAVTDRL

SEQ ID NO: 83768 - protein, 574 aa, Oryza sativa Indica Group
MPGQAAKPKGTGEQGGDAEVVSEERTPSDQQQGSPVSTLDKELSGLSSESGILDDSLVAEEEDSGELKEIQNLDCNGNQEKKTSQKSSTSDSFASAKVSDGTNSLRKTSGSAKTSDRANFTESGKSSMCRASTSSDISDESSRSSMSSATTKPHKGNDSRWEAIQTVKTKDGILGLNHFRLLKKLGSGDIGSVYLSELSGTRSYFAMKVMDKASLASRKKLLRSQTELEILQSLDHPFLPTLYTHFETDKFSCLVMEFCPGGDLHTLRQRQPGKHFSEQAAKFYVAEVLLALEYLHMLGIIYRDLKPENVLVREDGHIMLSDFDLSLRCSVSPTVIKSANPGLDALQRNNAAYCVQPACIEPSCIQPSCVAPTTCFGPRFFKSKSKSKSKKEKSKPEAANQASLFPELIAEPTDARSMSFVGTHEYLAPEIIKGEGHGSAVDWWTFGIFLYELLFGKTPFKGSGNRATLFNVVGQPLRFPESPIVSFSARDMIRGLLVKDPQHRLGYKRGATEIKQHPFFEGVNWALIRCASPPDIPKPVELDCHPKQVPSTNGKVAPASNQKGSDNYLEFEFF

SEQ ID NO: 83769 - protein, 208 aa, Xylella fastidiosa 9a5c
MDDVTKALNLVPMVVEQTSRGERAYDIYSRLLKERLIFLVGPIDDYMANLIVAQLLFLEAENPEKDINIYINSPGGVVTAGMAIYDTMQYIKPAVSTICVGQAASMGALLLASGASGKRYALPNSRVMIHQPLGGFQGQATDIDIHAREILALRARLNEILAKHTGQSLETIAHDTERDNFKSAVDAQAYGLVDQVLGQRPEELIQSS

SEQ ID NO: 83770 - protein, 382 aa, Bacteroides fragilis YCH46
MKVHEYQAKEIFSTYGIPVERHALCHTADGAVAAYHRMGVNRVAIKAQVLTGGRGKAGGVKLANNDRDVYQYAQTILEMTIKGYPVTKILLSEAVNIAAEYYISFTIDRNTRSVTLIMSAAGGMDIEEVARQSPEKIIRCSIDPLIGVPDYLAHKFAFSLFEQAEQANRMATIIQDLYKAFIEKDASLAEINPLVLTPVGTLLAIDAKMVFDDNALYRHPDLQKLSEPTEDEKLEAIAKERGFSYVRMDGEIGCMVNGAGLAMTTMDMIKLYGGNPANFLDIGGSSNPVKVIEAMRLLLDDKKVKVVFINIFGGITRCDDVAIGLLQAFEQIQTDIPIIVRLTGTNGNMGRELLRKNNRFQVAQTMEEATKMAIESLKKESI

SEQ ID NO: 83771 - protein, 553 aa, Parvularcula bermudensis HTCC2503
MVTDPSARAFSWKKLTALAAEGPPPLSDLFDHNPGRVAHFSLEAAGVYADYSKTPVNQTILDALYGLARACDFEARRDAMFGGQRINETEERAVLHVALRDTSDRIYTVDGQNVTTDIHAVKDRMKAFVEKVHDGRHDGYGGAPLDTVVNIGIGGSDLGPAMVSRALDPYTVDGRRTFYVSNVDGADIASVLRQIDPERTLFLIASKTFTTQETMTNAETARNWFLSSGGNEAAIAKHFVALSTNEAAVTDFGIDPENMFAFWDWVGGRYSLWSAIGLSIALQIGWSGFEDLLSGARGMDRHFETMPLEGNLPASLALIDVWHRSFLGYSARAVLPYDQSLARLPAYLQQADMESLGKRIDRSGQVVDYPTGAIVFGEPGTNGQHAFYQLLHQGTDVIPCDFIAAACGQVEVGDHHEKLLANFLAQPEALMAGRSVEAARSEALATGKNPETADRLAIHRSFPGDRPTISLLVERLTPEALGALLALYEHRIFVQSILWDINAFDQWGVELGKGLAKTILAELEGEVDVASHDPSTADLIRRIKRLRREGGVA

SEQ ID NO: 83772 - protein, 927 aa, Oryza sativa Japonica Group
MAPAQCARVQRVFHFGKGKSEGNKAMKDLVSMPGMMDTVLNLGLNDEVAAGLAAKSGDRFAYDSYRRFLDMFGNVRTVHHTGLGGLHNFCPLLGVRNRSVGHLAPDRTGPVAGVEVVRTPLRPEPSTTSLLLPIPAMVRLITSAAAAAAAAATAARRRAPCGPRLSPSWMLDLYQLRLPWPRFAEGNFAFIQPKNWLQVMDIPHALFEEKLEAMKAVKGLHNDTDLTATDLKELVAQYKDVYVEAKGEPFPSDPKKQLQLAVLAVFNSWDSPRAIKYRSINKITGLKGTAVNVQTMVFGNMGNTSGTGVLFTRNPSTGEKKLYGEFLVNAQGEDVVAGIRTPEDLDAMRDHMPEPYEELVENCKILESHYKEMMDIEFTVQENRLWMLQCRTGKRTGKGAVKIAVDMVNEGLVERRTALKMVEPGHLDQLLHPQFENPSGYKDKVIATGLPASPGAAVGQIVFTAEDAEAWHAQGKDVILVRTETSPEDVGGMHAAVGILTARGGMTSHAAVVARGWGKCCVSGCSSVRVNDASKIVVIEDKALHEGEWLSLNGSTGEVIIGKQPLCPPALSGDLETFMSWVDEVRKLKVMANADTPEDATTARQNGAEGIGLCRTEHMFFASDERIKAVRQMIMASSLELRQKALDRLLPYQRSDFEGIFRAMDGLPVTIRLLDPPLHEFLPEGHVEDMVRELCSETGAAQDDVLARVEKLSEVNPMLGFRGCRLGISYPELTEMQARAIFEAAITMTNQGIQVFPEIMVPLVGTPQELGHQVDVIRQIANKVFTDMGKTIGYKVGTMIEIPRAALVADEIAEQAEFFSFGTNDLTQMTFGYSRDDVGKFLPIYLSQGILQHDPFEVLDQRGVGELVKLATERGRKARPNLKVGICGEHGGEPLSVAFFAKAGLDYVSCSPFRVPIARLAAAQVLL

SEQ ID NO: 83773 - protein, 292 aa, Picea sitchensis
MSTAATSICATAAMLGSQSTHSVGVCQSPFWGKKHNMAFACPQLATSSRKVLPTVKASSRVDKFSKTDIIVSPSILSANFATLGEQVKAVELAGCDWVHVDVMDGRFVPNITIGPLVVAALRPVTDLPLDVHLMIVEPDQRVPDFIKAGADIVSVHCEQSSTIHLHRTVNQIKSLGAKAGVVLNPATPLSCIEYVLDVVDLVLIMSVNPGFGGQSFIESQVKKISDLRRMCAERGVNPWIEVDGGVTPSNAYKVIEAGANALVAGSAVFGAKDYAEAIKGIKTSKRPTPVAA

SEQ ID NO: 83774 - protein, 243 aa, Erythrobacter sp. NAP1
MNALVTGASGGIGSAIAIALAKQGARVALSGSNGQKLRAFREQLHEEHGGEHVEITCDLSNTEQVEELIPATLDTLGGIDILVNNAGITRDGLAMRMKDEDWHQVVSINLEAAFRLMRGSARPMMKARFGRIINITSVVGHTGNPGQMNYCAAKAGLTGMTKSFAQEVASRGITANCVAPGFIRTAMTTALDEKQTETINARIPMGKMGAGDDIGAAVSFLASREAGYITGETLHVNGGMAMV

SEQ ID NO: 83775 - protein, 143 aa, Zea mays
SLRHVNIDHLHVGWYQSTYYGSFVTRALLDSQFSYQHAIEESVVLIYDPIKTAQGSLSLKAYRLTPKLMEVCKEKDFSPEALKKGNITFEHMFEEVPIVIKNSHLINVLMWELEKKSAVADKHELLSLASSNHLGKTLQLLMD

SEQ ID NO: 83776 - protein, 158 aa, Bacillus licheniformis ATCC 14580
MFRIGQGFDVHQLVEGRPLIIGGITIPYEKGLLGHSDADVLLHTIADACLGAVGEGDIGKHFPDTDPEFKDADSFKLLRHVWMIVKEKGYTLGNLDCTIIAQKPKMAPYIEDMRARIAEGLEAEISQINVKATTTEKLGFTGRAEGIAAQASVLLQKV

SEQ ID NO: 83777 - protein, 375 aa, Marinobacter sp. ELB17
MAKRDYYETLGVSRDADDKEVKRAYRKLAMKYHPDRNPDDKDADNKFKEASEAYEILADANKRAAYDQFGHAGVDGQGGGGFGGGNGNFSDIFGDVFGDIFGGGGGRGRNTRGSDLRYTLDLDLEEAVKGRTVKITIPGHRECETCDGSGAEKGSRPEACGTCKGMGQVRMQQGFFTVQQACPTCRGAGKVIKNPCSKCHGQGRVKEEKTLSVKVPPGVDTGDRIRLSGEGEMGIEGGPPGDLYVQMAVREHSIFTRDGRNLYCEVPISIVDAALGGELEVPTLDGRVKLKIPAETQTGKLFRLRNKGVAPVRGGGAGDLLCRVTIETPVRLTKRQKELLNEFQDTLDSGDGDQHGPKKTSWFRGVKSFFDETKF

SEQ ID NO: 83778 - protein, 216 aa, Bacillus licheniformis ATCC 14580
MFFKMLKEDVDVVFDQDPAARSYIEVILTYSGLHAIWAHRIAHALYKRKRFFIARAISQIARFFTGIEIHPGAKIGRRFFIDHGMGVVIGETCEIGNNVTVFQGVTLGGTGKEKGKRHPTIEDDALISTGAKVLGSITVGRGAKIGAGSVVLHDVPECSTVVGIPGRVVVQNGKKIRRDLNHQDLPDPVADRFRELENEIRQLKQELRRKEREDEL

SEQ ID NO: 83779 - protein, 406 aa, Alcanivorax sp. EPR 7
IGGTCVNTGCVPSKIMIRAAHIAHLRTESPFDAGLSAQAPVVDRAKLLEQQQRRVEELRDAKYEGILRDHPAITVLHGEARFIDAHSLMVKLNEGGEQVVHFDRAFIGTGARPAVPPIPGLADTPYLTSTSALALDTLPERLIVIGASVVALELAQAFARLGSRVTVLARSRLLSQEDPAVGDAVEAAFRREGIEVLKQTQASRVDYTDNEFIVDTNAGTLRADQLLVATGRTPNTEALNLASLGVETAHGAILVDEHLHTTVPGLYAAGDCTDQPEFVYVAAAGGSRAAVNMTGGEATLDLSAMPAVIFTDPQVATVGLTEAEAIEQGFSVDTRELDLENVPRALVNFDTGGFIKLVAERDSGRLLGVQAVAGEAGELIQTAVMALRARMAVHDIANELFPYLRW

SEQ ID NO: 83780 - protein, 306 aa, Streptomyces coelicolor A3(2)
MSDGTSNAPTRKHTALPKAQILIEALPWLTRHHGKTVVIKFGGNAMIDEDLKAAFAQDVVFLRHAGLKPVVVHGGGPQISAALDKHGIVSEFKAGLRVTTEDAMDVVRMVLAGQVQRELVGLLNQHGPLAVGLTGEDAHTLTATKHQPEIDGELVDIGRVGEITEIDTGAIEALLADGRIPVVSSIARSQDDHHVYNVNADTAAAALAAALGAETLMVLTDVEGLYEDWPDSDEVISRLTASELEKLLPDLSSGMVPKMEGCLHAVRGGVTTARVIDGRVQHSILLEIFTDEGIGTMVVPDEQGES

SEQ ID NO: 83781 - protein, 376 aa, Marinobacter sp. ELB17
MSTPAILALADGSLFYGTAIGVDGETSGEVVFNTAMTGYQEILTDPSYARQLVTLTYPHIGNTGVNPEDVESDRIHAAALIIRDLPLAASNWRSTQSLDGYLRDNNIVGIADIDTRRLTRILRDKGSQSGAVVAGESATAERALELAKAFPGLKGMDLAKEVSSKDVSHWTETAWDLVNGYGQQDSPHFKIVAYDYGIKLNILRMLASRGCDITVVPAQTPAADVLVMNPDGVFLSNGPGDPEPCDYAIKAIQDILEADLPVFGICLGHQLLALASGAKTMKMNHGHHGANHPVQCLADGTVMITSQNHGFAVDEASLPANLEATHKSLFDGTLQGLRRTDKAAFSFQGHPEASPGPHDVAPLFDQFIRSMEARRG

SEQ ID NO: 83782 - protein, 261 aa, Oryza sativa Indica Group
MGFCTVQSPIDGIFVLTMASSDGHQYLTDEAIGDLIASLTAVRDTPGLRGLVTTSRLGSFCDGVDHDAAGQPDEQVAARVGEVVRLLLEMPAPTAAAVNGDATSLGLALALAHDHCVVWEGAAVALPEARRRRPLPGYVAALLRDKVAYARLRKLLMLRAEACTGKELVGTWYSANDPAAADREVVAAEACELLEGIEVGSGKNYATARQAMWPESCAAVGMEITRPRRPSSPEQILHVSEKEKEKHGASDQYQIKQTKIM

SEQ ID NO: 83783 - protein, 468 aa, Mesorhizobium loti MAFF303099
MRLSNLGTEQLREKDRSFVFHPSTHLAKHSRGETPNRIMAGAEGVYIWDTEGRKSLDGFGGLYCVNMGYGCTEIAEAIARQAHELPFAHVYASQGTEPVALLAEAVVEYFGQNMRRVFFGLSGSDANETNIKLVWYYNNILGRPEKKKIISRHRGYHGSGLVTGSLTGLAFFHNFFDLPLDLVRHTTTPHHYRQAHDGESEQAFSTRCADELEGLILAEGPETVAAFIGEPVLGTGGIVPPPKGYWTAIQGVLDKYDILLIADEVVCGFGRTGEQFGSHLYGMRPDFVTIAKGLSSAYLPISGSIIGDRVWSVLEQGTEKHGALGHGWTYSGHTLCAAAALANIRLLKERNILEHVRDVGPYWHARMNAELAGHPIVGEVRGVGILAAVELMRDPKQRIPFESDLQVGVRAAAALFENGVIGRAMPHGDILGFAPPLIITRKEIDIIVDATAKSVETTYRALKAEGAI

SEQ ID NO: 83784 - protein, 423 aa, Coccidioides immitis RS
MSSAYHASSTQAAISAEDEFAAHNYHPLPVVFARASGVSVWDPEGRHYLDFLSAYSAVNQGHCHPELVKALCEQAATLTLSSRAFYNDVFPRFAEFVTKYFGYDMVLPMNTGAEAVETAIKIARKWGYKVKGIPQNEAIVLSVENNFHGRTFAAISMSTDPESRDNYGPYLPNIGSKIPGTDKPITYNDKQALREAFEAAGPKIAAFLVEPIQGEAGIVVPDEDYLQEARALCDKHNALLICDEIQTGIARTGKLLCQEWSGIRGDLVLLGKAISGGMYPVSCVLGHKDVMLTIEPGTHGSTYGGNPLGCAVAYRALEVIRDEKMTERAEKFGKIFRDGLNALNNPIIQTVRGRGLLNAIVVDESKTGGRTAWDLCMIMKEKGLLAKPTHQNIIRFAPPLVITDEQMKQALSIIEESLKELKA

SEQ ID NO: 83785 - protein, 190 aa, Wolbachia endosymbiont of Drosophila simulans
MFIQIEETPNPNTLKFLPGFEILNEGETTDFSNANEIKNSKLAANLFQIEHVVRVFFGHDFISVTKLGGINWDTLKVEILTTIMDHFTSGGKALDKEGVNDNNIPDEEFFDKNDIEIVNRIKELMESYIKPAVAQDGGDIKFRGYKDGIVYVELQGACSGCPSAAITLKQGVQNMLSYHIPEIAGIETTL

SEQ ID NO: 83786 - protein, 524 aa, Erythrobacter sp. NAP1
MDDQHLPDSILIVDFGSQVTQLIARRVREAGVYSEIAPFSMAEEAFKRLNPKGIILSGSPASVPDDGSPRTPQAFFEAGVPILGICYGQQVMSHQLGGEVRPGHETGEGGEFGRAYLTVTKECALFDGLWKEGERHQVWMSHGDKVTEFAPGFEIVATSDGAPFAVIADEKRKFYGTQFHPEVVHTPDGGKLLANFVRHVCGLKGDWTMAEFRKTKIEEIRAQVGEGRVICGLSGGVDSAVAAVLIHEAIGDQLTCVYVDHGLMRLNETEQVVSLFRDHYNIPLIAVDAEETFLAGLAGVTDPEKKRKFIGGAFIDLFEAEAKKVGGADFLAQGTLYPDVIESVSFTGGPSVTIKSHHNVGGLPERMNMELVEPLRELFKDEVRELGRELGLPEAFVGRHPFPGPGLAIRIPGEVTKERCDILRKADAIYLEEIRNAGLYDAIWQAFAVLLPVKTVGVMGDGRTYDSVCGLRAVTSTDGMTADVFPFDAAFLSQVATRIINEVKGINRVVYDYTSKPPGTIEWE

SEQ ID NO: 83787 - protein, 443 aa, Blastopirellula marina DSM 3645
MTSRLFYWSLTSALAGFLFGFDTVVISGAEETIEKLWDLDKVTHGLAMSAALWGTVIGSLIGGWPTDAWGRRKTLLSIGVLYFISAVWSALANDVSAFMIARLVGGLGVGISTVVAPLYISEISPPERRGRLAAMFQFNIVFGILIAYASNALLAGIGPNSWRWMLGVEAFPAIIYTLMCFTLPESPRWLITKKNDREAGLRVLQMVAPERTPAEIDALANEIAEAATVEKQSLSSFWSAKMKTPIMLAFLVAFFNQMSGINAILYFAPRIFKEAGQSGEAALQTSVSIGIVNLIFTFAGLWLIDRLGRKTLLWIGSVGYIVSLVGCSWASWNDQYVVLAACVNIFIASHAIGQGAVIWVLISEVFPNRYRAMGQSLGSSTHWVFAALITALFPLFAEQLGMGAIFLFFCGMMVLQLIWVVTMVPETKGVPLEEMERKLGVTP

SEQ ID NO: 83788 - protein, 316 aa, Dechloromonas aromatica RCB
MAYNSLMVFTGNANPKLAADVAKQLNVDLGRANVGRFSDGEVSVELQEHVRGRDIFVLQSTCAPTNDNLMELLVIVDSLKRASAGRITATIPYFGYARQDRRSRSSRVPIAAKLVANMLVASGVDRVLTMDLHAEQIQGFFDIPVDNIYALPILLDDIRKQNYENPLVVSPDHGGVVRARSLAKRLECDLAIIDKRRPKANVSEVMNIIGEVDGRTCIIMDDMVDTAGTLCKAATALKANGAKKVVAYCTHPVLSGPAIERVNSSDLDALVVTDTIPLRDDAAASPRIRQLSVAEIMAETIRRISNDDSVSSLFID

SEQ ID NO: 83789 - protein, 755 aa, Haemophilus somnus 129PT
MDAQLRQAALDFHEFPKPGKIEVTPTKSLGTQRDLALAYSPGVAVPCLEIQADPASAYRYTSRGNLVAVISNGTAVLGLGNIGALAGKPVMEGKGVLFKKFAGVDVFDIEIDEQNPDKLVEVIAALEPTFGGINLEDIKAPECFYIEQKLRERLKIPVFHDDQHGTAIISAAAIINGLRIVNKKIEDVRLVASGAGAASIACLNLLVSLGMKRENITVCDSKGVIYKGRDEKMDDTKKLYAIDDNGQRSLADAIPDSDIFLGCSAAGALTQEMVKTMGPNPLILALANPEPEILPPLAKAVRPDAIVCTGRSDYPNQVNNVLCFPFIFRGALDVSATTINEEMKLAAVYAIADLALAEQSEVVSSAYGESGVSFGPDYIIPKPFDPRLIVKIAPAVAKAAMDSGVATRPIEDFEAYIEKLTQFVYKTNLFMKPVFAQAKEDKKRVILTDGEEKRVLHAIQEIATLGIAYPVLLGRTHIIEESIKKLGLQLQLGRDFEIIDIENNPYYEECCDTYYNKLKRQGMTPTGAKRKMLHNPTALGAVLLELGKVDAMICGLVGPFAAHLATVKEVVGEKEHEIPATVNGLVLPTGNLFIADTFVNSSPTAEELAEITIMSAKEVRRFGIEPQVALVSHSNYGSINDPSAVKMRQVLELVREKAPDLIIDGEMHCDIALSENLRKEVMPDSPIKGAANLLIMPNMETARISLNLLQGTATPITIGPILMGVEKPAHILTSASSVRRIINMVAVAAVKAQNR

SEQ ID NO: 83790 - protein, 260 aa, Shewanella oneidensis MR-1
MSTNNSVLVLKVGGALLQCEMGMARLMDTAAAMIANGQQVLMVHGGGCLVDEQLAANGMETVKLEGLRVTPPEQMPIIAGALAGTSNKILQGAATKAGIVSVGMCLADGNTVSAKIKDERLGLVGEVYPKDATYLKFILSQGWMPICSSIAMMDDGQMLNVNADQAATVLAKLVGGKLVLLSDVSGVLDGKGQLIPSLNGQQIADLVKQGVIEKGMKVKVEAALEVAQWMGQAVQVASWRDASQLVALAKGEAVGTQIQP

SEQ ID NO: 83791 - protein, 363 aa, Dechloromonas aromatica RCB
MSLKCGIVGLPNVGKSTLFNALTKAGIEAANYPFCTIEPNVGIVEVPDKRMKALAEIVKPQKMQPAIVEFVDIAGLVAGASKGEGLGNQFLANIRETDAVVHVVRCFADDNVVHVSGGVDPLRDIEVIDTELALADMATVEKALNRYRRPASSGDKEAKILVAVLEKCFTQLDQAKAVRALDLSKEEWACLKPFCLITAKPVLYVANVAEDGFTNNPLLDAVRAHAAAEKAEVVSLCASIESEIADLDDEEKEMFLADLGLEEPGLDRLIHAGYKLLGLQTYFTAGVKEVRAWTIHQGDTAPQAAGVIHTDFERGFIRAQTIAFEDFITYKGEAGAKEAGKMRAEGKEYVVKDGDVMNFLFNV

SEQ ID NO: 83792 - protein, 334 aa, Coxiella burnetii RSA 493
MRTLVTGCAGFIGFHLTKRLLARGDHILGLDNLNDYYDVNLKEARLAQLKEFPHFSFHKLDLADRQGMTDLFQKHLFDTVVHLAAQAGVRYSLTNPYAYVDSNLVGFAHILEGCRHQSVKHLVFASSSSVYGANEKYPFSESDNVDHPIALYAASKKANELMAHSYAHLFQLPCTGLRFFTVYGPWGRPDMALFKFTRNLLADKPIDVYNHGKMSRDFTYIDDIVDGILLTLDHPPEPNSAYSANQPNPAKSNAPYRIYNIGSNNPILLTNFIAILEKTLNKKAIKNFLPLQPGDVPETYADVSQLEKDFQYRPRTPLQKGVKNFVEWYLQYFS

SEQ ID NO: 83793 - protein, 301 aa, Shewanella oneidensis MR-1
MKHFLSIKELTQQQLLDLITLAKTIKANPAEYRHALDGKSVVMLFEKPSLRTRVSFDIGINKFGGHCLYLDQQNGALGKRESVADFASNLSCWADAIVARTYSHTTIEQLAEFGTVPVINALSDLYHPCQALADFLTLAEHFENISDVKLAYVGDGNNVTNSLMYCAAILGATMTVICPAGHFPDGYVVAEVQELASRYGGKIVLTSDIDAIEGHDAIYTDTWISMGDPTPLAEIKDKFAPYQVNNALMAKAGAHFFMHCLPAHRGVEVTDAVMDGECSLILQQAENRMHAQNAVLVTLFS

SEQ ID NO: 83794 - protein, 135 aa, Vitis vinifera
MATITASNPATSLVRASVASKGLNGISSPVLGLPAMAKKGRVRCMSEEKPCGSDMGSSISMGASLMAAAAAVAASAGPAMALVDERLSTEGTGLPFGLSNNLLGWILFGVFGLIWALYFTYTATLEEDDESGLSL

SEQ ID NO: 83795 - protein, 255 aa, Brassica napus
RFSKEEMVVDLQNLFQRFTFDTTFVLVTGFDPKTLSVEMPEDEYAEALDVLGEGIFFRHVIPKFLWKLQKWIGFGQEKRTMEADATFDRVSAKYILAKRHEVLSQGIHDQQQSNGECHEDLLTSHMKLDTTKYELLNPSDDKFLRDTILAFNLAGRDTTASALSWFFWLLSENPRVVTKIRQEIITNISLHGQDNLDKLVYLQAALYESMRLYPPVPFQRKSPIKPDLLPSGHKVEANSTIMIFLYALGRMRAVW

SEQ ID NO: 83796 - protein, 429 aa, Coxiella burnetii RSA 493
MNAVARKIAVIGLGYVGLPVAVAFSRLQPVIAYDKNSARIRALKQGYDACGEVDSQQLRTCQIDFTDDPDDLAKADFYIVAVPTPIDQSKHPDLSLLLNASETIGRYLKRGDIVVFESTVYPGVTEEECAPVLEKASGLKYGVDFTLGYSPERINPSDKTHRFETITKIVSGSDPETLDIVAHVYGSVITAGIYRAPSIRTAEAAKVIENTQRDLNIALMNELAIIFKRMDIDTQEVLAAAGTKWNFLPFKPGLVGGHCIGVDPYYLTYQAQRYGYNPQVILAGRRINDTMGKYIAEQTIKQMIHAGYTIKGAKVAVLGLTFKENCPDLRNSKVIDIIEELNDYGIECVVHDPLADPEVAKQLYNIDLKSWDEIHDVDSFVLAVAHDQFHQYSLEDYHAKLAHHSIIVDVKNVLNPQDCKSNGITLWRL

SEQ ID NO: 83797 - protein, 449 aa, Coxiella burnetii RSA 493
MKVSVYGAGYVGLVSAVCLAELGHSVCCCDVNEEKIAKLMQGITPIHEQQLEPLLQKNLKIKRIFFTTRSDEAVKHGVIQIIAVGTPSADSGQVDMRYVDSVVETLGEQLTNYAIIVTKSTVAVGTADRISTQIENQLQKRKANIEFDVVSNPEFLKEGTAVIDFLDPDRVVVGVNNSRAANLMKELYAPLIKKGRPFVVMDRRSAEFSKYVSNAFLATKISFINEMSHFAEYFEADIEAVKIALGLDSRINGKFLNPGCGFGGSCFPKDLLALQSISRTAAIPASMVNAVLEVNERQKLILYEKIRRYFNGNLQGKIIAVWGLAFKPHTDDVRSASSLKLIESFWKAGAIVQAYDPLAMENIRALYGELSQLKLCENAYAALNNADVLAIVTEWDEFKNPNFALIKDSLRYPAIFDGRNLYQPHQLQEWGFDYFAIARGGIQFQTLPT

SEQ ID NO: 83798 - protein, 463 aa, Legionella pneumophila subsp. pneumophila str. Philadelphia 1
MDLFRKKDIKGSLDNESHLAKCLSVFDLTFLGVGAIIGAGIFVLTGIVAATISGPAVIFSYVVAGFACAFAALSYAELAASIGGCGSAYGYAYAGFGELIAWIVGWDLLLEYSIAVSAVSIGWSGYANDFLMALKIFIPTHLLHGPADGGDLNILAILIIAVLTTLLIVGVKSSSRFNNIMVLVKLLVIFIFIAIAFGEVKVENWSSFMPYGWAGVMKGASIIFFAYVGFDAVSTAAEEAINPQRDLPIGIIASLAICTVIYILVSGLLTGIAHYTTLNVSSPISHVLLVLGYKTAAGLVGVGAIAGLTTVMLVLFYGLTRVFLAMSRDGLLPRFLSKTNEHTKTPIRIILLCGILMASLASVTPIGTLAELVNIGTLFAFIVVCGGVLYLRRTHPDMERPFKTPFMPYVPILGIISCFYLILNLPWVTILRFIIWMAVGMAVYFAFSRGNSALSVEGDCAAE

SEQ ID NO: 83799 - protein, 369 aa, Dechloromonas aromatica RCB
MPPHPAIASTAEIVTELKAGRMVILVDEEDRENEGDLVMAAEHITPEAINFMAKFGRGLVCLTLTEARCKKLGLTQMARNNGTVYGTAFTVSIEAAEGVTTGISAADRARTIQVAVNKASTADDIVQPGHVFPITAREGGVLVRAGHTEAGCDLAGMAGLEPSSVICEIMNDDGTMARLPELIEFAKEHGLKIGTIADLIHYRASSETLVERVTSKTVSTAHGDFTLHAYVDRASGATHLAMVKGSLPAGGETLVRVHEPLSVLDFLDPASKRQAFSIDQAQAALAKHGHGVIVLMHRPEDGAALLSRLTGTAPTAPAKWDPRSYGIGAQILRDLGVTKMRLLSSPRKMPSMTGFELEVTGFVTSPAEL

SEQ ID NO: 83800 - protein, 547 aa, Coxiella burnetii RSA 493
MSLVESPPWQALKSKYQELSSLHMRDFFAQDKKRGTRLSLEAAGLYFDYSKNRVDEKTIDLLCESANACNLPLRIEQLFSGKLTNESGEMVGFHTALRQVNNFSFKTNNNAIQEIHASWEKIKKLSIRIREGDYKGFTNKSITDIVNIGIGGSSLGPQMAYNALKPYVKAPLRCHFISNLDDTDFYETVRTLNPETTLFIITSKTFTTKETLENARRATEWLMQAAKKENLIQTHFMAVTAAPEKAHEFGIQKDNIFMLWPWVGGRFSVWSAAGLSLAIAIGWEEFFEFLRGAHAMDTHFRQAEFNKNMPILLALLSIWYINFFHAKTQAIIPYSQRLVYLPDYLTQLHMESLGKSVQLDGSAVHWQTGAVVWGDLGTNSQHSFHQLFLQGTMVIPVDFIAVLKNSRESHWQLPLIANCLGQSQTLMEGYDKEGVMRDLINQGIEHEKAEKLATYRLIRGNNPSNTIILEELNPYSLGSLLALYEHKVYVQSVIWNINPFDQWGVERGKHLAKDILQALQAETDQSSFDSSTERLINYVLKIKGNRP

SEQ ID NO: 83801 - protein, 285 aa, Parvularcula bermudensis HTCC2503
MSRLSPSPQTPPWPLHNEEDFEGMRRAGQLAASCLDMLTREVVPGVDTLTLDRLAREFVLDHGAVSATIGYRGYRHALCISPNHVICHGIPGQKPINGKPLREGDIANIDVTVVLDGWHGDTSRMYTLDPISVKAQRLVDVTFECLWKGIDTVRPGATLRDIGQAIQSHAESAGFSVVRDFCGHGLGRAFHNAPNVVHYGEVKDHLGRTQTTPDTPLTEGMFFTIEPMINAGKPDVRMLKDGWTAVTRDRSLTAQFEHSLGVTADGVDVFTRSPEGLDRPPYGAS

SEQ ID NO: 83802 - protein, 179 aa, Streptomyces coelicolor A3(2)
MRAAASQSATRACWNSTAGAWAGTRFRLRSGKALGTDRKEVAVRFRSVPHLPFGQDQDVRPNVLRFGLEPESLSVDLTATGSRPETLTQLSLTARMDTPDLPAYGRLLLDVLRGDPALSIRGDEAEEAWRVVEPVLSAWERGLVPLEEYPAGSDGPPPRHATPERRDDLLHEESVMRAE

SEQ ID NO: 83803 - protein, 376 aa, Schizosaccharomyces pombe
IMAASRNVAMMVVGRFIVGYGIGLTSLIVPMYITELAPARLRGRLVIIYVVFITGGQLIAYSLNAAFEHVHQGWRIMFGIGAAPALGQLISLFWTPESPRYLLRHHHVEKVYKILSRIHPEAKPAEIAYKVSLIQEGVKVDFPEGNKFQHFFHSLKVLFTVPSNRRSLFIGCFLQWFQQFSGTNAIQYFSAIIFQSVGFKNSISVSMVVGATNFVFTIVAFMFIDRIGRRRILLCTSAVMIAGLALCAIAYHFLPADTTQNTHSGWQYVVIASIIIFLASYASGIGNIPWQQAELFPMEVRALGAGFSTAINWVGNLIISASFLTMMESITPTGTFALFAGFCFVGLVTSYFTYPELAGMFIENIHKLLEKGFWQA

SEQ ID NO: 83804 - protein, 295 aa, Coxiella burnetii RSA 493
MKKVTTAVFPVAGLGTRFLPVTKAGPKEMLPIVDKPIIQYVVEEAIAAGITHLVFVTSSSKRAIEDYFDSNYELETRLRSSRKLDALKLIQNLLPKEVRISYVRQAHPLGLGDAVLSAKHVVGDQPFAVLLPDDIIDCGEKSCLQLMMEAFEKHQRNIIAVEQVPLNQTDKYGIVSVVDEHQVKRITGMVEKPPLGSALSDWAVTGRYILSPRVFDHLDAISCGVGGEIQLTDAIVALLQEEQVLAFPFKGHRYDCGSRLGFLQATIAYALKRPEFKEPLREYLFKLLGSECVGG

SEQ ID NO: 83805 - protein, 210 aa, Bacteroides fragilis YCH46
MRSLIGKQAPKFDATAVINGHEIVQNFSLDQYKGKKYVVFFFYPMDFTFVCPTELHAFQEKLEEFEKRDVAVVGCSVDSEYSHFSWLQMPKNEGGIQGVKYPIVSDFSKSISESYGVLAGSYAPDENGNWVCEGTPVAFRGLFLIDKEGVVRHCVINDLPLGRNVDEVLRMVDALQHFEEYGEVCPANWSKGKDAMKATEDGVANYLSKH

SEQ ID NO: 83806 - protein, 378 aa, Helicobacter hepaticus ATCC 51449
MSIWRIAQIFVCVLVMALGMLGCSSEEKAQQVKEKRSEKLEGFEQNAKIKKPNIVILATGGTIAGAVDSQIKTTGYNAGVISVDTLIEAVPQLQEIAHIQGEQIANIDSADMNDEIWLTLAQRVNKLLENPKIDGIVITHGTDTMEESAFFLHLTTRSDKPVVLTGAMRPSTAISADGPKNLYNALALAANTQSKGKGVMVVMNDRIQSARYVSKTHSLNVDAFSSPNSGDMGYILDGKVFFYTFPNKPHTTHSEFDVRSLRSLPKVDILYSYANDGLAIAAQALANQGTKGLVIAGSGAGSIHKNHKDMLKKLMQEGLIVVQSSRINNGIVLASEADAKLGFIGSGDLNPQKARVLLMLALTQTKNSAEIAKIFQRY

SEQ ID NO: 83807 - protein, 273 aa, Candidatus Kuenenia stuttgartiensis
MKVHPNTLAAYLEVAKQAAMEAGNVLKKYFRKLDASMIEEKAANDFVTDVDRRSEQIIKNHIITHFSDHAILAEESETQTNTSPFLWIIDPLDGTANYIHGVPAFAISIALEIKGELCMGIVYDPIKADIFSAVKGQGASKNGKPIHVSLPKNLNDSLIATGFPFRKKNIVDTYVKIFRELLNHASDMRRCGSASLDLAYTADGIFSGFFEYALSPWDIAAGALLVQEAGGITTDFNGKNNYLKTGNIIAGSKIIHNELLKIIQSNDPNYFEK

SEQ ID NO: 83808 - protein, 270 aa, Sinorhizobium meliloti 1021
MVPAKFVEVEFRMADERVSARGGMETSFGFREVGTGEKQPLVNDVFHKVAKRYDIMNDVMSAGLHRVWKDAMIAALNPPGREDYRVLDVAGGTGDIAFRIVERSGRKAHATVLDINGSMLSVGAERARKKGIEANLDFVEANAEDLPFAANSFDAYTIAFGIRNVPRIEVALKEAYRVLKRGGRLLVLEFSEVEMPLLDRFYDAWSFNAIPKFGKLITGDDAPYQYLVESIRKFPNQRDFAAMIRDAGFARVSFTNYTGGIAALHSGWKI

SEQ ID NO: 83809 - protein, 567 aa, Dehalococcoides sp. VS
MEELGSSFGLDLIIVLIAAVLAGLLARRFKLPLLLGYLGAGIAIGPNGFGLVQSPGVIESMATVGVILLLFTLGLDFSLDELKRVGKVAVLGGLIQIIVTAGFGFLLGRGLGWDINASIFFGFMVSLSSTLIVLKILMDRGEAEAPHGRVMLGILLVQDICLIPLMIILPALGSEGGDIGLTIGVAFAKAAAFILVMFALGFWVFPRLLGRVASHSHELFLLSVITLSLGAAMGATALGLSPAVGAFIAGLLIGQSMYAKQALADIIPLRDIFGALFFVSLGMLANLNFAVENMGLVLLVVVFLLVIKSLVAGVVPWLFGYTFQTSFTTGIGLMQIGEFSFVLAGVGLASSVISDSIYAITISSAVITMIITPFALSFSGAAYRKVSQWPLASKLVSLRTSGQAEFMDLDISNHAVICSQGGVAKTLTRVMNRRNFPFLVIDLDPQTIAELRRQKAPAIYGDAANPEILRFARLEKARLLICAMPGFADTEQVVKNARKINARLDIVARVTSDTQAAKLKQMGVSEVVQPEFEVGLELSRHAMHRFGMTTIEIQYILNSLRNMGKNE

SEQ ID NO: 83810 - protein, 607 aa, Oryza sativa Japonica Group
MSRRHARPLLPLLRRHLHRSATVHRSPAPAPPDGIPSSSSAPPDPAAARWPSSWSPAAPPLHSFAASHLREAVSPIAAAILALPGVDPDPLPALVEHNFPTLLAVSPLASLELLSLLRPNPQLGLAVFSSRRTLSPPATLPEFVLAISLAGRARDPAAAARLFAEASTAYCPDQALYNALMSSYMHSGLADRCIEAFHTLERDPRCGPPNADSYNILIALFGRSLLVDHMEATLLSLDASGHPRTIGTYNAIIAGYLTAWMWEKMESVFDEMVSGHVAPDKTTYLLMLRGYAHAGMIYKMELAYERARQHVGQVDMVHIRAMICAYCKFKHVDRIQKIEELLQKLGPDDYRPWLAVLLIRAYAQEGLVERMEQWIAEALERNTIVTTVQVMRSIITSYFQCDAVDKLAHFIRQAEEAGWKLCRSLYHCKMVMYGKQHRLPEMHGVLDEMEFFRFDRTKKTFWIMYKAYVSSGRMAEANTILCMMGKHGFGFPRGGTGADVEEASDGIGGGDVSGVRDSPVLGVDSSEVAAPYLRQCRRSQRQRRWRLVEGEVMGMALTWAAGKTALTAPNQIGSRGACMDGGAQCDTRRKCPAKKRRRLGGEDHTDI

SEQ ID NO: 83811 - protein, 1080 aa, Triticum aestivum
MDGDADALKSGRHGAGDVCQICADGLGTTVDGEVFTACDVCRFPVCRPCYEHERKEGTQACLQCKTKYKRHRGSPPIRGEEGDDTDADDGSDFNYPASGTEDQKQKIADRMRSWRMNTGGSGNVGHPKYDSGEIGLSKYDSGEIPRGYVPSVTNSQMSGEIPGASPDHHMMSPTGNISRRAPFPYVNHSPNPSREFSGSIGNVAWKERVDGWKMKQDKGAIPMTNGTSIAPSEGRAATDIDASTEYNMEDALLNDETRQPLSRKVPIASSKINPYRMVIVLRLVVLSIFLHYRLTNPVRNAYPLWLLSVICEIWFALSWILDQFPKWFPINRETYLDRLALRYDREGEPSQLAAVDIFVSTVDPLKEPPIVTANTVLSILAVDYPVDKVSCYVSDDGASMLTFDALAETSEFARKWVPFVKKYDIEPRAPEFYFCQKIDYLKDKVQPSFVKDRRAMKREYEEFKIRINALVSKALKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKAVREAMCFLMDPNLGPQVCYVQFPQRFDGIDRNDRYANRNTVFFDINLRGLDGIQGPVYVGTGCVFNRTAIYGYEPPIKAKKPGFLASLCGGKKKTSKSKKRSSDKKKSNKHVDSSVPVFNLEDIEEGVEGAGFDDEKSVLMSQMSLEKRFGQSAAFVASTLMEYGGVPQSSTPESLLKEAIHVISCGYEDKSEWGTEIGWIYGSVTEDILTGFKMHARGWRSVYCMPKRPAFKGSAPINLSDRLNQVLRWALGSVEILFSRHCPLWYGYGGRLKFLERFAYINTTIYPLTSLPLLVYCILPAICLLTGKFIMPEISNLASIWFIALFLSIFATGILEMRWSGVGIDEWWRNEQFWVIGGISAHLFAVFQGLLKVLAGIDTNFTVTSKANDEEGDFAELYMFKWTTLLIPPTTILIINMVGVVAGTSYAINSGYQSWGPLFGKLFFAFWVIVHLYPFLKGLMGRQNRTPTIVIVWAVLLASIFSLLWVRVDPFTTRLAGPNIQTCGINC

SEQ ID NO: 83812 - protein, 241 aa, Marinobacter sp. ELB17
MNGSQSLVNELVGLVAQQVRELGMEAVVFPPALYVSAVIQAADNAMAVGVQNVSEKAQGAYTGELSAPMAADVGCRYGLVGHSERRQLFGETDVQVAVKTEQLLSAGLNAIVCVGETLEQREAGQAEATVATQVRDGLSKVTPEQWGQIVVAYEPIWAIGTGKTATGEDAQAMHKAIRGVLANMGAPAESISLLYGGSVKADNAAALFAEPDIDGGLIGGASLSATDFVSICQALPADTHC

SEQ ID NO: 83813 - protein, 659 aa, Coccidioides immitis RS
MSSALSKRQQARHERTLQELIRSVPGNDRCADCEARNPAWASWNLGIFLCMRCAGLHRKLGTHISKVKSLSMDTWSQDQVDNMKRNGNAVVNKVYNPKHIKPPIPIDADEVDPAMERFIRKKYESKVLEDGKPKIPSREDPSYVTKHVEDSPPPLPPKPSRKFGFGFRSSSSHSGSNKSSPRRESFGSISQNSTLHSNKPSRSLGFSFNDPSGSLESKLAVLRNMGFPDDKRNATILKGLNGDVEKTIDALVRLGEGNGSTSRSRTPVLKTPTSAKFSDSYDPTGSSNPFDKMGSSSSRSSAGISINRRESHSTTSSSDEAAARKLAPYNPFGVPPSQQAPTQTLEQSFQNLQVSQPLFPNMTGGYPSQQGQATYRHYQQSMTPPVTMASQSGFAVSPGSLNGSYNPFFQSSSAVDGVAGAVYPSQSQNLSPTNPFFSQAAPPNNFQLQLPDLRQPAQISSTSEVFQLQHANTMPMMSTSSFDNPPQHQQPPPFPQSAPITPVHSTNMPFFQNPYAQQQQQYFQPQQPNRMDKSSILALYNFSKPPPTIPEQPQPQSQPDTVVPQTQQSTNPFPLPSSNQATSPQPPQPSTTGGRNPFFTSSNANTGLTNNPLGSGANSQPANPTYIRTHMSQESMDIGRAQSGRHSPDVFASLSARYG

SEQ ID NO: 83814 - protein, 423 aa, Actinobacillus pleuropneumoniae serovar 1 str. 4074
MNTFNRIAIIGLGYIGLPAAVAFARCGKSVLGVDINPDVVTKINQGRIHFVEPQLEEAVKQAVENGLLFATQIPDPADVFVIAVPTPLTYNHQPDLQYIKQAVKAISPYLVKGNLIVLESTSPVGTTEKLAKWLQKLRPDLSFPTQGNDNADIYIAYCPERVLPGRVMIELFENDRVIGGLTAESTRQAVDLYRIFVKGECIATDARTAEMCKLTENSFRDVNLAFANELSMICDKLNINVWELIRLANRHPRVNILQPGAGVGGHCIAVDPWFIAAQTPDQSRLIRTAREVNDSKPQWVIEKVKQALADCVNRRNCLAGDVTIACLGLSFKADIDDLRGSPALAITQYLADWHRGVVLAVEPHINALPPSLRGKVELVGFEQAIKKADILLLLVDHTAFKNLSPDTMSVPWLIDTKGIWSQL

SEQ ID NO: 83815 - protein, 710 aa, Oryza sativa Japonica Group
MALTTFSISRGGFVGALPQEGHFAPAAAELSLHKLQSRPHKARRRSSSSISASLSTEREAAEYHSQRPPTPLLDTVNYPIHMKNLSLKELQQLADELRSDVIFHVSKTGGHLGSSLGVVELTVALHYVFNTPQDKILWDVGHQSYPHKILTGRRDKMPTMRQTNGLSGFTKRSESEPAYVRLAGMAVGRDLKGGKNNVVAVIGDGAMTAGQAYEAMNNAGYLDSDMIVILNDNKQVSLPTATLDGPAPPVGALSSALSKLQSSRPLRELREVAKGVTKQIGGSVHELAAKVDEYARGMISGSGSTLFEELGLYYIGPVDGHNIDDLITILREVKSTKTTGPVLIHVVTEKGRGYPYAERAADKYHGVAKFDPATGKQFKSPAKTLSYTNYFAEALIAEAEQDNRVVAIHAAMGGGTGLNYFLRRFPNRCFDVGIAEQHAVTFAAGLACEGLKPFCAIYSSFLQRGYDQVVHDVDLQKLPVRFAMDRAGLVGADGPTHCGAFDVTYMACLPNMVVMAPSDEAELCHMVATAAAIDDRPSCFRYPRGNGIGVPLPPNYKGVPLEVGKGRVLLEGERVALLGYGSAVQYCLAAASLVERHGLKVTVADARFCKPLDQTLIRRLASSHEVLLTVEEGSIGGFGSHVAQFMALDGLLDGKLKWRPLVLPDRYIDHGSPADQLAEAGLTPSHIAATVFNVLGQAREALAIMTVPNA

SEQ ID NO: 83816 - protein, 60 aa, Vitis vinifera
MGSLGAILTYPGDIYPLLKLKMADCHPKKQLPPEPRWVFCYTLLHKASRDFSLVVQQLDT

SEQ ID NO: 83817 - protein, 563 aa, Coccidioides immitis RS
MFLINLTLLRKIALLESKMVSKLAVKVVENTGLRLSHPLPERLYYIYRRRARNLAWYDEDGEPPTRNPFKKFRTRSHTRRTTTVAARPEFDAISMEEHRKGEAMAGGIQRAEGTDSMPLPSSVGTDGAFGLPPVGESVNSLVPLRRPEIDAASLSDQSIRRRTTPKHAENANLDDAIIEDPEALGGKEDKQKYTFVGQLRATLFNSWINVLLLAVPVGSYGTEEIAMRTGETVGGLLNATFGNAVELIVSILALFKNEIVIVKTSLIGRINRIEQNFNMTVAQTAASLLALAVGSLIIPTAFHTWSEAGETGIAPLSRGTSIILLFVYGCYLFFQLKSHTEMYNKPSEKVEKRRGKVESGDAIKGIAQIGAGISASMGGHNAQSVPIQVPDDEDQEEPELHFFVALFTLAASTALVGVCAEALVSSIDVITTRGHISETFVGLILLPIVGNAAEHATAITVAMKDKMDLSIGVAVGSSMQIALLVLPLIVVIGWIAGKDDMSLYFDGFQIAVLFVAVLLVNYLIQDGKSHWLEGMLLMTLYLIISVAAWFYPAKSERTGSGAS

SEQ ID NO: 83818 - protein, 415 aa, Salinibacter ruber DSM 13855
MSSSPSSSSPSSEKPFDTIEDALATIRDGGLAIVVDDEDRENEGDFIGAAEAMTPDLVNFMTKEGRGLLCTAIPPERAEELDLDLMVDANSSLYSTPFTVSVDYRQGTSTGISAADRAKTIRALADPDASPYDFARPGHVFPLRARTGGVLRRAGHTEAAVDLARLAGLEPAGALVEIMNEDGSMARVPQLRERAQALDMPLITIQDLIAYRMQNERLIERAAEVDLDTAFGTFQVVAYEETLTGDVHLALLKGDWAEDEPVLVRVHSQNVLGDVLAARRESYSEELAEALLQVEHEGTGAILYMMQSNHGQGLLSKLKDLERHQNQDDGAPTDVSLEMDHRDYGIGCQILRDLGIRKLRLLTNNPRKRIGLAGYGLELVEQTPIELPTEARDHLSTVAADRLTPLLMELIDAGT

SEQ ID NO: 83819 - protein, 160 aa, Dechloromonas aromatica RCB
MSTNSRFDNVFEYDSNLNGAGLKVGVVMCRFNLPVCEGLLSSCIAELKRLGVADADMTIATVPGALEAPLVLQSMAQSGSFDALVALGAVIRGDTYHFEVVSNDACRAIMEVQLDTGVPIANGILTCDTDEQAEVRMQPKGADCAQAAVEMANLQKALLQ

SEQ ID NO: 83820 - protein, 194 aa, Triticum aestivum
RKNCFLFGGSGDRLIRNGFFWGIQEIGVQSWSMNCQTEMSPGCGFFKGKHVAVPELPCPENEVYVAGCFSGTPIILTKTLQLNCRKKHNRKFALDSIPEYGTTECQKDVSDHGLDLQVVDYRSFKPEQAEDYNSMYCQRTIYVDEEDGELSWFNAGVRVGVGIGLGLCVGVGIGVSLLVRSYQATTRNFKRRFI

SEQ ID NO: 83821 - protein, 200 aa, Haemophilus somnus 129PT
MVLVTRQAPDFTAAAVLGNGEIVEKFNLKQHIAGKAAVVFFYPMDFTFVCPSELIAFDHRYKEFQDRNVEIIGVSIDSEFTHNAWRNTPVDNGGIGQVQYALVADIKHEIAKAYGIEHPEAGVALRASFLIDKEGVVRHQVVNDLPLGRNIDEMLRMVDALQFHEEHGEVCPAQWEKGKEGMTGSPEGVAKYLKQNADKL

SEQ ID NO: 83822 - protein, 473 aa, Oryza sativa Japonica Group
MAAALARRGGGGLARALARGRGMCSATAAERAAGAALTSEELMRMERERSAHNYHPIPVVFSKGEGSHILDPEGNKYIDFLSAYSAVNQGHCHPKVLRALKEQAERLTLSSRAFYNDKFPIFAEYLTSMFGYEMMLPMNTGAEGVETAIKLVRKWGYEKKKIPKNEALIVSCCGCFHGRTLGVISMSCDNDATRGFGPLVPGHLKVDFGDTDGLEKIFKDHGERICGFLFEPIQGEAGVIIPPDGYLKAVRDLCSRHNILMIADEIQTGIARTGKMLACDWENIRPDVVILGKALGAGVVPVSAVLADKDIMLCIKPGEHGSTFGGNPLASAVAVASLKVVTDEGLVERAAKLGQEFRDQLQKVQQRFPQIIREVRGRGLLNAVDLSNEALSPASAYDICIKLKERGVLAKPTHDTIIRLAPPLSISPEELAEASKAFSDVLEHDLPQLQKQIKKTESAAEKQSCDRCGRDLY

SEQ ID NO: 83823 - protein, 429 aa, Shigella flexneri 2a str. 2457T
MTTDDLAFDQRHIWHPYTSMTSPLPVYPVASAEGCELILSDGRRLVDGMSSWWAAIHGYNHPQLNAAMKTQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKMCDREGILLIADEIATGFGRTGKLFACEYAEIAPDILCLGKALTGGTMTLSATLTTREVAETISNGEAGCFMHGPTFMGNPLACAAANASLAIIESGEWQQQVAAIEVQLREQLAPARDAEMVADVRVLGAIGVVETTRPVNMAALQKFFVEQGVWIRPFGKLIYLMPPYIILPQQLQRLTAAVNRAVQDETFFCQ

SEQ ID NO: 83824 - protein, 308 aa, Neocallimastix frontalis
MAQKKQQQKLGFYEDFLLAGVSATISKTAAAPLERVKLLVQNQGEMLKSGRLATPYKGIGDCFVRVAKEVGIASFWRGNGANIIRYFPTQALNIAFKERIKNALAVDKEKEGYAEWLVGNIASGGAGGALSQVFVYSLDYARTRLANDAKSANGGERQYKGLIDVYKKTYKADGITGLYRGFALSCVGIMVYRGLYFGLYDSMKPLLKNLGMEGSFAASFILGWGVTTVAGIASYPIDTIRRRMMMTSGETVKYKSSIDCAKQVMQKEGVQAFFKGCGANILRGVAGAGVLSGFDKIKEVYINWRIKN

SEQ ID NO: 83825 - protein, 477 aa, Helicobacter hepaticus ATCC 51449
MTISILCGGSGTRLFPLSRELLPKQFANLLPSKNAQTSSHSLFQETLLRNDFLRKSHKGKFQIITNDNHYFIAQEQAHKINIPLSEFILESLGKNTAPALTFAALKSLESFSLNQNEDDIILALPSDHLIKNTADYEQSIFQAIELAQKGFLVTFGIKPNCPHTGYGYIKAKDSVVEKFIEKPSIKDAKAYVENGNYLWNSGMFCFKAEVFLQELEVHNPEVYKRCKLTFEASKESEAKDFIRLDAKMSENLPDISIDYALMEKSQKVACVSSNFIWNDIGSFESLSNEYPTDEAENASKNTFIQKECKNNFVISDKLVAGIGLEDLMIIDENDCLLIAKKGYSQQVKDIVALLKTTHPELTQIHKTAHRPWGTYTILLESQNYKIKQIVVKPKGKLSLQKHYHRNEHWIIVSGCAIITLGESQKFLKANQSTYIPMGEVHRLENPGILPLVLIEVQMGEYLGEDDIVRLSDDYQRK

SEQ ID NO: 83826 - protein, 421 aa, Lactobacillus reuteri
MYLMCVSLNYHQLPIELREKFSFSADEIPKANRLLNAEKSILENLLISTCNRTEIYAVVDQVHTGRYYIKRFLAEWFHYTVEEFNQYVSITTKDDAASHLFRVIVGLDSLIKGEPQILGQMKNAFQVATDQGTTGVILNHLFRQAITFSKRMHTEYRVSELAQSSSQAGLHQIKSDFGSLEGKSLAVIGLGHIGKHTAYNASNMGFSKVLLLNRTDQKAKQIANELQGVVEARPFSRLDSVMAEVDAAVFAASVKEPLYRVTDDRQQVIVDLGVPRNVAYDSESVNYYDIDNLHSILETNDTKKNQMLNQIAKEIPLEVNNFYVWEKQLHIVPVIRGLREHSLKIEGEAYDSLLRKLPELNAHERKVISKHMKSIINQMIKGPIKEIKELSVTPGATSDIDFFCKIFGMDNLKVENQENDR

SEQ ID NO: 83827 - protein, 474 aa, Acidobacteria bacterium Ellin345
MADQKTPNIAVIGGGPGGYAAAFLAADLGMTVTLIDMELNPGGVCLYRGCIPSKALLHVAKLIEEAKHSTNWGVTYDAPKIDLERLRTFKEGVVKKLTGGLGQLSKQRKVTYIQGKATLVDSCTVKVEKTAGGEETLHFDKLILATGSRPAVIPAFNIGSPRVMDSTGALNLEDIPKRLLVVGGGYIGLELGSVYAAIGSKVSVVEMTAGLLPGADRDLVAPLHKRLTGIFEAIMLNTTVISIADTGSAVKVKFKTQDGKEEEQTYDRVLVSVGRKPNSQIPGLDKTRVKVNQKGFLQVNPSLMTDDPFIYAIGDVVGEPMLAHKASHEGLVAVESIAGHKVAFEPQAIPAVVFTDPEIAWAGLTETQAQNEGREVTVTKFPWAASGRAVTIDRTEGLTKLIIDPQTERVLGVGICGPGAGEMIAEGVVAIEMGALAGDIKLSIHPHPTLSETIMEAAEVFYGQSTHIYRPKRK

SEQ ID NO: 83828 - protein, 615 aa, Acidobacteria bacterium Ellin345
MAQEFKLPELGENIASGDLVRVMVKPGDTVKEGQPVIELETDKAVIEVPSTVSGKVQEVKVQKGQKLKVGAIIFTYGDGAAAAPVQPAAPAKTEDKPKAEPKAEAPKQAAPSAAKPAASTGTKQTIEFKLPELGENIKQGQLVRIIAKQGASVSDGQPILELETDKAVIEVPATLTGTIKEVHVKEGDKIGVGQTIFTVETTEGNTQPPHPHTNTEGNTQPPTGGGASSNTEGNTQPPHPHSNTEGNPQPPTGGGGSSSATAARDFELSGQQLARLQFELALRSEGKTEREAHPPDVRDLGVRVSLTPLTPGRPTVAASPTVRRLAREIGVDIVQVKGTGPGGRISEGDVKLFAKQLIVRLQHEAATAKAAPKVVLPDFSKWGSIEKEQMRSIRRKTAERLTQAWTTIPHVTQHDRADITELEKLREKFAKQAEAAGGKLTVTAIALKVIAAAMKKFPKFNASIDIDREEIIYKKYVHIGVAVDTEAGLLVPVLRNVDQKNVYQIAAEMNELSKRARERKLKPEEMEGGTFTITNLGGIGGTSFTPIVNLPEVAILGLSRGRTEPVWVNDHFEPRTMLPLSLSYDHRIIDGADAARYLRWVADALEQPVLLLLQG

SEQ ID NO: 83829 - protein, 137 aa, Helicobacter hepaticus ATCC 51449
MEQTLSIIKPDAVKKGVIGKIIDRFESNNLRICAMKKLQLTRCDAEAFYAIHKERPFFKDLVDFMISGPVVVMVLEGNNAVMKNRDLMGATNPKEAEAGTIRADFAQSIDANAVHGSDSLENAKNEIAFFFSTREIC

SEQ ID NO: 83830 - protein, 351 aa, Xanthomonas oryzae pv. oryzae KACC10331
MATMAAHLLYRLPVPMSRPSLTRFLIEEQHAGRIDAELRQLITIVSRACKRISIAVSKGALGGVLGDAGTGNVQGEAQKKLDVLSNDILLEANAWGGHLAACASEEMDHSQPVPEQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPDETAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAAATRYHLDADKA

SEQ ID NO: 83831 - protein, 416 aa, Xanthomonas oryzae pv. oryzae KACC10331
MAQQRPSLFRPSASHAVSFFANVEQVPGDPILGLTEAYNADSRPNKVNLGVGIYYDENGRIPLLRAVHKIEQQLAQDTKPRGYLPIDGLAAYDKATQELLFGAESALLAAGRVATSQTVGGSGALRVGADLLKKLLPTSTIAISNPSWENHRAVFGAAGFEVVDYTYFDAASHGLNFDGMLADLAKLEPGTVVLLHACCHNPTGADLSKEQWKQVAGLLKERNLFPFVDIAYQGFDKGIEADAHAVRLLAAEGIDSYVVASSYSKSFSLYGERVGALSVVSATAAEAKAVQSQVKRIIRTIYSSPSTHGAALVAGVLTSPELRDVWEQELTEMRERIHALRAGLVEKLATLGAPEFEFIQRQAGMFSYSGLTKTQMDRLRDEFAIYAVGTGRICVAALSQRNLDYVAQAVATVSRM

SEQ ID NO: 83832 - protein, 337 aa, Wolbachia endosymbiont of Drosophila simulans
EASGQITEFLVKEDDVISPDQLLAKLSVGEVKEEAKKEDKSESAAKKDAPSARKIMEENAISAESVKGTGMGGRITKADVIGHMNKAEQPAIKQYELPKSVVNGEQREERVKMSKIRQVIAARLKASQNTAAILTTFNEIDMKNVMDLRTKYKDAFEKKYGIKLGFMSFFIKAAVQALKEIPEINAEISGDEIIYKHYYDIGVAVGTDKGLVVPVIRSADQMSFAEIELTLVALGKKAREGKLQVSEMEGATFTISNGGVYGSLLSTPIINPPQSGILGMHSIQNRPVAVGNAVEIRPMMYIALSYDHRIVDGKGAVTFLVKIKNYIEDPNRLVLEV

SEQ ID NO: 83833 - protein, 449 aa, Marinobacter sp. ELB17
MSDNKAEIWLAQHPEIDSIFACVCDLNGTMRGKRVPVDQLSKVIDGGLRMPLSIVGMDVWGEDVENSELVFETGDSDGLCDFTGRPLMPITWTSRPTALAMLWMRQEEGAPFPGDPRRALARIAEQYKQRGLTPVVATELEFYLVDPSEDYPQAPRSPVTGKRLESDGAMSLDELQHFDEFLNDVYDACELQGIPADAAISENGAGQFEINMHHVADPLRAADDAVLFKRLVRGIARKHGLAATFMAKPYGDLSGSGFHTHFSLIDENGINVFDNGGDEGTPLLLNAVAGLLATMQQNTLTFAPHENSYRRLLPGAHAPTSVSWGYENRTAAIRIPGGDPIARRIEHRVAGADANPYLVLASILGGALLGIENEMQPAAPITGNAYSMNLDNLPLDWATAIDAFRKGADVPTIFSKRLQTMLVECKMQELRKFARYVTKFEYDSYLEIV

SEQ ID NO: 83834 - protein, 210 aa, Caulobacter crescentus CB15
MMYDPVSTAMNLVPMVVEQTSRGERAFDIFSRLLKERIIFLTGPVEDGMASLICAQLLFLESENPKKEIAMYINSPGGVVTAGLAIYDTMQYIKSPVSTVCMGMAASMGSLLLAAGAAGQRISLPNARIMVHQPSGGFRGQASDIERHAEDIIKTKRRLNEIYVKHCGRTYEEVERTLDRDHFMSADEAKAWGLVDHVYDSRDAAEAGAE

SEQ ID NO: 83835 - protein, 331 aa, Beta vulgaris
MAELNNGGHSKELVVSFGEMLIDFVPTSSGVSLAEAPGFLKAPGGAPANVAIAVSRLGGNAAFVGKLGDDEFGHMLAGILKKNGVSADGLSFDKGARTALAFVTLKSDGEREFMFYRNPSADMLLTPDELNLDLIRSAKVFHYGSIRLIVEPCRSAHLKAMEEAKKAGALLSYDPNLRLPLWPSAEEAREQIMSIWDKAEVIKVSDNELEFLTGNSTIDDATAMSLWHPNLKLLLVTLGDQGCRYYTKNFKGSLDGFKVNAVDTTGAGDSFVGALLNKIVDDHSIIEDESRLKEVLKFANACGAITTTKKGAIPALPTVADALELIKKNAS

SEQ ID NO: 83836 - protein, 300 aa, Desulfovibrio vulgaris subsp. vulgaris str. Hildenborough
MPKHFTRIRDLGFEGAWKVLERAKEMKDTGYRGRTLEGKVATLIFEKASTRTRISFEVAVRHLGGTTIFMTPAESQLGRSEPLRDTARVISRYTDCMIVRTFGQAKIDELASFGSIPVVNALTDEGHPCQVMSDVLTMYERTPDLSQVRVAWIGDGNNMANSWIEAAMYFPFELFMAFPEGYEPDRQLLGLALEAGAKIFLTRDPHMAIDGAHYVNTDVWASMGQEEEQKRREAAFKGFCIDGALMGRAHPDAKFMHCLPAHRGEEVTDEVMESPASIVWDQAENRLHMQKAILEWVFTE

SEQ ID NO: 83837 - protein, 461 aa, Acidobacteria bacterium Ellin345
MSTAITTAGPKIRTKLPGPNAQRVLEGDARIISPSYTRSYPLVAKRGHGVVIEDVDGNEFFDFSSGIAVTSTGHCHPEVVAAIQKQAGELIHMSGTDFYYESMITLGDRLSKIAPMKGPHRVYYGNSGAEAIECALKLARYHTKRQHIIAFYGAFHGRTMGALSLTASKPQQHRRFSPLVPGVTHIPYPNLYRRPEGTDANEYAVSVARFLEEKVFTTDIAPEEVAAIFVEAIQGEGGYLPAPPAFMQELRKICDKHGILLVCDEVQSGCGRTGKWWAVEHTGVEPDMITIAKGIASGMPLSVCLTKAEIMDWVPGSHASTFGGNPVAIAAALATLDVLEREGVKNAETVGKHIMNRISKWPEKMPLVGDVRGHGLMLGVEFVSDKKTKRPAGELRDAVVDLAFEKGILYLGAGPNTLRIAPALIVTKEEADIALDILEECILNVAALHEKGKKAGEEVGS

SEQ ID NO: 83838 - protein, 219 aa, Pyrus communis
MAPPPSLAGLQVEATAFPPSVKPPGSSNTLFLGGAGVRGLEIQGNFVKFTAIGVYLEDNAVPLLAVKWKGKTAEELSESVEFFRDIVTGPFEKFIQVTTILPLTGQQYSEKVSENCVAFWKSVGIYTDAEGKAIEKFIEVFKDQNFPPGASILFTQSPKGSLTICFSKDASVPEAANAVIENKLLSEAVLESILGKHGVSPAAKRSLAARLSELLNGCK

SEQ ID NO: 83839 - protein, 651 aa, Oryza sativa Japonica Group
MAALLLWLSWLLLSLLSIYLLDLLAHSRRCLPPGPRPLPLIGSLHLLGDLPHRSLAGLAKTYGPLMSLRLGAVTTVVASSPEVAREFLQKHDAVFATRSTPDATGDHARNSVAWLPPGPRWRELRKIMATELFSTRRLDALHELRQEKVAELVDHVAGLARDGTAVDIGRVAFTTSLNLVARTIFSHDLTSLDDHGASKEFQRLITDVMEAVGSPNLSDFFPALAAVDLQGWRRRLSGLFARLHRLFDAEMDHRRLHGMKEKDGDFLEVLLRLAARDDDTARLDGDTLRSLFTDLFTAGSDTSSSTVEWAMAELLQNPISMAKLCDELRRVVGSRRRIEESEIGQLPYLQAVIKETFRLHSPAPLLLPRQATRTIQIMGYTIPKGTRVLINVWAMGRDEDIWPEAGKFIPERFLERTIDYKGGDLELIPFGAGRRICPGMPLAVRMVHVLLASLLIHFKWRLPAEVEGNRIDMTEKFGVTLAKANHLCAMAAPTTSNSGGVSGKGEEEDEAYWDEWLAKPIHERVAWQMPSATELQDAGVTFHAKGLPCSLVDVTFSQRDGVMEIPTVENYANHAMLANLVAYEQSRGRLEMQRVYSRRCSTVRWRAAASGVRDERAVGWQRHHLHDWRLAVHGSRSRGEDGGEEKGIGSV

SEQ ID NO: 83840 - protein, 349 aa, Opitutaceae bacterium TAV2
MTSARPARPAHPTAPPRTPQKILVTGGAGFIGSHLCEALLADGHHLVVLDDFNDYYPPALKHAHLAPIRDQLDALVQADIRDPAAIERTFATHHPIHAVYHLAARAGVRPSIHSPRLYLSTNIDGTLNLLEACRAHHVPDFILASSSSVYGANPKTPFAETDPIQRTLSPYAASKLAAEQLCSNYAHLHGLRCLCLRLFTVYGPRQRPDLAIARFTAAIRDGRPIDLYGDGTTARDYTYVDDIIQGLLAAGRRTATLPPATFEIFNLGESATTTLNELVTLIENALGRPALIRRQPEQPGDVPRTYADISKARRLLGYAPATLPADGIRKYIRWLETNQPAPASLQIGR

SEQ ID NO: 83841 - protein, 143 aa, Coccidioides immitis RS
MANEQSAAILTNVCDAIPHICKYTAWPIADEALSTELLDLVQQASHYRQLKKGANEATKTLNRGTSELIILAADTSPLAILLHLPLLCEDKNTPYVYVPSKVALGRACGVSRAVIAASITSNEASDLSAQIRNIKQKVERLMI

SEQ ID NO: 83842 - protein, 356 aa, Salinibacter ruber DSM 13855
MRYAVIMAGGIGTRFWPVSRKEHPKQFLDIFGDGTLIQNTIARLQGLVPPERCLVVTHERYVEKTKKQLPAVPEENILAEPISRNTAPCIAYAATTLAKRDPDATMAVLPADHVIGNVARFHDTLDVAFDAAQERDALVTIGIDPTYPATGYGYIQYDGSGADPPALEAYPVRTFAEKPDQSTAERFIDAGDFLWNSGMFIWRADTILDQIETHLPDAHEAFAPVRAADGAADSETLTEAFRESPRISIDYGVMEQADTVYVVPGTFDWNDVGDWRAVYDLSEKDEHGNVIEGEVIMQDSSRCYVQTEDRLVVLVGIHDKVVVDTGDAVLVCDRESAQQVKQVVEYLHAHQFEEYV

SEQ ID NO: 83843 - protein, 484 aa, Dechloromonas aromatica RCB
MNLQNTELLRSTNLIGGIWARADDGAQLAVINPATGEKLADVPLCGATETRRAIDAANAAWPAWRALTARRRSQLLQAWFSLIIKNADDLAQLVTAECGKPLQEAKGEVIYGASFVEWFAEEGKRTYGESIPSPAANTRLLVIKQPIGVCAAITPWNFPLAMITRKVAPALAAGCPVVVKPAEATPLTALALAVLAEQAGFPAGVFNVVTGKPAEIGGELCANPIVRKLSFTGSTGVGRLLMAQCAPTIKKLSLELGGNAPFIVFDDADVNAAVDGAIAAKYRNTGQTCVCANRFLIQAGIYDEFAAKFAEKASALKVGAGIEADVAQGPLINAAGLSKVEAHVADAVGKGARVLCGGARHERGGNFFQPTVLADVTTAMMVAREETFGPVAPLFRFETEEQAIAMANDTEFGLAAYFFTRNVGRCWRVGEALEYGMVGINTGMISNEVSPFGGIKQSGLGREGSKYGIEDYLEIKYLCFDVNT

SEQ ID NO: 83844 - protein, 225 aa, Shewanella oneidensis MR-1
MRPFLIAPSILSADFARLGDDVKAVLDAGADVVHFDVMDNHYVPNLTIGPMVCKALRDYGITADIDVHLMVKPVDRIVPDFAKAGASIITFHPEASEHIDRTLQLIKESGCKAGLVFNPATPLHYLDHVMDKLDVILLMSVNPGFGGQSFIPSTLDKLRQVRERIDASGFDIRLEVDGGVKVDNIAEIAAAGADMFVAGSAIFGKPDYKAVVDEMRVELAKVEAK

SEQ ID NO: 83845 - protein, 272 aa, Salinibacter ruber DSM 13855
MLSNDTVAVIGAGNIGHSLIGGMIGGNLIETEDVIATRRTGSALDALAEEFPGLRTTTDNVEAVQDASIILLTIKPQSRAEVITNIRDHVDRDVLVISVLAGITSERLQLGFGQDQPVIRAMPNTPALVDAGATALSPGTYATDAHLEKARAIFEAVGNAVVVPEDHMDAVTGLSGSGPAYVYMFIEALTDAGVKQGMSREDASTLARQTVYGAAKLAIDTDKHPAILRDEVTTPGGTAIAAVSSLEEHGLRTMLINAVGTATQRSEELNDE

SEQ ID NO: 83846 - protein, 302 aa, Coprinopsis cinerea okayama7#130
MHGFLPFLSLSFLSLLVPALASPILEARQGVSILSPAEVADYRPYTHYAFTASCSPAKTLTWSCGGNCDANPQFLPIASGGDGAIVQRWYVGYDPALDSIIVGYQGTDTSKLFPLLTDANILLTPLNPFLFPGVPLTALTHDGFNNAHALSANAVLSAVRTGLAQHNTTNVAVVGHSLGGALAVISTLHLSIHLPAGTAFRTVTYGMPRVGNAIFADLVNSVSVMNRINNKYDIIPVLPPRVTGLGYVHTEGEIHIVNSGDWVSCPGEDNTNSQCSIGYVPIPLLGDVNDHSGPFDGVQGAC

SEQ ID NO: 83847 - protein, 354 aa, Vitis vinifera
MDLINSLLNLVVPPASLVMLAFAWPALSFINACEWVYNTLYSENMEDKVVIITGASSGIGEQVAYEYAKKGAKLVLVARRENRLLGIGENARQLGAKHVMIMAADVVKLDDCRRFVTETVNYYGRVDHLVNTASLGHTFYFEEAIDTSVFPPLMDINFWGNVYPTYVALPFLRQSNGRVIVNASVENWLPLPRMSLYAAAKAALINFYETLRFEAKEVGITIATHGWIGSDMTRGKFMLEDGAEMQWKEEREVQVTGGPVEEFARLMVAGACRGDAYVKYPSWYDIFLLYRVFAPNVLGWTFRLLLSTNGARRSTSLIGTGRPLLESIPPPKLLTGGPFTFPQHNPQQHQQKME

SEQ ID NO: 83848 - protein, 748 aa, Vibrio sp. Ex25
MLSQLREIVEKVSRVDDVHLALDILVKETCAALSTECCTIYLANEEMQRLELMATQGLIFEGDSIHINFNEGLVGLVKRSAEPLNLAEASKHPEFKFFPQLGEQIYHSFLATPIIHRKQVLGVLVIQQKTPRLFSEMEESFLVTLSAQLAVLIAHAQNLGHWQLASKPTVLKGLPASTGVAIGEFWFDNTQPSLSDVFPSSTLDKEREHETLLVAIERALNDFRRMRKKLDSEINKDALAIFDLFTHLLNDPMLRGDLKKQIEKGDRADWALRQVVESYSNRFARMSDVYMRERAQDIRELGQRLLYFLHNSEQENSAIDRPIILVASELTATLLASVPKEFLLAVVSLEGGANSHAAILSRALGVPAVMGANINQDVVNGKLGIVDGYTGEIFLEPNRQLLREYRSLVSEESELFAMVNKDLALPAVTQDNHHIEIMLNAGLSADSNIAINTGVDGVGLYRTEIAFLLQHHFPSEDEQYHQYQAILNSYPNQRVVMRTLDIGGDKPLPYLPIEEDNPFLGWRGIRFTLDHPDIFLIQLRAMLRASAESGNLSILLPMVSGVKELDDAISLINQAHSEAVLLDDRIQFPQVGVMIEVPSMVYLLPTIAHRVDFVSVGTNDLTQYLLAVDRNNSRVADVYESMHPAVLLALKQIHDVCDKYQVPVCICGELAGDPFGALLLLGLGYTSLSMNTSNVAKVKYLIRHSQQEELEKLAEQAMTKSYGEDIHQMMHDFFIQQGFAGFIRAGKK

SEQ ID NO: 83849 - protein, 589 aa, Parvularcula bermudensis HTCC2503
MVSRARRRQYLPILSWIGGYRGDTFAKDALAAVIVTIMLIPQSLAYALLAGLPPQVGLYASILPLVAYAVFGTSRSLAVGPVAVVSLLTATAVGQVAEQGTAGYLAAAILLALLSGAFLTAMGLFRLGFVANFLSHPVISGFITASGLIIAASQVKHILGVEAHGETLFRLVSALFHQLADTNIPTLMIGVMAIAFLFWVRRGLAPCLKKVGMKATTASMLAKAGPVLAIVVTIALTAIFRLDQQGVAIVGDIEGSLPPVAVPSVDLNLLRSLVGPAILISIIGFVESISVAQTLAAKRRQRIDPDQELIALGAANIASGLSSGYPVTGGFARSAVNFDAGAETPAAGAYTALGISLAALYLTPLLTFLPKATLAATIIVAVLSLVDIRAVGETMRYSKADGASMLATIIFTLGFGIETGVVAGVLLSLSLYLLKTSRPHMAIVGLVPGTEHFRNVDRHDVVTDDKVITLRVDESLYFANARGLEDIVYDLVADNPTLEHFVLMCPAVNSIDASALESLEAMNARLKDSGVTFHLSEVKGPVMDRLKRSHLLADLTGEVFLSQFAALSTLTPALVDGARDGAHPQAAAR

SEQ ID NO: 83850 - protein, 196 aa, Chrysanthemum x morifolium
MEIQGNFVKFTGIGVYLEDTAIPLLAGKWKGKTAEELVNSVEFFRDIVTGPFKKFTQVTMILPLTGKQYSEKVSEMCVGVWKAHGTYTDADGATIDKFLEVFKDENFPPGASILFTTSPDGSLTISFSKDGMIPEAANIVLENEKLAQAVIESVIGKNGVSPATKQSLASRLSDLMNHFDEKATTDAEPNLSKNGL

SEQ ID NO: 83851 - protein, 278 aa, Arabidopsis thaliana
MKTIILFVTFLALSSSSLADETETEFHYKPGEIADPSKWSSIKAEWKICGTGKRQSPINLTPKIARIVHNSTEILQTYYKPVEAILKNRGFDMKVKWEDDAGKIVINDTDYKLVQSHWHAPSEHFLDGQRLAMELHMVHKSVEGHLAVIGVLFREGEPNAFISRIMDKIHKIADVQDGEVSIGKIDPREFGWDLTKFYEYRGSLTTPPCTEDVMWTIINKVGTVSREQIDVLTDARRGGYEKNARPAQPLNGRLVYLNEQSSPSPTPRLRIPRVGPVG

SEQ ID NO: 83852 - protein, 255 aa, Azoarcus sp. EbN1
MFSRLREDLASVRERDPAARSTWEVLTCYPGVHALMFHRLAHAAWTRELFWIGRFVSHISRFLTGIEIHPGATIGRRVFIDHGMGVVIGETAEVGDDCTIYQAVTLGGTSLYRGTKRHPTLGNGVVVGAGAKVLGGFTVGDGARIGSNAVVVKPVPAGRTAVGNPARVIDPERTDARDKAREQKAEQMGFSAYGVTKQMDDPIAKAMHGLLDHAVETDRRIQLLVEQLEKAGVRLDSTIEQSDEFDAQRLSKMVD

SEQ ID NO: 83853 - protein, 386 aa, Acidobacteria bacterium Ellin345
MPKLSERALGIKQSEIRVMSVECERVKGINLAQGICDTEVPPPVRQGAHEAIENGNNQYTRMDGIAGLRQAIAKKMKRYNRIERDPETEVVVTGGSTGGYLSTCLALLEAGDEVILFQPYYGYHVHTLETLGVTPRFVNLQPPSWEFKKEELERAISARTKAIVVNTPGNPSGKMFTREELGWIAEIASQHDLFVITDEIYEYFRYDGREHISPATVDRLRERTVTISGFSKTFSVTGWRLGYVVADAKWTNAIKYFSDLAYICGPSPLQWGVMMGIDELGDEFYDELNAEYAQKRRLLCDTLHEVGLTPFEPQGSYYVLADASSLPGKDSKERAMHLLHTAGVATVPGESFMKSGGETLLRFCFAKRMEELEEACRRLEGVRANV

SEQ ID NO: 83854 - protein, 423 aa, Arabidopsis thaliana
MDHREKSDRRLLLWFFAVATAVKLLLIPSSRSTDFEVHRNWLAITNSLPLTKWYFDETSQWTLDYPPFFAYFERFLSIFARLVDPRIVDLQSGLDYNAESVIYFQRISVIVSDLCLLYGVYRLTRKLEPLKRNLICALVIWSPGLLIVDHIHFQYNGFLLGWLLLSISFLQEGRDLLGGFLFAVLLCFKHLFAVTAPVYFVYLLRHYCWSGLVTGFRRLVTIGAVVVAVFAAAYGPFIYHGQIQQVISRMFPFGRGLCHAYWVPNFWVFYITLDKGLAVLRIRLGYEIQIPSASFTGGLVGDSSPFAVLPQITPLTTFAMVLLAISPCLIKAWKKPHSGLVARWVAYAYTCGFLFGWHVHEKASLHFTIPLAIVAVQSLEDAKHYFLVSIGDKLPFLPLMLISTYCTVGIMYSWIWQLRKILT

SEQ ID NO: 83855 - protein, 636 aa, Zea mays
MAAAAAAEIVREIASVGAADLAAAAEPLRADCLRLARKVSLLSHLVAEVADAGAGAGDAAAEAWLRDLVRALEAARRFVALGRTPAAAGASDQDAICKNTGLQFKYVTWQLQAALANLPHSCFEISDEVQEEVDLVRAQLRREMEKNGGLDVTVFMKVHDILAQIDNAAPQSQQPHQQPEQPQMEKFSNDDLELQNVVLLVSEISGLSKPDMTKIVSDLIQGLENVETPESPKPDNVDRQPPSDETKGSSEEVKKPDSVAIPEDFRCPISLELMRDPVIVSTGQTYERAFIQRWIDCGNRTCPKTQQKLQNLSLTPNYVLRSLILQWCEEKGMEPPSRSKSDGSPLEVAGNRLAIEALVRNLSSSSLDDRKSAAAEIRSLAKKSTDNRILLAESSAIPALVKLLSSKDPKTQEHAVTALLNLSIYDQNKELVVVAGAIVPITQVLRTGSMEARENAAAAIFSLSLMDDNKIMIGSTPGAIEALVELLQSGSSRGKKDAATALFNLCIYQANKVRAVRAGILVPLIRMLQDSSRSGAVDEALTILSVLASHHECKTAISKAHAIPFLIDLLRSGQARNRENAAAIILALCKRDAENLACVGRLGAQIPLAELAKTGTDRAKRKATSLLEHLSKLQVL

SEQ ID NO: 83856 - protein, 157 aa, Pseudomonas putida GB-1
MRIGHGYDVHRFCDGDFITLGGVRIPHKYGLLAHSDGDVLLHALSDALLGAAALGDIGKHFPDTDPQFKGADSRALLRHVVGIVRAKGWKVGNVDATIVAQAPKMAPHIETMRQLIAEDLQVELDQVNVKATTTEKLGFTGREEGIAVHSVALLLPA

SEQ ID NO: 83857 - protein, 215 aa, Coxiella burnetii RSA 493
MKNNVIIIGISGPSASGKSLLANTIVNELGSDQVVVISEDSYYKDLGDMPFEERAKINYDHPDSLDHELLYQHLLQLQQGNAIAVPCYDHSRHRRLEKTKTVGRHRIIVLEGILLFVEAQLREIMDIRIFMDTPLDICLLRRLQRDIVERERSLEGVLTQYQETVRPMYLQFTEPSKRYADIIVPRGGENRIAIEMIQAKMRELLGVNGALKRHA

SEQ ID NO: 83858 - protein, 477 aa, Acidobacteria bacterium Ellin345
MPPIKRNPKAPRQIPPEVAPNVRVQGGAVEVAGGFTTEQAQVESLRCLNCKDAKCVEACPLHIDIKSFIQHIVLGDVASAFDKISERSPFPGICGRVCQHELFCESACLLGKKLDPVAIGSLERFCSDHHRQFNGKAPVVKANPTGPKIAMVGSGPASLMASFVLAQRGYRVTVFEALHRLGGVLIYGVPPFRLPREILDSEIARLEAMGVKFETDVIVGNSVTLEELFHEEGFEAVFLGTGAGLPFMLNIPGENLIGVYTANEFLTRINLMNANETGADTPVNIGKHTVVIGGGNSAMDAARWSKRLGADTTILFRRGRAELRARAEEIEHAEQEGIKFEFLGAPVALFGDENGWLNEMECIRMKLGEPDSSGRPSPVPIEGSNYRIPVDTVIAAVGQAPNPTLQRTTPQLITNRGKIVVDVNRQTNMDKVFAGGDVVRGGSTVILAMSDGLAAADAIDKALKLQQKEVEIVGAEA

SEQ ID NO: 83859 - protein, 377 aa, Arabidopsis thaliana
MGAVTSSMAAKFAFFPPNPPSYGVEVVEGKLRLIGVENVKENVEVLKLKTKRGNQVVAAYIKNPTASLTLLYSHGNAADLGQMFELFSELSLHLRVNLIGYDYSGYGRSSGKPSEQNTYSDIEAVYRCLEEKYGVKEQDVILYGQSVGSGPTLELASRLPNLRAVVLHSAIASGLRVMYPVKRTYWFDIYKNVEKISFVKCPVLVIHGTSDDVVNWSHGKQLFELCKEKYEPLWIKGGNHCDLELYPQYIKHLRKFVSAIEKSPILRNGPVPLTEKARSSTDIREPARPSTDQRDKSRTSTDQREMPKLSTDIARASVDKRERTRRSVDGTEKPSNSAEQQLVQPEKGRNSIDRFGEMIRSVGFCNIDCFKPTATAK

SEQ ID NO: 83860 - protein, 605 aa, Schizosaccharomyces pombe
MTKDAESTMTVGTYLAQRLVEIGIKNHFVVPGDYNLRLLDFLEYYPGLSEIGCCNELNCAFAAEGYARSNGIACAVVTYSVGALTAFDGIGGAYAENLPVILVSGSPNTNDLSSGHLLHHTLGTHDFEYQMEIAKKLTCAAVAIKRAEDAPVMIDHAIRQAILQHKPVYIEIPTNMANQPCAVPGPISAVISPEISDKESLEKATDIAAELISKKEKPILLAGPKLRAAGAESAFVKLAEALNCAAFIMPAAKGFYSEEHKNYAGVYWGEVSSSETTKAVYESSDLVIGAGVLFNDYSTVGWRAAPNPNILLNSDYTSVSIPGYVFSRVYMAEFLELLAKKVSKKPTTLEAYNKGRPQTVVSKAAEPKAALNRVEVMRQIQGLVDSNTTLYAETGDSWFNGLQMKLPAGAKFEVEMQWGHIGWSVPSAMGYAVAAPERRTIVMVGDGSFQLTGQEISQMIRHKLPVLIFLLNNRGYTIEIQIHDGPYNRIQNWDFAAFCESLNGETGKTKGLHAKTGEELTSAIKVALQNKEGSTLIECPIDEAACIQEWIAGYRTFTPRKIQLTFLDTQACMAAGLLSASEGTPYSESYFLSASEGICPYSESY

SEQ ID NO: 83861 - protein, 583 aa, Oceanicola granulosus HTCC2516
MSDAPAYQVLARKYRPETFADLVGQDAMVRTLKNAFAADRIAQAFIMTGIRGTGKTTTARIIAKGMNCVGADGQGGPTTEPCGRCEHCTAIMEGRHVDVMEMDAASRTGVGDIREIIDSVHYRAASARYKIYIIDEVHMLSTSAFNALLKTLEEPPEHVKFIFATTEIRKVPVTVLSRCQRFDLRRIEPEVMIALLRRIADAEGAAIADDALALITRAAEGSARDATSLLDQAISHGAGETTAEQVRAMLGLADRSRVLDLFDLILKGDAAGALTELAGQYADGADPMAVLRDLAEICHWVSVIKITPEAAEDPTVSPEERDRGRQMAEALPMRVLSRMWQMLLKTLEEVASAPNAMMAAEMAVIRLTHVADLPTPEELVRRLGDQPPPPAPGPGGGGGARPGAAASHAPAAGVPAPTHSAPAGPTAHGALAVKSETALAHYPSFAHVVELIRHHRDVKLLVEVETNLRLVSYSPGRIEMEPTETAPPDLAAKLGSRLQAWTGVRWAVSVSSGGGGPTIAEERDAAELALKAEAAAHPLVQAVLQAFPKARITEVRTPEALAEEAGADALPEVSEEWDPFEDD

SEQ ID NO: 83862 - protein, 76 aa, Neisseria gonorrhoeae
DQFAGGTKALAEAIAQSKAFSIAGGGDTLAAIAKFGVTDQIGYISTGGGAFLEFLEGKELPAVAALEKTRRVNGLI

SEQ ID NO: 83863 - protein, 271 aa, Picea sitchensis
MARSVIPAFIAFALILFIAGVRTQEIDDEREFEYKEGPKGPEHWGELKEEWKACGRGTQQSPIDVVKRNAIISPNLGTLHRIYHPANATLVNRGHDIMVNWSEGAGSVEIKGKRFTLKQCHWHTPAEHTIDGKQHPLEIHLVHQAVDGEIAVIGIIFEFGRPDTFLAELRDAIMAIAHMEPPVKPLGMVDPYDIKFDSRKYYRYMGSLTTPPCTEGVIWNVIDEVRTVSEDQVRALQEAVHDGYEKNARPIQPLNGRIVGLYDHEYLYTEA

SEQ ID NO: 83864 - protein, 361 aa, Arabidopsis lyrata subsp. petraea
CKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGES

SEQ ID NO: 83865 - protein, 115 aa, Oryza sativa Japonica Group
MADLTGGGGGGGGSAGSRRPLGFLKNAAKHKHGFVQLLLMGSVLMMSLRTLGQKHRRRDLIYDNADLRREHDDLSLRMRDVQDALRREADADESGALASHLRRIFAAHPASTDDK

SEQ ID NO: 83866 - protein, 573 aa, Oryza sativa Indica Group
MATFCKVRKRDDGIYVLTLASSDGHHYLTTEAITQLKQALERIRSTKARGLVTTTTSGSFCDGINAVSDDDDDEPLSSLERGMAEVVRLLLDLPMPTAAAVRGDARWLGFVLALAHDHLFVHTEAVLGLAAAADTTAKPRRRPLPDYVVALLREKIPYAQLRKLLLLKAHVFTGEELKGNWHSVHEAIPNRDHVVAVAVQNLQSVVVGDGMDYAKVRRTMYTNSCVAVAVTTTTTTMLPFDGSSSVANGVTISSEMTPSGESFNSSYNSSTTPVDISLAAIEACTDGFSESKKVGSGAYGKVYKGVYNEEELAFKKIDGLAVLNEDQFKNELKHLMSVQHRNIVRFVGYCSQIKEKFIWRGKEYVSVQYITRILCFEYLPGGSLDKHLDKESESDGFDWRTRYNIIKGISQGLNYLHELEKPIFHLDLKPANVLLDENMEPKIADFGISKHFTGTKTHITISKPTGTPRYMPPEYLNKLVISNKYDVFSFGVMVMEIIAGPTGYDNFSEANDQDSFKYIDRVYKQWEKRITAKSHDPSAEINQVKRCINIAVKCLNQNRDDRPEIKAIVGELN

SEQ ID NO: 83867 - protein, 529 aa, Arabidopsis thaliana
MSIGLTEFVTNKLAAEHPQVIPISVFIAILCLCLVIGHLLEENRWVNESITAILVGAASGTVILLISKGKSSHILVFDEELFFIYLLPPIIFNAGFQVKKKKFFHNFLTIMSFGVIGVFISTVIISFGTWWLFPKLGFKGLSARDYLAIGTIFSSTDTVCTLQILHQDETPLLYSLVFGEGVVNDATSVVLFNAVQKIQFESLTGWTALQVFGNFLYLFSTSTLLGIGVGLITSFVLKTLYFGRHSTTRELAIMVLMAYLSYMLAELFSLSGILTVFFCGVLMSHYASYNVTESSRITSRHVFAMLSFIAETFIFLYVGTDALDFTKWKTSSLSFGGTLGVSGVITALVLLGRAAFVFPLSVLTNFMNRHTERNESITFKHQVIIWWAGLMRGAVSIALAFKQFTYSGVTLDPVNAAMVTNTTIVVLFTTLVFGFLTKPLVNYLLPQDASHNTGNRGKRTEPGSPKEDATLPLLSFDESASTNFNRAKDSISLLMEQPVYTIHRYWRKFDDTYMRPIFGGPRRENQPEC

SEQ ID NO: 83868 - protein, 355 aa, Gerbera hybrid cultivar
MVIQATTRVESLSTSGIRQIPKEYIRPQEELRSITNIFDEETNKQKPQVPTVDLTDIESDDPEKRHKCLEELKKAAMEWGVMHVVNHGISGDLIGRVKAAGEGFFGLPVEEKEKYGNDPDGGRIQGYGSKLANNASGQLEWEDYFFHLVFPEEKRDLTIWPTTPSDYTDATTEYAKQLRALATKILSALSLGLGLEEGRLEKEVGGIEELILQLKINYYPKCPQPELALGVEAHTDVSALTFILHNMVPGLQLFYDGQWVSAQCVPDSIILHIGDTLEILSNGKYKSILHRGLVNKEKVRISWAVFCEPPKEKIILKPLPETVSEAEPPLFPPRTFQQHMEHKLFRKNKDEVMQN

SEQ ID NO: 83869 - protein, 495 aa, Oryza sativa Japonica Group
MEGIHAGTVTMACSWLVLTAAMAVLASWLIRLVSLKWNSSHPCKADEGSRLPPGSRGLPLLGESLEFFTSSTSLELPVFFKRRLNRYGPVFRTNMVGQDLIVCLDPEVNSFVFQQEERLFQCWYPDSFMRIIGADNIITTLGSSHKYIRNLILRLFGPENLRRAMLQDVHRTAQASLLSWLDRPSIELKDAVSSMIFSVTAKKLISYDSLASDGKMWKQFDAFIRGLLAFPIGIPGTAFYKCMQGRKNIMKMLKELIDERKEASGRRGSIDFIDVLLEELNEEKPLISENVALDLIFLLLFASFETTASAITAVVRFLTDNPEALQELAEEHDNIQKRRVDLNSEITWEEYKSMKFTSHVIHEALRLANIAPVMFRKATEDVHIKGFFIPKGSKIMICPSTVHLNPMIYKDPNIFNPWRWKDTAEPTGGASKDFMAFGGGLRLCVGADFAKLQTAIFLHCLVTKYRWKAIKGGTMVLGPGLRFPEGFHIQLFPKP

SEQ ID NO: 83870 - protein, 235 aa, Oryza sativa Indica Group
MGFCTYKEKDDIFKLTLTGGNSGHNYLTEKSLKELKETLATIRGKATPSSRGLVTICSGKSSFCDGIDYTSSPPPAVEELIRGMAEVVRELLGMPFPTVAAVGGDVRSSLALALVLAHDDVAVLKKVKIEAREVVEGRHDAVPPYLGALLRDKSSYPQMSSDLVLRSETMAGDRLKYWYLIERVCDDQWELKGHAINMIKEVFGDERDGEAYVTTRKSLVFSECWKAVSELLKNI

SEQ ID NO: 83871 - protein, 189 aa, Acidobacteria bacterium Ellin345
MIWRFWTVPNQLTLARLIFVPFVITNVLDYNFKWALGLFIAAGLSDGLDGLLARWLKQRSTLGEYLDPIADKLLLSSLFLVLSFRQIIPWRFTVVVFSRDICILMLCALIYVTTPLRDFRPSFLGKLNTVAQVGALFLVLLNEVVDRNWIYVGKDYLLWTVFALTCLSALHYLYLVGYRLHQVTSAASK

SEQ ID NO: 83872 - protein, 271 aa, Picea sitchensis
MGDCDELSGFLSSAVEVAKRAGEMIATNFYKEKSVEHKGKVDLVTETDKACEELAFQFLKQKYPEHKFIGEETSAVHGTDDLTDAPTWIIDPVDGTTNFVHRFPFVCISIGLTIGKVPTVGVVYNPIIGELFTAIRGRGAFLNGSPISSSSQTELGSALLAAEIGIKRDKETVDITTKRINGLLFKVRSLRMSGSCALNLCGVACGRLDITYELGFGGPWDVAAGVVIIQEAGGCVFDPSGDEVSIMSQRIAASNGYLKEEFLDELKASCV

SEQ ID NO: 83873 - protein, 903 aa, Solanum lycopersicum
MEVDNCWNIRLVNCVIICLVIYIQSAFAQEGFLSIQCCATANFTEPRTNLSWISDGIWFPENQSCISRPVYKSEHYERARSFSSDISHKWCYSLPTRKEHDYLVRGTFLSVKQEKTLPHSSFVVLIGVTPIATVKSSDELKVEGIFRATRSYTNFCLLKKKGNPYISKVELRPINSDYLKKEPSEILKLVHRVDAGNKAAEIRYPYDQYDRIWRPASNLESQVTQTPPSIIKHVFARKHSLLPPAFVLRTALTHPERLDFLHEDLDTGYYTYSLFLYFLEPNDSVQAGERVFYIYINNEKRLKVDILASGSRYLDVVLNFRANRSVNLTMIKASNLSQLGPICNGYEILKALPRVKETATEEVDIMANVKKELLQQNKNNEIWKSWSGDPCLPLPWPGLTCDRVNGTSVITQIDLSSGGLSGPSPPSIQKLMHLRKLNISINGSSGTNSLFTSYFTYSTRYLSSRIHISNKLSRSIKESNITTDKGMANVKQNSSSTHKLVIGAAVGTALLVILAIVISVVCLFKRRVMAGPKFLMRNYSITRNAVYSVPSMDTTMMKSISSRNFKLEYIEAITQNYKTLIGEGGFGSVYRGTLPDGVEVAVKVRSATSTQGIREFNNELNLLSAITHENLVPLIGYCCENEQQILVYPFMSNSSLQDRLYGGAAKRKILDWPARLSIALGAARGLLYLHTFSERCLIHRDVKSSNILLDQSMCAKVADFGFSKYASQEGDSGTSLEVRGTAGYLDPEYYSTQRLSAKSDVFSFGVVLLEILTGREPLNINKPRNEWSLVEWAKPLIRSSRVEEIVDPTIKGGYHGEALWRVVEVALACTETYSTYRPCMADIVRELEDALIIENNASEYLKSLDSFGGSNRFSVERSIVLPPIKSQTEPSSLLSKPAPPQPR

SEQ ID NO: 83874 - protein, 510 aa, Caulobacter crescentus CB15
MQHILEELERRRQQAKAGGGETRVASQHAKGKLTARERIELLLDEGSFEEFDMFVEHRCADFGMQDQKIPGDGVVTGWGTINGKVVYVFSKDFTVFGGSLSNAHAQKIVKVQRQAMKVGAPVIGLFDAGGARIQEGVDSLAGYADIFVENVMASGVIPQISVIMGPCAGGDVYSPAMTDFIFMVKDTSYMFVTGPDVVKTVTNEVVTAEELGGARVHAAKSGVAEGAFENDLEAMTQVRRLIDFLPSSNREPAPERESFDEPLRDEMSLDTLVPADPTKPYDMKELILKVVDEADFFEISSEWAKNIICGFARMDGETVGIVANQPQVLAGVLDIDSSRKAARFVRFCDAFNIPIVTFVDVPGFMPGTKQEYGGLIKHGAKLLFAYTEATVPKITVITRKAYGGAYDVMSSKHLRGDLNYAWPTAEIAVMGAKGAVEIIFRQEAKDPEALAAREAEYKDRFANPFVAAQRGYIDDVIMPHGTRRRIVRGLKSLKGKELSNPWKKHDNIPL

SEQ ID NO: 83875 - protein, 246 aa, Wolbachia endosymbiont of Drosophila simulans
MNDDLDSTTKQEALNYHSRGGKPGKISIMPTKPLSTQYDLSLAYSPGVAAPCLEIAKNPEVVYDYTAKSNCVAVISNGTAVLGLGNIGPLAAKPVMEGKAVLFKRFADIDAVDIEVGTENIEDFINAVRYLGPSWGGINLEDIRSPDCFIIEKRLNELMDIPVFHDDQHGTAVVVAAGIENALDIVGKKLEDVKIIMNGAGAAGIACLEILKSMGAKNIVLCDKQGVIYKGRNEDMNEWKEKYAID

SEQ ID NO: 83876 - protein, 767 aa, Arabidopsis thaliana
PALLPELWTEILVPICAVIGIAFSLFQWYVVSRVKLTSDLGASSSGGANNGKNGYGDYLIEEEEGVNDQSVVAKCAEIQTAISEGATSFLFTEYKYVGVFMIFFAAVIFVFLGSVEGFSTDNKPCTYDTTRTCKPALATAAFSTIAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKVADVGADLVGKIERNIPEDDPRNPAVIADNVGDNVGDIAGMGSDLFGSYAEASCAALVVASISSFGINHDFTAMCYPLLISSMGILVCLITTLFATDFFEIKLVKEIEPALKNQLIISTVIMTVGIAIVSWVGLPTSFTIFNFGTQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGIHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYF

SEQ ID NO: 83877 - protein, 135 aa, Oryza sativa Indica Group
MAGRGKAIGAGAAKKATSRSSKGGLQFPVGRIARFLKAGKYAERVGAGAPVYLAAVLEYLAAEVLELAGNAARDNKKTRIVPRHIQLAVRNDEELTKLLGGATIASGGVMPNIHQHLLPKKAGSSKASHADDDDN

SEQ ID NO: 83878 - protein, 113 aa, Arabidopsis thaliana
MFNSTALVIFAILFLSISADVFPIPSPNGEIDAMLIRNSIIGEDEDLMPTEISRRVLMAQKRYIGYETLRRDMVPCQKPGASYYDCRSGQANSYSRGCDTITRCARDTNDINT

SEQ ID NO: 83879 - protein, 476 aa, Glycine max
MEPRVGNKFRLGRKIGSGSFGEIYLGTNIQTNEEVAVKLESVKTKHPQLLYESKLYKILQGGNGIPNVKWYGVEGEYNVLVMDILEGSLEDLFNFCSRKLPLKTVLMLADQMLNRVEFVHSKSFLHRDIKPDNFLMGLGRRANQVYIIDFGLAKKYRDTTTHQHIPYRENKNLTGTARYASMNTHLGIEQSRRDDLESLGYVLMYFLRGSLPWQGLKAGTKKQKYEKISEKKVSTSIESLCRGYPSEFASYFHYCRSLRFDDKPDYAYLKRLLRDLFIREGFQFDYVFDWTILKYQQSSSVTAPARAIGPAAGPSSGMPPLASNGDGQLGGEDGNGRPTNWSSSDPTRRRNSGTIANDGILSRQKGPVTYDSTGSKDAMLSSSNFFWSSGTAKRGAVSGNRDVVGSETEASRSLILDSSQGALRKIPAPGAQRSSAIMSSEHNRTSSGRNTSNIKNLETTLRGIESLHFNDERVHY

SEQ ID NO: 83880 - protein, 370 aa, Pseudomonas putida GB-1
MIKSRAAVAFEAKKPLEIVEVDVAMPKAGEVLLRVVASGVCHTDAYTLSGADPEGIFPSILGHEGGAIVEAVGEGVTSVAVGDHVIPLYTPECGKCKFCLSGKTNLCQAIRATQGKGLMPDGTTRFSYKGQQLFHYMGTSTFSEYTVLPEISVAKIQKEAPLEKVCLLGCGVTTGIGAVLNTAKVKPGDTVAIFGLGGIGLSAVIGAVKAKASRIIAIDINPAKFEIARQLGATDCVNPKDYDRPIQEVIVDLTDGGVDFSFECIGNVQLMRAALECCHKGWGESVIIGVAGAGQEIATRPFQLVTGRVWRGSAFGGVRGRSELPSYVEMSEKGEIPLDTFITHTMGLEDINKAFDLMHEGKSIRSVIHF

SEQ ID NO: 83881 - protein, 816 aa, Coprinopsis cinerea okayama7#130
MADPSGAPPQPGPNDISTAILRPKKSPNRLIVDESTTDDNSVATLNPNTMETLGLFRGDTILVRGKKRKDTVLICLSDDNVEEGRIQVNKVARNNLRVKLGDLVNVHGCPDIKYGKRIHVLPFDDSVEGLSGNIFDVYLKPYFLEAYRPVRKGDTFLVRGGMRTVEFKVIETDPAEFCIVAQDTVIHTEGDPVKREDEESNLAEVGYDDIGGCRKQMAQIRELVELPLRHPQLFKSIGIKPPRGILMFGPPGTGKTLMARAVANETGAFFFLINGPEIMSKMAGESESNLRKAFEEAEKNSPAIIFIDEIDSIAPKREKTNGEVERRVVSQLLTLMDGLKARSNVVVMAATNRPNSIDPALRRFGRFDREVDIGIPDPTGRLEILRIHTKNMKLADDVDLEQIAADTHGYVGSDIAALCSEAAMQQIREKMDLIDLDEDTIDAEVLDSLGVTMDNFRFALGTSNPSALRETVVEVPTVTWDDIGGLDKVKLELQETVQYPVDHPEKFLKYGMSPSKGVLFYGPPGTGKTLLAKAIANECNANFISIKGPELLTMWFGESEANVRDVFDKARAAAPCVMFFDELDSIAKARGGSSGDAGGAGDRVLNQILTEMDGMNTKKNVFIIGATNRPDQIDSALLRPGRLDQLIYIPLPDEPSRLSILKACLKKSPVAPDVDLAFLAKNTHGFSGADLTEICQRAAKLAIRESIDADIRAARERKAREDAGDVKMEEEEAEEEEDPVPQITRAHFEEAMQYARRSVSDAEIRRYEMFAQNLQQSRGFGNNFKFPESDGVAPGTAPAATSNAGFTEDADDDLYA

SEQ ID NO: 83882 - protein, 300 aa, Vitis vinifera
MRPSKPQTSINLKLILVCFLCLLLFLLVFKSNFTPFQENHPSPILETHVSNSTSTPAAEEQPPSRDCPSLPLTPTCTKTPPSLAQALVHYATLNITPQQTFNEISVSLRVLQKKAPCNFLVFGLGHDSLMWTALNHGGRTIFLEEDKSWIEQIKQKLPSLESYHVVYDSKVHQADELMEVGMGEDCKVVVDPRFSKCKLSLKGFPNEVYDVEWDLIMVDAPTGYHDEAPGRMSAIYTAGLMARNREDGETDVFVHDVDRVVEDKFSKAFLCEGYFREQEGRIRHFTIPSHRTRSGRSFCP

SEQ ID NO: 83883 - protein, 152 aa, Oryza sativa
  misc_feature (18)..(18): Xaa can be any naturally occurring amino acid
  misc_feature (37)..(37): Xaa can be any naturally occurring amino acid
  misc_feature (60)..(60): Xaa can be any naturally occurring amino acid
  misc_feature (98)..(98): Xaa can be any naturally occurring amino acid
MARQAIAPMHAAAAHRAXHFLPLRRCVRRAWRVEQHXAAAGGAGDSTDKVSGAFGHYNLXLLRAKGDESLDYIPLRVTEGAIRADFPAGTYYLDGPGXLCDDHSFHVHALDGHRYLRCLRFLTDERTIQYFAREVEHVRMHPGGGSSERATD

SEQ ID NO: 83884 - protein, 429 aa, Pseudomonas putida GB-1
MAKIVDIKGREVLDSRGNPTVEADVLLDNGIIGSACAPSGASTGSREALELRDGDKSRYLGKGVLKAVANINGPIRELLLGKDPSDQKALDRAMIELDGTENKAKLGANAILAVSLAAAKAAAQDQDLPLYAHIANLNGTPGQYSMPVPMMNIINGGEHADNNVDIQEFMVQPVGAKTFSDGLRMGTEIFHHLKAVLKARGLNTAVGDEGGFAPNLASNEDALGAIAEAVEKAGYKLGTDVTLALDCAASEFYEDGKYNLSGEGKSFDAEGFAEYLKGLTERFPIISIEDGLDESDWAGWKILTDKIGEKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAVYRGRAEFRG

SEQ ID NO: 83885 - protein, 391 aa, Sulfolobus solfataricus P2
MNPIILALFDVSIFILLAEILSSLVQKYGLPKLIGELLAGMIIGPYALGSLLNQLLGFPLIGINSYIEFLAEFSVILLIFASGLEHGIAPIKSSGILGFLGATFGALLPFFAAYYFYISSFGLDSALILGTAMGATSLAAVASIIEEGKLKGKGINFMVSSAAADDVVDLLLLSVVIAILQGESTSVTSISLKIIALVVIWVVILVVSIILIPKITDRISDKYIEEFPLAVLFGLTLLMVSLGYSPIISAFVAGVAFANSVKNSKIKEISSTLLSVFGPLFFVYIGAEVNFLTLNLNTVILSLELTAIATIFKWLGIFPFALAYLRNAKAANTVALGMVPRGETGLVIASLGLSYNALNQEEFEGIVFMSIFTTLIGSALFKIYAKKHLVS

SEQ ID NO: 83886 - protein, 525 aa, Zea mays
  misc_feature (197)..(197): Xaa can be any naturally occurring amino acid
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYITVRFLIGFSLATFVSCQYWMSTMFSSKIIGTVNGLAAGWGTMGXGGATQLIMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCAQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 83887 - protein, 300 aa, Coprinopsis cinerea okayama7#130
MRAFLSLLSLCFLSLLDSSLAVPILEARQSVSTLTAAQVASYKPYTHYAGAAYCSPSRTRAWNCGRNCDARPQFTPIASGGDGAITQYWYVGYDSALRTVVVAYQGTDPDKFFPLLTNANFDLKPLSSSLFPGVSSSVRTHDGFGDAHARSANAVLSAVRTGLSQYGTNSVTLVGHSLGGALATIATLHLSVNLPSSTTFRTVTYGMPRVGNEAFVNLVNSKSVMNRINNKDDLIPIVPGRFLGFAHTEGEIHIVNNGNWVNCPGQDNTNSQCTIGYVPNIFSGNLNDHGGPFDGVNTSC

SEQ ID NO: 83888 - protein, 456 aa, Oceanicola granulosus HTCC2516
MLKNDPLEQWDRDHFLHPSTHLAEFARGNVAHRIVSGGEGSHIVDRNGTRLLDGFAGLYCVNVGYGRREIADAIAKQARELSYYHSYVGHGTEASVTLAHMILERAPANMSKVFFGLGGSDANETNIKLIWYMNNILGRPGKKKIISRWRGYHGSGLMSGSLTGLPLFHKAFDLPLAPILHTEAPYYYRRPNADMSEEAFSAWCASELEAMIQREGPDTIAAFWAEPVLGTGGIVPPPEGYWAAIQEVLDRHDILLVADEVITGFGRLGTMFGSDHYGMKPDVITIAKGLTSAYAPLSGSVLSEKVWKVLEQGTDEMGAIGHGWTYSAHPIGAAAGVANLKLIDELGLIDNAAEVGAHLRAGMRDALGEHPNVGDIRGEGMLCAVELVSDRESKEGFDPSRKVTVNAVAHLMENGVIGRAMPHSETIGFAPPFCLTRDEADEIVAKTAAAVKAVLG

SEQ ID NO: 83889 - protein, 805 aa, Oryza sativa Indica Group
MARGLKRGRTRLIGLIIADITNPYSVNVLSGIEAACREKGFTPLVCNTNNEVDQELHYLDLLRSYQVEGIVVNAVGMREEGLNRLQQSSLPMVLIDRKIPEFACDVVGLDNTQAATTATEHLIEQGFEAILFLSEPLGMVNTRRDRLAAFRATLARYPGVIAENAETPLHEADQLDNTLRQFHTRHRGMRKAVISANGALTLQVARSLKRIGLHWGSDIGLLGFDELEWAELAGVGITTLKQPTWQIGYAAVEQVVRRIEGTSEAVREQRNSIDMLRWSPKMGRKIMVVTAAYGAEQVRQAGGQRAMLPVIAGAGADGVEIRRELFNSEELLALPALGESIELLGLLACYSAPAALFMPDGTLNPDLPRYLSEASTLNALWLKVSLGHFSDTQPLDALRTLLNTSGIALVVENDQTDCGQLAPMQRFQAACRERALPVTLTFDMGNWLWVGDSPEEAARHLAPAVSYIHVKAAVPHKDNFRAVAPDGADSRWLDLLGQLPADAPRAMAMFVATETGELSAVEHFIKRVAGAELNVATGLARLGLNVGWVSRVGDDSFGHFVLDSLKKEGIDAAGVTLDGRFPTGFQLKSKVENGTDPIVEYFRKGSAASHLSVEDYHADYFASARHLHLSGVAAALSASSYSLLDHAATTMKSLGKTISFDPNLRPVLWKSEAEMIEKLNRLAFRADWVLPGLKEGMILTGKNTLEGIADFYLNKGVKAVVLKTGADGAWFKTAEGEQGAVAAVKVENVVDTVGAGDGFAVGVISALLEGKPLQQAVARGNKIGSLAIQVQGDSEGLPTRAQLGM

SEQ ID NO: 83890 - protein, 347 aa, Vitis vinifera
  misc_feature (309)..(324): Xaa can be any naturally occurring amino acid
MDSDSRAAPEVCAFGVICRRFKPHLLMVLVHTCYTILYFTAEAAFNHGLNPHVMVTYRHFIGGLVMFPFAYVLERKVRPKLTLALFAEIFVLSLFGIGLTLNMYFASLTYTSPTFLASMVNTIASLTFVMAIILRLEHLDIRNPRGLAKILGTLFSLVGVMIMTSCKGPVIRNLSSPLIHIGRNNMHENWTKGSILTVASCITWSIWYIMQAFTMKRYPAPLSITTWMNFIGGAQSAVIAVIMQHKPEAWSFSVNIQLWSTIYAVSKVMIGFQIYIYSLKLLNNSNSYLIMPGVRGRAVIPLPVGKTYXXXXXXXXXXXXXXXXSPFTIMVAFTAYFVLGEKLYTGR

SEQ ID NO: 83891 - protein, 550 aa, Schizosaccharomyces pombe
MSFCLASTLPAWEVVQTHYESVGKHLVLKELFAKDSSRFEKFSFTFNGLKEEDGPILFDFSKNLITEETVELLVKLAKEANVEGLRDALFAGEHINFTEDRAVFHPALRNVSEKPMKVNGQDVMPGVRKVLRHMKEFSDAVRSGAWKGYTGKPIKSIVNVGIGGSDLAPVMVTEALKPYGQENLELHFVSNIDGTHLSEALKKCDPETTLFLIASKTFTTAETCTNAKSAKDWFLASAKDPSHVAKHFVALSTNEKEVTAFGISAQNMFEFSDWVGGRYSVWSAIGLSVALYIGYENFEAFLSGAHAMDEYFCSTPLEKNIPALAALISIWYSDFFGAQTHLVAPYDQYLHRFPAYLQQLSMESNGKAITRSGDMVNYTTGKILWGEPGTNSQHSFFQLIHQGTKLIPADFLIPIESHNPIDNNKHHRMLFSNFAAQTEALMLGKTPAEVKAEGTPDEIVPHKTFVGNRPSNSIIAKKITPASLGALIAFYEWVTFTEGAVWNINSFDQFGVELGKKLVKNVLAQLETKGDVENHYSSTNGLINLFKNGF

SEQ ID NO: 83892 - protein, 437 aa, Bacteroides fragilis YCH46
MKIAIVGTGYVGLVTGTCFAEIGVDVTCVDTNSEKIEALKKGIIPIYENGLEEMVIRNTKAGRLKFTTSLESCLDDVEVVFSAVGTPPDEDGSADLSYVLAVARTIGQNMKKYKLVVTKSTVPVGTACKVRNAIQEELDKRGAKIEFDVASNPEFLKEGNAVNDFMSPDRVVIGVESERAEKLMTKLYKPFMLNNFRVIFMDIPSAEMTKYAANSMLATRISFMNDIANLCELVGADVNMVRSGIGSDTRIGRKFLYPGIGYGGSCFPKDVKALIKTAEQNGYQMRVLQAVEEVNENQKSLLFDKLVKQYNGNLEGKTVALWGLAFKPETDDMREAPALVLIDKLLKAGCKVRAYDPAAANECKRRIGETIYYARDMYDAVLDADALMLVTEWKEFRLPSWAVVKKTMSQQVVMDGRNIYDKKEMEEQGFIYHCIGK

SEQ ID NO: 83893 - protein, 475 aa, Oceanicola granulosus HTCC2516
MKIVATLGPSSSSYEMIRKLHEAGADVFRLNMSHGDHAEIRARHEIIRQVEKDLDSPIGILADLQGPKLRVGTFANGEEELEPGQSFRLDLDEAEGDSARVRLPHKEIFDALEPGATLLVNDGKIRLKVKDCGGDFADCEVIVGGTISNRKGVNVPDVVLPLAALSEKDRKDLEFVCDLGVDWLALSFVQRRADVEEARALARDRARILSKIEKPAAVKAFDEILAASDGIMVARGDLGVELPVQNVPPIQKQLVRKSRAAAKPVIVATQMLESMIESPMPTRAEVSDVATAIYEGSDAIMLSAESAAGSYPVEAVSTMDNVAREVEADPNYRDIMIASRSISRTTVADGIVAAAREIAESTDILAICCFSESGTTALLAARERPETPILTMTTETSTARSLCLSWGVQTVMTGDVDRFKTAVVYAVRAARSELNATEDDNIIVIAGVPFNTPGSTNILRVAPCEERLIFRAEPG

SEQ ID NO: 83894 - protein, 418 aa, Bacteroides fragilis YCH46
MKFSELQLNDNVLEALDAMRFEECTPIQEQAIPVILEGRDLIAVAQTGTGKTAAFLLPILNKLSEGGHPEDAINCVIMSPTRELAQQIDQQMEGFSYFMPVSSVAVYGGNDGILFEQQKKGLMLGADVVIATPGRLIAHLSLGYVDLSRVSYFILDEADRMLDMGFYEDIMQIVKYLPKERQTIMFSATMPAKIQQLANTILNNPAEVKLAVSKPAEKIVQAAYVCYENQKLGIVRSLFAEEVPERVIIFASSKIKVKEVAKALKMMKLNVGEMHSDLEQVQREFIMHEFKSGRINILVATDIVSRGIDIDDIRLVINFDVPHDSEDYVHRIGRTARANNDGVALTFVNEKEQTNFKNIENFLEKEIYKIPVPAELGEAPQYNPRSYTNAGRGGRNFRNGNRKNNNGGRSTAPRSGRR

SEQ ID NO: 83895 - protein, 1115 aa, Ustilago maydis 521
MDPHLDPTTALVNLDADKNVGPMEVEEPVSVHDSKAFAEKHLADLGQEEQDFAVCTWKIKGWRTLDKRITGPEFECGGHRWRILLFPFGNSNGQPNDMVSVYLDYADPKGSPEGWHVCAQFALVISNPQDPTIFSTSQAHHRFTAEEMDWGFTRFNELRKLAVPTDGRTRPIIENDCADVTAYVRVLKDPTGVLWHNFINYDSKKETGYVGLKNQGATCYMNSLLQSLFCTHYFRKAVYQIPTEGDVPSESVALALQRVFYLLQTSDQPVGTNELTKSFGWKSLDSFLQHDVQEFNRVLQEKLETKMKGTAADGAITRLFVGKMKSYLKCVNVDYESSRTEDFYDIQLNVKGMNNLVDSFRDYVGTEMLDGDNKYHAEGYGLQDARKGVIFEKFPPVLHLQLKRFEYDIEKDSMVKINDRHEFPLEINLGDYVDMPQCYEDWRYRLHGVLVHSGDLHGGHYFALLKPERDSKWFKFDDDRVTPVTEKEVLEDNFGGEIPNGHPAAQIGARAPVRAMKRFTNAYMLVYIRERDIDEVLKPMAPEDTPVHLRQRLEDERLQMEARKREREEQHLYLTVKLITEDTFRGHQGFDLATFEERNLPATDLPTFRVLKNELYLNFKSRIAAQYNLPEDLIRMWVLVNRQNKTVRPDTVIPENDPNLTLETVRDRMASRQHDLRLFLEVVNGEVPNTEANPSMMIFLKYFDTSRQTLLGVSRVYVQRHMKVGDLVPTINELMRWPPTTQVKLFEEIKPGMIEQMKPKATFSQSEIQDGDVICFQIELSEKDAHDYESQSLYSNPIQFYDFLQNQIKVLFKPRFEDVDYKSEFELTLSKKMTYDMMAAKAGERLKHDPFKLRFTTGNGPNGTPKTVLKRTANQTVNEIVSPSYIQGQASLLYYELLDVSIIELETKRNLKIFWTGANNKEDSVHQFLLPKTATISEVTEQLGKQVKLTADGSGKVRLFEAILNGRQQREFAPVDMIGNIGEGAELFAEEVPLEELQLTEDDKIINVFHFSKELARTHGVPFRFVVKRNEPFRETRKRLQERLEVAEKDFAKFRFALVQSSTYKQPTYLEDDDLLYEHKFQPDDALGLDHTDRSGRAGRFGNNVVQDKGIRIRN

SEQ ID NO: 83896 - protein, 761 aa, Sinorhizobium meliloti 1021
MPGIDKTDRAMTSVTAQEALDFHSQGRPGKLEISPTKPMATQRDLSLAYSPGVAVPVKAIADDPATAYDYTARGNMVAVISNGTAILGLGNLGALASKPVMEGKAVLFKRFADVDSIDLEVDTENVDEFVNCVRFLGPSFGGINLEDIKAPDCFIIEQRLREVMDIPVFHDDQHGTAIIAAAGLVNALTLTGRDFKTAKLVCNGAGAAAIACIELIKAMGFNPENIILCDTKGVIYKGRTDGMNQWKSAHAVETDRRTLAEALDGADVFFGLSAKGALSADMVRSMGARPIIFAMANPDPEITPEEVALIRDDAIVATGRSDYPNQVNNVLGFPYIFRGALDVRASTINDAMKIAAAEALANLAKEDVPDDVAAAYQGNRPRFGPQYIIPVPFDPRLISAIPMAVAKAAMETGVARKPIEDLKAYGQQLSARRDPIASTLQRIVERVRRQPKRIVFAEGEEVQMMRSAIAYANQQLGTALLLGREEVMRETAEREGIDLDRAGIQIVNARLSKRVGAYTDFLYSRLQRKGYLFRDVQRLINTDRNHFAASMVALGDADGMVTGLTRNYSTALEDVRRCIDPKPGHRVIGVSIALCRGRTVLVADTAVHDMPTSEELADIAEEAAGLAKRLGYVPRVAMLAYSTFGHPSGERSERVREAVKILDRRRVDFEYDGEMAADVALNARVMEQYPFCRLSGTANVLVMPAFHSASISTKMLQELGGSTVIGPLLVGLDKSVQIASMSAKDSDLVNLAAIAAYNAGT

SEQ ID NO: 83897 - protein, 845 aa, Aspergillus nidulans FGSC A4
MANPERSYLSRFFSSQFSKLPYPSQSFKDAVILVTGGNTGLGLEAARHFVRLQAATVILAVRDLKKGEQAKLSIEESTKVQGVVEVWQVDLEDVRSVQSLAAKASSLPRLDVVVANAGISTNKWALVGDMERTIQVNVLSTFLLILALLPKMQEQDIEGQIRARPRVVVVSSEGHETTAFAERKAARIFDALRDQRQANMDERYDTSKLIQLYLVRALAERLSRSDKPPVTLNAVSPGLCKTGLLRETPLVARLLTGPVMAILARNAEEGSRTLVHAAAANDGETNGKYLRDYLQRFYLAFRLISSSEQEGPTVHGTTNSSPSPCILSRYGKFYGAANESKAFLAYNNLTRCIRTLHDTKPRNKLRKNMGWQYIVAQPLKVDATICNISLAVQLCTAMRYEELDEACRSLEHLASDAEAEGEDAPLIPDPPGAVSPPTSLSGKAVLQVILLCASATLTLDIGLTVVRAPKIRLFESILCQAYYRTHGNPLPVPMQNIPESQCKTKEIQSGVARLIGWQTVFDGIPGGGPAVATAVLEATIADVVPDDKRSTIYFQLQATVLISDILANPLSSVLMAHNAWTPCFLGVGIQALATVLLIALPETLDFAKGSRPSDASIYGCKEEEPTLRGCLAKNFRSIVSDRNVAGLVFSLLILTVSAESLDFLLQYVSQRYGWSIAQSAMLLSLRAVVEFGLLLVVGSLLLFTQSSGLRNPRQRDLLIARLSLGLIVAGLLILSLSPTVAPAILVYTLGAGFQPAIMSLLASLWKASNPSNLGSLYSTVAIILAVGGVISGPLISLMYRIGLSLGHGWVGLPYFVASGLCAGIAGVLLSVKLPEQEQKPRRRET

SEQ ID NO: 83898 - protein, 458 aa, Rhizobium sp. NGR234
MYSNSLIELDRAHLIHPVASYRGHEKLGVRVLASAKGATVTDASGRQLIDGFAGLWCVNAGYGHESIVEAATRQMRELPYATGYFGLGSEPAIRLASELAERAPGNLDHVFFTLGGSDAVDSTIRFIRYYWIGRGEPQRDQFISVEQGYHGSSTVGAGLTALPAFHAGFGIPFDWQHKIPSHYAYRNPVGDDPQAIIDASLAALRQKVEEIGPERVAAFYAEPIQGSGGVLVPPKGWMKAMRQLCQELGILFVADEVITGFGRTGPLFACHEDEIVPDFMTVAKGLTSGYVPMGAVFMGDHIYQTIADSAGAGAVGHGYTYSAHPVSAAVGLEVLKLYENELLDNGRKAGARLMAGLESLKDHPLVGDVRGRGMLAAVELVVDKEKKTPLPAKAEPARRIFDRAWENGLVIRAFANGVLGYAPPLCCTEAEIDGIVERTRKVLDETLEDPAVRSGLSD

SEQ ID NO: 83899 - protein, 531 aa, Solanum lycopersicum
MGDIEGSPGSSMHGVTGREPVLAFSVASLIVPTDTSANFKVPVDSEHKAKVFKFYSFSKPHGLTFQLSWISFCTCFVSTFAAAPLVPIIRDNLNLTKMDVGNAGVASVSGSILSRLAMGAICDMLGPRYGCAFLIMLSAPTVLCMSFVSSAGGYVAVRFMIGFSLATFVSCQYWMSTMFNSQIIGLVNGTAAGWGNMGGGATQLIMPLLYDIIRRAGATPFTAWRIAFFIPGWLHVIMGILVLTLGQDLPDGNLASLQKKGDVSKDKFSKILWYAATNYRTWILVLLYGYSMGVELTTDNVIAEYFFDRFDLKLHTAGIIAATFGMANLLARPFGGWSSDVAAKHFGMRGRLWNSWILQTLGGVFCLLLGRATTLPLAITWMIIFSIGAQAACGVTFGIIPFISRRSLGIISGMTGAGGNFGSGLTQLLFFTSTKYSTGTGLTYMGMMIIACTLPVMLVRFPQWGSMFLPPSKDPIKGTEEHYFGSEYTEDEKQKGMHQNSIKFAENSRTERGKKRVGSAPTPPNVTPNRV

SEQ ID NO: 83900 - protein, 482 aa, Acidobacteria bacterium Ellin345
MSTTSAPAVGSAQFGVVGLGVMGQNLALNVSDHGQVVSVWNLEADWVTKFLTQHSDRKMTGSGDLKEFVQSLARPRRILMMIMAGNPVDQMLDKLAPLLEPGDIVIDGGNSFFKDTQRREAAYRTKNLNFFGMGVSGGEEGARFGPSLMPGGDEASYEHLKPTLEAIAAKTDYGACVTYVGPNGAGHFVKMVHNGIEYGDMQLIAEAYDLLRKALGLGAKEIAAIFEEWNKGKLESYLIEITSHVLQVDDPETGKPLVDMILDKAGQKGTGKWTQQIALDLAVPIPTIGAALDARVLSSMKDERVAASKKLGAPSRQYSGDKKEFINAVQDALYASKVCSYAQGMSLIRAGSKEWNWNVNLREMARIWTGGCIIRARLLADIMHAFDRDANVANLLVESEFTSRVLESEKNWRSVVQTAAGLGIPTPAFSSSLAYFDSYRSMQLPQNLTQAQRDFFGAHTYQRADRPDAGFVHTDWIKLVKK

SEQ ID NO: 83901 - protein, 514 aa, Acidobacteria bacterium Ellin345
MSTVVQATPTRSIAIPPMPKAEPCTIVIFGASGDLTKRKLIPALYDLACIGCISGQQFDVLGTGRTEMTTDEFRKAMRDAASTSKDARKFSDWNWEEFEKRLHYFPGDINNDGFYHALKDQLSEIEKNGGSSNHLFYVSTQASLAPPIVQGLGKCGLSKNEKGWTRIVLEKPFGRDLESAKALNREVLQVFDEKDVYRIDHYLGKETVQNILVFRFGNSLFEPIWNRNYINSVEITAAETLGVEQRAAFYEETGALRDMVANHLLQLVTLTAMEPPVAFDADSVREQKVQVLRAIHHMTPEQVCERTVRGQYGPGKINGKDVPGYREEPGVKPDSRTETYVAVEFRIDNWRWAGVPFYVRSGKRLAKSETEIKIHFKRTPQALFAKTSDDDIEANVITLRVQPNEGITMSFAAKQPGAQMKAVPVKMDFSYQTAFGGQAPVAYETLLLDAMRGDPTLFTRGDEAENQWRIITPIEDAWLQLPVPKFPNYAAGSDGPEEANTLIAEECKKWSPIG

SEQ ID NO: 83902 - protein, 211 aa, Zea mays
MGCATSKQFSRSAPAHADPAVLATQTSFTVNEVEALYELYKKLSCSIVKDGLIHKEEFQLALFRNSRRANLFADRVFDLFDLKRNGVIDFEEFVRSLSVFHPKADTSEKTAFAFKLYDLRGTGYIEKEELREMVLALLDESDLCLSDSTVETIVDNTFSQADSNGDGRIDPEEWEEFVKKNPATLRNMTLPYLQDITMSFPSFIMRSEASD

SEQ ID NO: 83903 - protein, 122 aa, Brassica napus
TGAKTECFSKLAARKHARIVQKLGFDARFKDFKIQNIVASCDVKFPIRLEILAVSVHRDFLSYEPEMFPGLIYRMREPKIVLLVFVSGKIVITGAKKREDTFRAFENIYPVLTQFKKICIHR

SEQ ID NO: 83904 - protein, 602 aa, Opitutaceae bacterium TAV2
MSSESSPKSEYTVQGIPASQGIAYGPAFLYIKSEVEVPCYEVDQAKHANEIARFDHALVTTRQQIQKTQAVVEKNLGPDEARIFDAHLLVLEDQALITETIRDFEKTSQNIESCFNRIAQRYIKAFAEIDDEYLRERASDIRDVAQRMLNTLLGRTAQTLSQLVEKRIVVANDISPSDAAGIDRSQALGIVTDTGSKTSHAVIVARSMRVPAVVGARDLTSRIKTGDIVLVDGYEGLVIVNPSEKTLFRYGQIQLQKKSYEQRLLEAAKLPSVTLDGVDVPLRANIEKSDEFKLVREYHSEGVGLYRSEFLYLNSSSVPTEDEQYDAYRQVVAELAPAPVTIRTMDLGGDKLMSAGAVLSSREDNPFLGYRAIRICLDHVDLFKAQLRAILRASAHGNVNIMYPMISGRDELRRANAVLDECKHELREKGEAFDEAVKVGSMIEIPSAAMTADLLARECDFFSIGTNDLIQYLIAIDRLNDRIAHLYEPTHPAVLRTLRQIVDAAHAARIKVSVCGEMAGDPVLAVLLLGIGVDELSMTPPLLPAVKNVVRSMRMADARRLASDALQMESPSEIYRRCVEFYRERVPEEIANGKLRMANGSG

SEQ ID NO: 83905 - protein, 56 aa, Zea mays
KLLHGPLQHLRCDGSDSRTLDETLENMHALNRMFSLDMEKAIIEQKIKAKVEKTQN

SEQ ID NO: 83906 - protein, 590 aa, Oryza sativa Japonica Group
MQALLIFAILAVLAGVVQGQQWCQPFSCGHLSNISHPFWRRGDPHRCGVSSYELECSSGKATIQINTGTYYVTSINYNDSSFWVVDANLQDANSNCPLPRSNHRPFIWGIPGPSYTRELTLQGIWWATFVNCSQAVKNNNKYIHVDCQNTSSSFVYVLNVAPYYALMENLEPSCGYLAMIPVSWTPASGKKYQYFAELMRKGFSVRFPFVLDHPTAFELIKQCLNRSIRFVLAPLALLTFLAQRYWKTRITIDAVEKFLRMQLMLGPTRYTYTDIIAMTSHFRDKLGQGGYGSVFKGVILPGDVYVAIKMLDNYNCNGEEFISEVSTIGSIHHVNVVRLVGFCAEEMRRALVYEYMPHGSLDKFIFAPEKSFSWDKLNEIALGIARGINYLHQGCDMQILHFDIKPHNILLDSNFVPKVADFGLAKLCPRDNNYVPVSAARGTVGYIAPEMISRSFGVISSKSDVYSFGMLLLEMAGGRRNSKQNMSSSTQVYYPSLVYNQLIQQEMGEITNTLNMHELERKLCVVGLHCIQVKPPDRPTMSEVIEMLEGDVDGLQLPSRPFFCDDEPLPLLVDSYRFSSELTEISEEDG

SEQ ID NO: 83907 - protein, 256 aa, Opitutaceae bacterium TAV2
PPCLLGFGGFGFCSAKLFPPRGLGPIRWLALEGGGFPKVIGQLPALEGKLGVPKVGAFPAVFRLINPPCGVTQETDFFPPPNFWKLLGPLPPPPPPSASDRVADALRFAVVIDAIDNVPNKALLIASCVRRGIPCVTTGGAGGKRDATRLRTGDLGESGGDDLLKQVRKTLRREHGFPTGERVRFGVRCVWSDERPVFPWADGTCRAEAEPGGRLRLDCASGFGTAVWVTAAFGLAAAQEGVAAVMCRQGGGLKSI

SEQ ID NO: 83908 - protein, 786 aa, Coprinopsis cinerea okayama7#130
MPTLALPIPSDLSPTTVKNTASLFRIVALALISGAAIASRLFAVINFESIIHEFDPWFNYRATKILATKGFYEFWNWFDPTAWYPLGRVVGGTVYPGLMATSGVIYNVLKAINLPVDIRNICVLLAPGFSALTAFATYLFTTEMKNESAGLLAAAFIGIAPGYISRSVAGSYDNEAISIFLLMFTFFLWIKALKTGSALYGTIAAIFYFYMVSAWGGYVFITNMIPLHALVLMLMGRFSSRLYAAYCSWYAIGTLASMQVPFVGFQPVSTSEHMGALGVFGLLQIVAFTELVRSHVSSQHFQKLLRIALVASGILGTAAFVFLTYKGKIAPWTGRFYSLWDTGYAKKYIPIIASVSEHQPTAWPSFFMDLQMLIFLFPAGVILCFKELRDEHLFVIIYAVMASYFAGVMVRLMLTLTPVVCVASAIALSSMLDVYLNPVEPDAAAETTSEDAASNGPSTPAPSATPAASKKGKKAASDNAASTNILSELAAVATGVPAGKSSKKDKSKPGIFGLDSRLVVLLNTTFLLVFFVLHCTWVTSIAYSSPSVILSSQNQDGSMHIIDDYREAYYWLRQNTAPDSVIMSWWDYGYQIAGMADRPTLVDNNTWNNTHIATVGKAMSSSEEKAWPILRKHDVEYVLVIFGGLIGYSGDDINKFLWMVRIAQGVWPDEIQEPNYFTPRGEYRIDEHASRTMRESLMYKMSYYRFAEIFGPGQAVDRVRNQPVPKTPIELDYLDEAFTSENWIVRIYQVRKEDPLGRDLKSANAFAAGKKAKKSKPLVRRKALVA

SEQ ID NO: 83909 - protein, 170 aa, uncultured archaeon
MTLDDTDREILAILEQDDATPSATLAEKLGITEGEVEERIGRLADTRTKILVVDDEPDTLLPLTRALEADNYAVVGAVDGAEALIKVSNETPDLILLDLMLPKLNGYEVCMKLKENPATRHIPVIMLSAKGEIKDKVLGIEIGADDYVTKPFDLLELKARIRALLRRTGA

SEQ ID NO: 83910 - protein, 322 aa, Wolbachia endosymbiont of Drosophila simulans
MNKIINNVFAREILDSRGYPTIEVEIELCDGAIGRASVPSGASTGKLEALELRDQDEKRYCGKGVLKAVQAVNGIIADEIIGMNAADQNAIDKALIELDGTKNKSKLGANATLGVSLAVAKAAANSFKMPLYRYLGGKQTSVMPVPLINIINGGVHADNKLDFQEFMILPVGAETFSEAIRISAEVFHNLRSILKKKGYSTNVGDEGGFAPNIESTEEALDLIIYAIESAGYSAQSDFALGLDVASSTFYEDGIYEFESKGLTSEELTEYYCNLVERYPIISIEDAMSEDDYEGWKLLTAKLGNKIQLVGDDLFVTNCELIC

SEQ ID NO: 83911 - protein, 310 aa, Salinibacter ruber DSM 13855
MGGDARRALFVPAPSPTLHRMLPDALRDTLEERLDATIESVASVRGGCIANACRLETDAAPFFLKHGPDEVARTFPGEAAGLEALGAADSPLVVPSVHDTAPATDDRPGFLVMEWVNPGREGRRFWDRFGEGLAALHRHTADAYGFGQDNFIGRLPQSNAWTDDWPTFFREQRLAPQVDMARERGRWRDGWGTALTTLYRRLPDILPRSPEPSVLHGDLWKGNYLVTAVGDPALVDPATYYGHREADLAMTELFGGYDDRFYDAYRSAWGLAPEYGTRRDVYNLYHLINHLNLFGGGYAAQVEDTLRPFK

SEQ ID NO: 83912 - protein, 369 aa, uncultured archaeon
MVIGMNKRLIICIVMVLILAISGCIDPDSGGNAAVVKEGDQVLVDYTGRLENGTVFDTSVRDVAIETGTYDPNRDYQPIEFTVGAGRMIKGFDHGVVGMAVGEEKTLTLPPEDAYGVHREDMVQIVPVEELRAAGITPVIGEKLTTSLGQVGTITNLTNTSVVIDFNHRLSGKTLIFDVKLVSIGSEDVVAEDDGADSDKGDTMADTTEKTVEGGNRIANIDTSMGMMTVELHEERAPDTTSNFIELANRGFYNDLTFHRVIDDFMIQGGDPKGDGTGGSGKTIKLETHPELTHVDGAVAMARSQHPDSASSQFYICDGAQPMLDGQYAVFGRVTNGMDVVRAIAEVETDSRDRPIENVTITRITILES

SEQ ID NO: 83913 - protein, 1241 aa, Coprinopsis cinerea okayama7#130
MVDLKHTQEQLELAPQRVTVETRYGPVTGGRAANGAAVFLEIPYAVPPKRFEDPQPLPDTFRYPDQKEYIVESAYAAQPRNDGQAAAMDFKAKVGLGAPTENPLFLNIYVPPSYPSKRNFPVKVYIHGGFLQFGSPHGLSAQAQYAAAEREEIWVNIGYRLSAFGFIASAKNGLTGNYGFKDQWLALKWIKANISAFGGNQDDIQLTGLSAGAHSVHQILHHLSVLPPGENAPFSSAVLQSNAMPTDPKTSAQLDPQFDALCKALGLDPDSPDILETLKDDTKVPASRITEVIEEEKLGRYGAFRGCLSDDWIITSPGPMERQHNGSFATSLRERGVKYIVVGEVSEEWYLYSIAHPISSPADITFQLERYFTPEFVSELVGHYPPLPSETSEAELLRRFGDVFSLAQVYLPVRVLARDLVARGFPVLRYRISWGPEHGCLPHKGLVTHGTDRALWTLCFPALTDTEASVARSWVGRVEKEVENALNGHSRAADEVLLLDEEQNIDMSLQINLSSRDILEAYQKVLNSQGIDWAIFTYEGGTNDLKVQATGDGGLEELEEEFHDGRVQYAFARVTEPHSQLPKFVQINWCGDGVPEAKKGLFHTHSQAVARFLKGTHVVISARNEGDVTPELIMSRVEAASGAKYSIQKEAPRKFEPIAPVGTNYKPVGKVDIAALRKGPTPTPPAKPAPPPASSRPAFSAGRPIASAGSLYGKAAASAPAGAWEEEKKPAATPPPAAPPLPTTSRPPTLPTTSRPAFSAMRPGGSPAAAARSVPPAPAPAAPSPPPAAPAAPTPVASSNVPTKPAEEDRIEPLKSSYTPVSLPAPKKLKNPFAAFEQQQQQEQSRAPAPSPSGKKLTWSERQALAKKQQEEEEARSRSASSFTPTTPVATISKPAFGRATVTQSGPRNFGAGTAVAAGVGAAAVGVGAGVAASRWGAKREPTPPPQEPEPEPEPEPAAEPEWEPEPEVAAPPPPPPPPPPPPRAVEPEPEPEPEPEPQFEAPPPPPPPPPPPPPAPPAPPAMAHVEPEPQFEAPPPPPPPPPPPPPAPPAPPVTQVAALSISEPEPEPEPEPEPAAEQEYQGTVAVVLYEYEATEDNEMNLVEGEYIEQIEEIDEGWWTGVGAGGKTGLFPANYVEIVRRAEEAGEAAPPPPPPPPPPPPAPAAPVAPPPPPREPTPEPEDVGIVAIALYDYDAAEDNEISFREGERITEIEPASEDWWQGKNPAGEIGLFPANYVEVQE

SEQ ID NO: 83914 - protein, 318 aa, Pseudomonas fluorescens PfO-1
MHVFTRDDIENAARQVYQVMSATAQYRWPLLAERLGCTVWVKHENHTPTGAFKVRGGITFMHWLRREHPTVKGIVSATRGNHGQSLALAARAVGLKALIVVPQGNSLEKNNAMRGFGGEVVEYGRDFDEAREEAARLAQKHDLFLVPPFHVELVKGVATYALELFGAAPDLDTVYVPIGCGSGICGVIAARDALGLNTEVVGVVSTEAAAAKLSFEANAICETASANTFADGLAVRKPIAQAFDIYKEGAARILSVSEVEIAEAMRVYYTDTHNLAEGAGAAALAALMQDRGRMEGKKVGVVLSGGNIDRSVYAKVIG

SEQ ID NO: 83915 - protein, 372 aa, Coccidioides immitis RS
MAKGNVLVTGGMGYIGSFTSLALLEAGYSVVIADSLYNSSDEVLNRIELICGKRPGFFKLDVTDEAAFDRLFDENPSIDSVIHFAALKAVGESVERPLDYYNTNVYGTLCLLRSMVRHNVTNIVFSSSATVYGDATRFENMIPIPEECPLGPTNPYGNTKVIAETAITDVISSQRTNAIKAGNAEDAEKWNAALLRYFNPAGAHPSAIMGEDPQGVPYNLLPLLAQVATGKREKLLVFGDDYASHDGTAIRDYIHILDLANGHLEALNYLRDNRPGVRAWNLGTGKGSTVFDIIKAFSKAVGRDLPYEVVARRDGDVLDLTGNPSRANRELGWKATRTLEQACEDLWRWTKNNPQGYRQSPPEEFLAKLKQN

SEQ ID NO: 83916 - protein, 148 aa, Glycine max
  misc_feature (141)..(141): Xaa can be any naturally occurring amino acid
MATRVVAEQKPKTKIVCTLGPASRSVPMIEKLLRAGMNVARFNFSHGSHEYHQETLDNLRAAMENTGILCAVMLDTKGPEIRTGFLKDSKPIQLKQGNEITISTDYDLKGDEKTICMSYKKLPEDVRPGMVILCADGTISXTVLSCDK

SEQ ID NO: 83917 - protein, 346 aa, Vitis vinifera
MHFSNHGSEALVYIKTHENPIYQPSSPASDTAFPILAIAVLSIMATAFLLVSYYIFVIKCCLSWHHIELLRRFSTSQSRQQEDPLMDYSPTFLNRGLDESLIHQIPTFLFRRGQSEEGSFHGCVVCLNEFQEHDMIRVLPNCSHAFHLDCIDIWLQSNANCPLCRSSISGTTRYRNDPIIAPSSSPQDPRPFSEALMGGDDDFVVIELGGGDDRGVILPPRQQERADSRELLVQSRGPSPTKLQQKLENKKSRKFHYVSSMGDECIDVREKDDQFLIQPIRRSFSMDSAADPQLYMTVQEIIRNKNRPLSEVSTSQECDSRVRRSFFSFGHGRGSRNAVLPIEFLV

SEQ ID NO: 83918 - protein, 358 aa, Dechloromonas aromatica RCB
MKICVIPGDGIGVEICAEAVRVIDALKDIHGLKIEYEYGLLGGAAYDQTGRPLPVETLRLADEANAILLGAVGGPKWDKLPAESRPERGLLGIRKYLGLNANLRPIKVYPELANASTLRPEVVSGLDMMIVRELTGDIYFGQPRGIRTSGFERVGYNTMEYSESEIALIAEMAFRIARQRSGKVMSVDKMNVLECMQLWRDVVTKVGERFPDVTLDHMLVDNAAMQLVKNPKQFDVLLTGNMFGDILSDEAAMLTGSIGMLPSASLNVEDKGMYEPCHGSAPDIAGQGVANPLGMILSAAMMFRYSLGRPDMADAIESAVQTVLTNGARTRDIFQAGDRLVSTSEMGGLVEAALRRIS

SEQ ID NO: 83919 - protein, 80 aa, Oryza sativa Japonica Group
MSEEAGRPLPKFGEWDVNDPASADGFTVIFNKARDEKKGGNGQDTDSPCKETRTERVESYAPKTNSKKWFCCVTSSPTQS

SEQ ID NO: 83920 - protein, 512 aa, Trichodesmium erythraeum IMS101
MIEVEVHQSLLNFLRSQNQPHWPHNLTMARLVARALRLGRSALIQTASPPGSRNQQYQLSYLLPVLMWPRKTILVAPQPVQEHLITVEIPKLMASNSQISSSISKKGIQIYPLQEPDFNGLLLMKPKAWLVSQCQDDHFSKGIPTIIDWADYLENWVQSFLTTSFLPTNWNQLMQFYPDQADLIRETRVNLTKSLFQHPANPYSCYLIEQHEQQILQNLIEGLSLTLRNQELQSHNLNHNFWYQWQSNGQLRWAEIHRQRGSFSLYSTPYDLSEALKNIWTKQPVVIIGGALDLEAKADTYRQNMGLGNITCVKFSPDRHNEMIQLYLPNSLPMPNTPQFQPALISEIRTLLHISSSVINRLIVLLIGDVPLKSQVGTTLASEFGSRVQVETVFSEENGILITGWEFWQQHQKEFKPPKLLIIATLPLPSLEHPLVSGRVNFYKQQGLDWFRLYLLPKALQDMQRAITPVRESQGIVALLDSRVIRRSYGQQILTALSPFAKIDYLDTTWLI

SEQ ID NO: 83921 - protein, 188 aa, Sinorhizobium meliloti 1021
MFIQTEATPNPATLKFLPGKVVMENGTAEFRSEEEALAGSPLAARLFSIPGVTGVYFGYDFITVSKEAQEWQHLKPAILGSIMEHFMSGQPIMSGAGRAEQTDEEDEFFDEGDEAIVATIKELLETRVRPAVAQDGGDITFRGFKDGTVFLNMKGACSGCPSSTATLRHGVQNLLRHFVPEVEAVESV

SEQ ID NO: 83922 - protein, 161 aa, Candidatus Kuenenia stuttgartiensis
MAQPEQPINLEETVVKINRCTTVTKGGKSMSFSSLVVVGNKAGSVGIGFGKAREVPNAVNKAVKEAKKQLFKINLKGDTIPHEIMGRYKAARVFMKPASPGTGIKAGAPARAVLEYVGVRNILTKCYGKRNPLNVVKATLNGLRSLKTKEEVEELRGVRIE

SEQ ID NO: 83923 - protein, 484 aa, Rhizobium sp. NGR234
MKLKDKELFRQAGVIGGEWIGAASGDVVEVFDPASQAVLGTVPDMGTAETRAAIEAAETAFGPWKKKTHAERAALLERWHALMIEHLEDLALILTLEQGKPLDEARGEIRYGAAFVKWFAEEARRIGGHTIPSPTPDRRIVVLKEAVGVCAIVTPWNFPNAMITRKVAPALAAGCTVVIKPSEFTPFSALALGVLAERAGIPAGVVNIVTGMPTAIGNEIMANETVRKISFTGSTRVGSLLMRGAADSVKRLSLELGGNAPFIVFDDADLDLAVEGAIASKFRNGGQTCVCANRILVQSGVYDAFAEKLAARVNAMKVGPGTEPGVAIGPMINAAAIDKIDRHVEDALAKGAKIAARGRSLPVGRQYTAPLVLTGATTEMLLASEETFGPVAPLFCFETEEEAITIANGTPFGLAAYFYTENLKRSWRVAEALEFGMVGLNTGAISTEVAPFGGVKQSGLGREGAQVGIEEYLELKSFHIGGLA

SEQ ID NO: 83924 - protein, 347 aa, Rhizobium sp. NGR234
MKSYSIALIPGDGIGQDVTDAAWQVLSTVARHSGFTLTATPFPWSCAFYKETGAMMPPDGIETLRRFDAILLGAVGWPAEVPDSVSLHGLLLPIRKAFVQYANIRPHRLLSGVKGPLKAEGFDILCIRENTEGEYSGAGGRVHQGTADEVAVETSIFTRTGVERILRFGFDQARQRRRKLASVTKSNAQKYSMVLWDEITRELAAEYPDVEVTSYHIDAMAARMVMAPESLDVVVASNLFGDILTDLGAAIQGGLGFAASANINPDRSAPSMFEPVHGSAPDIAHLGIANPIAAIWSGAMMLDHLGQARAARKVIEALERTTARGIGTVPGKNRTETITAAVLAALD

SEQ ID NO: 83925 - protein, 345 aa, Physcomitrella patens subsp. patens
MATAGVLDEETTAKVLRQMEFYFSDSNLPGDAFLLKNIEESDDDMVELSLLCTFQKMRKHLGVNESDPTKFPADKLAGVAEVLRNKSTFLRVSEDGKRVGRVTKLQKPEVVQAEVDARSIAANPFPYTITMEEVETFFKQYGQVKSVRLPKHASSKNVLSGFAVVEFSSEEEAKKILKMELVCQGATLELEPKTTFDERKETIFDQGANGGRQSGESKTNRRNEKKFQDRHTDSEEDYQKGLIVSFTAKKIGALDESEKKADDEKVVEGEKPSEIESGDEEKLSREDIKGALAKFGVIRYVDYAKGDSTGFLRFDVPEDAQKLRAAAAVTPEGGLTIAKHLVTFE

SEQ ID NO: 83926 - protein, 240 aa, Physcomitrella patens subsp. patens
MAPARGDSKVLNFGDVTLRRSDLQRLKQPEELNDQIIEFYFEHLTSNLNVDTQSGSVSPLLLVGPSQTYWLLHCPSDSLQDSVKPMSLAEREMVVFALNDNPDPSAAEGGCHWSLVVYSRPQNVFEHYDSLGGLNGAVAVRFVNKIKLHMGKRAAQAKSRERETPQQQNAYDCGVYVMKTSQLLCNAFKEQQRAVTFADIVDSLRTQLTPASVDEMRTSTVKLILQLAKQSPSRAAVTTS

SEQ ID NO: 83927 - protein, 250 aa, Candidatus Kuenenia stuttgartiensis
MIVRKSPREIEIMRSAGKITAEALRLARELTKIGITTDYLNEEIEKFIISKDAVPVFKGYRGFPKSICTSINEEVVHGIPSQRRLDEGDILSIDVGVRYRKYVADAALTIPVGIISEEAERLLDVCEKSLYLAISVIKSHEKLSLISRTIQEFVEENGYSVVRDYTGHGIGRSMHEDPQVPNFVSKSLLEYDEILMPGVTIAIEPMICVGKPGTKVLNNRWVVVTKDGELSAHFEHTVVVTENGAEILTL

SEQ ID NO: 83928 - protein, 100 aa, Arabidopsis thaliana
  misc_feature (54)..(54): Xaa can be any naturally occurring amino acid
MVSSMLSSAAVVTSPAQATMGAPFTGLKTSAEFPVTRKTNKDITSIASNGGRVXSCMKVWPPIGKKKSETLSYLPDLSDVEIGSGKWTTLPRKKAGFPWG

SEQ ID NO: 83929 - protein, 332 aa, Physcomitrella patens subsp. patens
MQNNPYPIYTSAPVSSGLGAVLDQDLHTNPDAVSKSLEFDLDSYLRAKAKAVNVALDKAVPMQYPEKIREAMRYSLLAGGKRVRPALCIAACELVGGNEDLAMPSACAMEMVHTMSLIHDDLPCMDDDDLRRGKPTNHKAFGEDTAVLAGDALLAYAFEHIARATTGVPADRVLRVIAHLGKAVGSEGLVAGQIVDIASEGDRTVGLEILEYVHTHKTAVLLESAVVSGAILGGASEDEISRLSNYARNVGLLFQVVDDILDVTKSSAELGKTAGKDLVADKATYPKLLGLEKSRAFAEELIRKAKDQLSVFDQQKVAPLLGLADYIAYRQN

SEQ ID NO: 83930 - protein, 1069 aa, Oryza sativa Japonica Group
MALRLLVVVAVAAVVSCAVAADEGSVVEVWPMPATASKGGQTLHVSRELRMTAEGSKYADGEAILKDAFQRMVTLIELDHVINGSSQGLPLLAGVNVVVHLPGDELNFGVDESYNLSVPATGSPIYAQIEAQTVFGALHALETFSQLCNFDFTSRLIELQSAPWSITDMPRFPYRGLLIDTSRHYLPVPVIKSVIDSMTYSKLNVLHWHIVDEQSFPIEIPSYPKLWNGAYSYSERYTMDDAIDIVQYAERRGVNVLAEIDVPGHALSWGVGYPSLWPSATCKEPLDVSSESTFQVINGILSDFSKVFKFKFVHLGGDEVNTSCWTSTPRVKAWLAQHGMKESDAYRYFVLRAQKIAKSHGYEVINWEETFNNFGDKLDRRTVVHNWLGGGVAEKVVAAGLRCIVSNQDKWYLDHLEVTWDGFYMNEPLRNIKNPAQQKLVLGGEYMDLTYLLYLVEHEGRVNTRYPYFPRLYSSEEAISASLHEDHSSARLKNSFVFSSGYLIVSMFYLQATTNMELTSSSAMWLAMAILAITAALTKIALGGGRRRCLSESSDLTCKTPPPPPVVNCIALLGLLPALFRGDVPATMQQLYAKFGSVFTVSVAGLLKATFLVGPEVSAHFFQGLESEVSHGDLFEFTVPMFGKEVGHGVDNATRIEQGRFFAEALKPVRLRIHVDPMVQEVEDYFAKWGQHGTVDLKHELEQLLLLISGRCLLGKEVMGTKFDEVCNLFRDIEGGVNLMSVFFPYTPLIPSNRRRDMARERLHAIFSDIVRSRKQQQGDQEEVNDKDVLQSFIDSRYKADGRATTEAEVAGLITGVLFAAKHTSTHTSVWTGARLLTHEKFLAAAVDEQDQIVRKHGIINGRIVTDHYGFLMEMHMLHICIKETLRLHPPAPMIVRTALRQFTVRTREGHEYCVPAGHTMASPIVISNRVPYIYKDAHLYDPDRFGPRREEDKVGGKFSYTSFGGGRNSCVGENYAYMQIKAIWSHLLRNFELKLLSPFPKTDWSKLVPEPQGKVMEKKRKYNSEELARYTLLKEGNGGGSESARLPHHQVYVIFSYHLILMYFYITR

SEQ ID NO: 83931 - protein, 590 aa, Oryza sativa
GAVDFLVKPIRKNELKNLWQHVWRRCHSSSGSGSESGIRTQKCTKPKVDDEYENNSGSNNDNEDDDDNDEDDDDLSVGHNARDGSDNGSGTQSSWTKRAVEIDSPQQMSPDQPSDLPDSTCAQVIHPTSEICSNRWLPTANKRSGKKHKENNDDSMGKYLEIGAPRNSSMEYQSSPREMSVNPTEKQHETLMPQSKTTRETDSRNTQNEPTTQTVDLISSIARSTDDKQVVRINNAPDCSSKVPDGNDKNRDSLIDMTSEELGLKRLKTTGSATEIHDERNILKRSDLSAFTRYHTTVASNQGGAGFGGSCSPQDNSSEALKTDSNCKVKSNSDAAEIKQGSNGSSNNNDMGSSTKNAITKPSSNRGKVISPSAVKATQHTSAFHPVQRQTSPANVVGKDKVDEGIANGVNVGHPVDVQNSFMQHHHHVHYYVHVMTQQQQQPSIERGSSDAQCGSSNVFDPPIEGHAANYSVNGSFSGGHNGNNGQRGPSTAPNVGRPNMETVNGIVDENGAGGGNGSGSGSGNDLYQNGVCYREAALNKFRQKRKVRNFGKKVRYQSRKRLAEQRPRIRGQFVRQSGQEDQAGQDEDR

SEQ ID NO: 83932 - protein, 547 aa, Oryza sativa Japonica Group
MAIILAITAAVTKIARGGRRRSATDPTCKMPPPPPVVNSIALLRLLPTLFRSGLPAILHELYTKFGSVFTINLAGLLKMTFLVGPEVSAHFFQAVTKIARGGRRRSATDPTCKMPPPPPVVNSIALLRLLPTLFRSGLPAILHELYTKFGSVFTINLAGLLKMTFLVGPEVSAHFFQGLESEISHGNLLEFTVPMFGKEIAHGVDSATRNEQARFFVDALKPARLRIHVDPMVQEVEDYFAKWGQHGTVDLRRELEQLLLLISGRCLLGKEVMGTMFDEVCNLFRDIEGGVNLMSVFFPYTPLIPSNRRRDMARKRLHAIFSDIVRSRKQREGDNVDKDVLQSLIDSSHERFLTAAVDEQDKIAREHSNINGGGRITDDRYGSLMEMRTLHSCIKETLRLHPPVPMLVRTAHKQFTVRTREGHEYAVPAGHTIASPIVISNQVPYIYKDGHLYDPDRFGPAGREEDKVGGKFSYASFGGGRTGCVGEGYAYMQIKAIWSHLLRNFELRLLSPLPKSDFTKFVPEPHGELMVSYKRRQLLPTTLLEKC

SEQ ID NO: 83933 - protein, 414 aa, unidentified eubacterium SCB49
MSVTQTTKSQDAIAVEDKYGAHNYHPLPVVLNRGEGVFVWDVEGKKYYDFLSAYSAVNQGHCHPKIVNAMNEQAQTLTLTSRAFHNDVLGKYEKYAAEYFSFDKVLPMNTGAEAVETALKLCRKWAYEVKGIKENEAEIVVCENNFHGRTTTIISFSNDPVARKNFGPYTDGFVKIEYNNLDALKQALESNKNIAGFLVEPIQGEAGVYVPSEGYLAGAKALCEEYNVLFIADEVQTGIARTGNLLAVDHENVKPDILILGKALSGGAYPVSAVLANDPIMSVIRPGTHGSTFGGNPVAAAVAMAALEVVKEESLADNAEKLGAIFRNEINAFIETSNIATLVRGRGLLNAIVINDVEESDTAWNICLRLRDNGLLAKPTHGNIIRFAPPLVMTEAQLRDCVSIIINTLKEFEK

SEQ ID NO: 83934 - protein, 247 aa, Listeria monocytogenes str. 4b F2365
MTLQGKVAVVTGGSRGIGRDIAIKLAKEGANIFFNYNGSPEAAEETAKLVAEHGVEVEAMKANVAIAEDVDAFFKQAIERFGRVDILVNNAGITRDNLLMRMKEDEWDDVININLKGTFLCTKAVSRTMMKQRAGKIINMASVVGLIGNAGQANYVASKAGVIGLTKTTARELAPRGINVNAVAPGFITTDMTDKLDEKTKEAMLAQIPLGAYGTTEDIANAVLFLASDASKYITGQTLSVDGGMVM

SEQ ID NO: 83935 - protein, 711 aa, Oryza sativa Japonica Group
MEAAALSTVLYVLALVVADADHHVVRVQGRRHQCQPFSCGHLQNVSYPFRRRGDPRSRRCGFRSYELDCSSDDGKATIRINTGKYYVSSINYTASIFWVVDANLQDDANSSCPLPRSDQLPYVGLGIPGSHDSWDLGLDDMITWVGFVNCSQELITNSSSKYLYVYHPVDCLTTALSFVYYMLPFFGSLVPSVEDIEPSCGYLAMTPIGGGWNSVNLPEYTSYAEVVKSMRGGFAVKFPTPWLNWFGLIKKCLNKSVSHRTMSTNGGLEHLDSLFAANSLLPIPPTSPPFAGTRRTSSAVQLPRDLLCLGQSYMAGLVVRRGQGPSAAWRRGEGPPLVAGGGGDVDRAGDDGGGEGDGQATKSTMDGVRRLRMAKVCVRTVGRDDFSYSQGQGGYGSVYKGVFLPGDVHVAIKMLDGNSNCNGEDFISEVATIGRIHHINVVRLVGFCSEEMRRALVYEYMPRGSLNKYIFSSERSFSWDKLNEIALGIARGINYLHQGCEMQILHFDIKPDNILLDDNFVSKVADFGLAKLYPREKSFVSDRALRGTVGYMAPEMVSRSFGVISDKSDVYSFGMLLLEMAGGRRNADPNANSNASRAYYPAWVYDQLIADQQVDEISNVADMHELERKLCLVGLWCIQMKSHDRPTMSEAIEMLEGDVDALQVPLRPFFCDGDGIGNGMPPPQVMDSYFHSSELTAISEEDDGIAELASS

SEQ ID NO: 83936 - protein, 307 aa, Coprinopsis cinerea okayama7#130
MALSLLVLPFSWTLLLLLALVSPRAGVLAVPLVHRQADLVALSNAEIQAFRPFTFYASTAYCKPDAVLSWSCGANCNANPTFKPIAAGGDGADVQFWYVGIDPTLQTIVVGHQGTDPTKIEALLTDADFFLDELESENFPGLDRSIKVHNGFAEAHAETAADVRAALQRAIDESGLTSVSLVGHSLGGALSLLDGVSLPLFFPDLTFRTIVYGMPRVGNKAFAEYVNRNVDLDRINNQDDFVPIIPGRFLGFQHAHGEKHIQDDLSWLVCPGNDSTDKRCATGDVRNIFDGSLSDHKGPYDTVLMGC

SEQ ID NO: 83937 - protein, 179 aa, Zea mays
  misc_feature (47)..(47): Xaa can be any naturally occurring amino acid
  misc_feature (71)..(71): Xaa can be any naturally occurring amino acid
  misc_feature (90)..(90): Xaa can be any naturally occurring amino acid
  misc_feature (111)..(111): Xaa can be any naturally occurring amino acid
CCLESLLKFAEAGSLFCFVELVSGFRDNFCQKLDNSAVGVRATLADXAKLSQLVAKHDGGLQQHLEITTEXWIPLPLTEEFNFADTIHIXWDTVLSDRDSLQDTLLRICCXLVRKRLLAGDFTSILELLQNYLPANISHHLYSAHKLQCTDLFLRPKRCCVCSAGLWLSPSSIAKGIQN

SEQ ID NO: 83938 - protein, 715 aa, Mycobacterium sp. JLS
MAENTIKWEQDSDGIVTLTLDDPTGSANVMNDHYKESMHNAVERLVAEKDSITGVVITSAKKTFFAGGDLKSMINTGPDDAAAVFENVESIKADLRKLETLGKPVVAAINGAALGGGLEIALACHHRIAADVKGSVIGLPEVTLGLLPGGGGVTRTVRMFGIQKAFMEVLSQGTRFKPGKAKDTGLVDELVGSVEELVPAAKAWIKANPEAHTQPWDVKGYKMPGGTPSSPGLASILPSFPALLKKQLKGAPMPAPRAILDAAVEGAQVDFDSASRIESRYFVSLVTGQVAKNMIQAFFLDLQTINGGGSRPDGIAKQDIKKIGVLGAGMMGAGIAYVSAKAGYDVVLKDVSLENAQKGKAYSEKIEAKALERGRTTKEKSDALLARITPAADPADLKGVDFVIEAVFENQELKHKVFQEIEDIVEPNALLGSNTSTLPITGLATGVKRQEDFIGIHFFSPVDKMPLVEIIKGEKTSDEALARVFDYTLAIGKTPIVVNDSRGFFTSRVIGTFVNEALAMLGEGVEPASIERAGSMAGYPAPPLQLSDELNLELMQKIATETRKATEAAGGTHDPHPAEAVVNKMIEIGRPSRLKGAGFYEYVDGKRTGLWPGLRETFGVGSADIPLQDMIDRMLFAEAIETQKCLDEGVLTSTADANIGSIMGIGYPPYTGGSAQYIVGYEGALGTGKEAFVARARELAERYGDRFTPPDSLTK

SEQ ID NO: 83939 - protein, 743 aa, Saccharomyces cerevisiae
MTKLFSKVKESIEGIKMPSTLTINGKAPIVAYAELIAARIVNALAPNSIAIKLVDDKKAPAAKLDDATEDVFNKITSKFAAIFDNGDKEQVAKWVNLAQKELVIKNFAKLSQSLETLDSQLNLRTFILGGLKYSAADVACWGALRSNGMCGSIIKNKVDVNVSRWYTLLEMDPIFGEAHDFLSKSLLELKKSANVGKKKETHKANFEIDLPDAKMGEVVTRFPPDPSGYLHIGHAKAALLNQYFAQAYKGKLIIRFDDTNPSKEKEEFQDSILEDLDLLGIKGDRITYSSDYFQEMYDYCVQMIKDGKAYCDDTPTEKMREERMDGVASARRDRSVEENLRIFTEEMKNGTEEGLKNCVRAKIDYKALNKTLRDPVIYRCNLTPHHRTGSTWKIYPTYDFCVPIVDAIEGVTHALRTIEYRDRNAQYDWMLQALRLRKVHIWDFARINFVRTLLSKRKLQWMVDKDLVGNWDDPRFPTVRGVRRRGMTAEGLRNFVLSQGPSRNVINLEWNLIWAFNKKVIDPIASRHTAIVNPVKIHLEGSEAPQEPKIEMKPKHKKNPAMGEKKVIYYKDIVVDKDDADVINVDEEVTLMDWGNVIITKKNDDGSMVAKLNLEGDFKKTKHKLTWLADTKDVVPVDLVDFDHLITKDRLEEDESFEDFLTPQTEFHTDAIADLNVKDMKIGDIIQFERKGYYRLDALPKDGKPYVFFTIPDVNLSTSMVQRNKHHISNVYTYLCYFSTSTF

SEQ ID NO: 83940 - protein, 410 aa, Salinibacter ruber DSM 13855
MLDLRPKTCSMAAPATAPDLDTYVSDRVRETPPSGIRRFFDIAATMDNVISLGIGEPDFNSPDAALEAGVDALENGRTSYTSNAGMEELRELIAEDYEERHGLSYDPESEIVATVGCSEAMQLAMQAFLEPGDEVLIPEPCFVSYGPSARFAGGEVVHVPTHVENDFQVTAADIEPHLSDRSKVLFLGYPNNPTGAVLRRDTLQEIAQLVVDNDLLVVSDEIYDQLIYGTAHDRGHVCVPTVEGLRERTVLLGGFSKNYAMTGWRIGFACAPKPLSQAMLKVHQYMIMSAPTMAQEGAIAALREARGDVEKMRQSYDERRRTIVSGLNDAGLPTFEPEGAFYCFPDVTSTGMTSEEFAQRLLEEEKVACVPGTAFGPSGEGYVRCSYATGLDDITEALTRIDRFVSRHQS

SEQ ID NO: 83941 - protein, 392 aa, Schizosaccharomyces pombe
MIGNGFSIIATHTDSPTLRLKPKSQKSAYGYLQVGVEKYGGGIWHTWFDRDLSLAGRVMVEEEDGRVIQYNVHIDRPLLRIPTLAIHLDPSANSSFSFNMETEFVPLIGLENELAKEETSDNGDKYHHPVLLSLLANEISKSLETTIDPSKIVDFELILGDAEKARLGGIHEEFVFSPRLDNLGMTSGASQALTKSLENNSLDNESCVRVVPSFDHEEIGSVSTQGAESTFLPAVLQRICELGKESSLFSISMVKSFLVSADMAHAMHPNYSSRYENSNTPFLNKGTVIKVNANQRYTTNSAGIVLLKKVAQLADVPIQSFVVRNDSPCGSTIGPKLAAMTGMRTLDLGNPMLSMHSCREMCGSKDFEYAVVLFSSFFQNFANLEEKIIIDE

SEQ ID NO: 83942 - protein, 378 aa, Zea mays
MDHVTSIKAHGRLVLIMSGLVEVGSLCGITDKGDEMVCTRQRSYFLAKEKEPSSVKKRARAAAGKLSDLNLVDEQVLRASLAQIPPKHKEEVESLTRSYKDQYRNWLFELRCGFGLLMYGFGSKKQLLEDFASTTLTNFTVVVINGYLPAVNLKQVDRAFAHGRQTTIAEMFWDQTKAKRRKRAGTRSQLSQQFPSQSTEGIISFLMRQTSDDVDDHSLTPNAQSVFRVLAEYQLANEKEEGELVVHIFAGRVGMLHTDTKLTLFLSEVPMRERSTYPKAEAESGRKASGTKRLSVHAPLREGVTLSAVDARTSGAARRTPAPGGQARVVTSDTAQVSASAARRVGGTTASWVAQGIEKLPAADVDAVPASPPRPTPT

SEQ ID NO: 83943 - protein, 268 aa, Pseudomonas putida GB-1
MRRCREPVMTVNIKTAEDIEKMRIAGRLAADVLEMIEEHVKPGVTTEELDRLCHDYIVNVQQAIPAPLNYKGYPKSICTSINHVVCHGIPNDKPLKDGDTLNIDVTVIKDGYHGDTSRMFHVGNVPVWAERLSKVTQECMYKAIELVKPGCRLGDIGEVIQKHAEKNGFSVVREFCGHGIGKVFHEEPQILHYGRAGTGMELKEGMTFTIEPMINQGKADTKVLGDGWTAITKDRKLSAQWEHTLVVTATGYEIFTLRKDDTIPRTSA

SEQ ID NO: 83944 - protein, 566 aa, Coprinopsis cinerea okayama7#130
MANTALTDSTTTNEPQWGRILICGGTDWPKLGRKDRNKSTEGENDAIFNPDLLEPNILRSLLNVKIVSIHTSCAGCHFVALDIHGTAWLFGRNGFSCLGIADVDYVSENAPVPLKPTDLGAPQGTKFVHAACGRNHTLLVGSDGSVWAAGANNVGQCGQPPSPDVPAFKPVSVVHGGNREKVVQASAGISFSLVLTDTGKVFSFGSAEKGQLGNGVTGERILTGNKTGFDIEWQPVFVKELKDKKVVKISSGQQHSLAIDDAGTVYGWGFNGYCRLGLGNQVDALKPKVIPQFAGPEEATMGADIAAGPTSSIVIDKQGMFWMAGKWKNSGEGSSGSPYSTFRFMQDIMGCKILLARSGGVTHWLTTPDEDGSPMTVCWGQNAANGELGLGLDEPKSSTKPTKNMPLSGIHVIDIAAGQNTTLLLAKPNDKFSDLPRHPEDVQPPQVCGGCKKDDGDPLECDKCDAPWHLHCLNPPLPEVPPGEWFCPECLKEEGTPIGNPWRHQKRPKPTILPAGAQRAPAKRPAPPPEEYDDDDDDEDEESDDGDRKKRKASGGRGGAAKKKRQ

SEQ ID NO: 83945 - protein, 164 aa, Oryza sativa Indica Group
MAQGDKKDQEPTELRAPEITLCANSCGFPGNPATQNLCQNCFLAATASTSSPSSLSSPVLDKQPPRPAAPLVEPQAPLPPPVEEMASALATAPAPVAKTSAVNRCSRCRKRVGLTGFRCRCGHLFCGEHRYSDRHGCSYDYKSAARDAIARDNPVVRAAKIVRF

SEQ ID NO: 83946 - protein, 484 aa, Dechloromonas aromatica RCB
MKQILNFINGEFVATGKQFEKRTPLDNSLIGMVHEAGKAEVDAAVKAAHDALEGPWGKMTVVERTDILNKVADEITRRFDEFLEAECADTGKPKSLASHIDIPRGAANFKIFADVIKNAPTEFFEMATPDGKGALNYAIRRPVGVVGVVCPWNLPLLLMTWKVGPALACGNTVVVKPSEETPSTATLLGEVMNACGVPKGVYNVVHGFGPNSAGEFLTTNQNVNAITFTGETRTGAAIMKAAADGARPVSLEMGGKNPAIVFADANLDVAIEATLRSCFSNCGQVCLGTERVYVERPFFETFVAALKAGAEKLKLGVPSDPSANMGPLVSQEHRNKVLSYYKKAVEEGATVVTGGGIPDMPGELANGAWVQPTIWTGLDDNAAVVREEIFGPCTTVMPFDSEDEVIKRANNTTYGLAASVFTQDVNRAHRVAGRIEAGLVWVNSWFLRDLRTPFGGAKQSGIGREGGVHSLEFYTELKNVCIKL

SEQ ID NO: 83947 - protein, 389 aa, Mycobacterium sp. JLS
MTVSRLRPYAVTVFAEMSALAARIGAVNLGQGFPDEDGPASMLEVARQAIADGVNQYPPGLGIAPLREAIAAQRKRVHGVDYDPDTEVLVTNGATEAIAAAVLGLVEPGSEVLLVEPFYDSYSPVLAMAGCHRVAVPMVEHGRGFAIDVDGLRGAITPRTSALIVNSPHNPTGMVASDEELTAITELAVEHDLLVITDEVYEHLVFDGYEHRPLAAYPGMSGRTVTISSAAKMFNVTGWKIGWACGAADLIAGVRAAKQYLTYVGGAPFQPAVAHALDHEDAWVAALRDSFQNKRDRLGSALAELGFAVHDSAGTYFLCADPRPLGYDDSTTFCADLPERAGVAAIPMSAFCDPHSPHTDRWNHLVRFAFCKRDDTLDEAIRRLQVLRR

SEQ ID NO: 83948 - protein, 120 aa, Triticum aestivum
  misc_feature (69)..(69): Xaa can be any naturally occurring amino acid
  misc_feature (77)..(77): Xaa can be any naturally occurring amino acid
  misc_feature (108)..(108): Xaa can be any naturally occurring amino acid
MAPAGMASSATTVAPLQGLKSTAGLPDSRRSGSAGLSSASNGGRIKCMQVRPNEGIKKFETLRYLPPLXSEALLRTXDYLIRSKRVPCLEFTKVGCAFREHNNSPEYXPGRYWTRVTCLC

SEQ ID NO: 83949 - protein, 399 aa, Pseudomonas putida GB-1
MNHALTQLQPYPFEKLRALLGSVKPAADKRAIALSIGEPKHESPAFVAQAMADNLDKLAVYPSTLGLPALRQAIGQWCERRFGVPAGWLDADRHILPVNGTREALFAFTQAVVNRADDGLVISPNPFYQIYEGAALLAGATPHYLPCLESNGFNPDFDAVPAEVWKRCQVLFLCSPGNPTGALVPMDTLKKLIALADEHDFVIAADECYSELYFDEDAPPPGLLTACAELGRSDFKRCVVFHSLSKRSNLPGLRSGFVAGDAEIIKPFLLYRTYHGCAMPVQTQLASVAAWQDEAHVRANRDQYRAKYDAVLDILQPVLDVQRPDGSFYLWAKVPGNDDAAFTRDLFEAEHVTVVPGSYLSREVDGVNPGSGRVRMALVAPLAECIEAAERIRAFLQKR

SEQ ID NO: 83950 - protein, 475 aa, Rhizobium sp. NGR234
MKHARKFYIDGEWVEPSVSKTLEVIDPSTEQPMGTIALGSAADAEKAVAAARRAFASYSQTSKQERVELLRRILTILKRRNDELGDIISREMGAPLAMARAEQAGIGAAHFEQAIKSFETFAFDYMQGTTRIVHEPVGVVAMITPWNWPINQIACKVAAALATGCTMVLKPSEIAPFNAVLFAEIMDEAGVPKGVFNLVQGDGPTVGAALASHPDVDMVSFTGSTRAGIAVAQAAAPTVKRVHQELGGKSPNIILRSADFPAAVAAGVRRCFGNSGQTCTAPTRMLVPAERMDEAGAIAARQADALVVGPPSDSRTDLGPVASAAQFDKIQALIERGIAEGAELVAGGLGRPSHLNAGYYVRPTVFARVTNQMSIAREEIFGPVLSIIGYDSEDEAIAVANDTPYGLAAYIQGDPKETRALAGKLRSGTVRLNSSGWDSAAPFGGYKQSGNGREYGKFGLHEFTEIKGIVGFLNE

SEQ ID NO: 83951 - protein, 314 aa, Sinorhizobium meliloti 1021
MSSARKIIIDTDPGQDDAAAIMLALGSPEEIEVLGITAVAGNVPLTLTARNARIVCELCNRTDVKIFAGAERPVARPLVTAEHVHGKTGLDGPALDEPTMPLQEQHAVDFIVETLRAEAPGAVTLCTLGPLTNIALALTKAPEIAPSVRELVMMGGGFFEGGNITPAAEFNIYVDPEAAEIVFRSGIPIVMMPLDVTHRVLTRKTRVEKIRAIGSPAAVALAEMLEFFERFDIEKYGTDGGPLHDPTVIAYILRPELFTGRDCNVEIETASPLTTGMTVVDWWQVTGRAHNAKVMRHIDDEGFFELLAERLARI

SEQ ID NO: 83952 - protein, 331 aa, Thellungiella halophila
MGGKGAMMVAILCLWALSATSEAVVTEEEPGLMMNFYKDTCPQAEDIIREQVKLLYKRHKNTAFSWLRNIFHDCAVESCDASLLLDSTRRELGEKEHDRSFGLRNFRYIEEIKEALERECPGVVSCSDILVLSAREGIEAVGGPHIPLKTGRRDGRKSRTDMLESYLPDHNESISVVLEKFKSIGIDTPGLVALLGSHSVGRTHCVKLVHRLYPEVDPSLNPDHVPHMLHKCPDSIPDPKAVQYVRNDRGTPMVLDNNYYRNILDNKGLLLVDHQLAHDKRTRPIVKKMAKDQAYFFKEFTRAIQILSENNPLTGSKGEIRKQCNLANKIH

SEQ ID NO: 83953 - protein, 377 aa, Zymomonas mobilis
MTAIVSIHGRQVVDSRGNPTVEVDVTLEDGSFGRAAVPSGASTGVHEAVELRDGDKTRWGGKGVTKAVHAVNNEIANAIIGLEAEDQELIDQTMIKLDGTPNKGKFGANAILGVSLAVAKAAAEARGLPLYRYVGGTAAHVLPVPMMNIVNGGMHADNPIDFQEFMIAPVGASSINEAVRIGTEVSHTLKKELSAKGMNTNVGDEGGFAPSLDSASSALDFIVDSISKAGYKPGEDVFIALDAASSEFYNKDQNIYDLKGEGRKLTSAQLVDYYVELCGKYPIYSIEDLAEDDFEFWKILTEKLGDKVQLVGDDLFVTNVKRLSDGIERGIANSLLVKFNQIGSLSETLAAVNMANDASYTPVMSHRSGGNRRHHDC

SEQ ID NO: 83954 - protein, 387 aa, Trichodesmium erythraeum IMS101
MNFATRMNSLGGDAAIEVFTKAKQLESQGRNIIHLEIGQPDFKTPKNIREAAFQAMNDGYTTYTPAAGLLKLREVIAEHISQTRNISVNSDEVVVMPGAKPVIFFTLLALINSGDEVIYPNPGFPVYESVINLVGGKPIPLPLLEELDFQFSIDNLVNSISEKTKLLIINSPHNPTGSVLTPEYLEAIAKLAVKHNFYVLSDEIYSHLNYDSKFTSIISFPSMKERTILLDGHSKTYAMTGWRLGYSISPKAIAEKLDKLMLNSNSCACSFTQIAGIEAIKNSQEFVKKIFAEFKQRRDVIVDGLNSISGINCRKPAGAFYAFPNVKQLPISSNKLADYLLAEAGVALLPGTAYGKFGDGYLRLSYANSIENIREGISRIETAIAKL

SEQ ID NO: 83955 - protein, 363 aa, Wolbachia endosymbiont of Drosophila simulans
MQDAVLILQDGKCFWGKSIGKKGKCIGEVCFTTGMTGYQHTITDPSFADQIITFTFPHIGNVGINHKDNEGKKIFASGVVMRELSSMSHPSSYISLNDWLEKNNVIGISGVDTRALTRHLREHGSQNGMICSSSKAHALDKLKEYKSVNGIEITNKVSLHSNFKSDLNAKYRVVIVDFGVKISIVSRLIELGCTVELIRPSTGFAQKVLSMNPDGIVLSNGPGDPQEIGESVVSEIDIIIKSKIPIFGICMGHQLLAITLGAKTIKMDIGHRGSNHPVYDVSSGKVGITSQNHGFVVDSASLPSNVEITHISLFDNSVEGIMMKDYSVFSVQYHPEEAPGTHDSHYLFRRFIDNIVLYKMKSA

SEQ ID NO: 83956 - protein, 502 aa, Mycobacterium avium 104
MSTSRSERLREVLRYDLPASLVVFLVALPLSLGIAIASDAPVLAGLIAAIVGGIVGGWLGGSPLQVSGPAAGLTVVVADVVAEFGWGVTCFITVVAGVLQVLLGFSRIARAALAISPVVVHAMLAGIGITIALQQVHVLLGGSSKSSAWSNVTGLPAQILGAHRPGLVLGLLVIAILVAWRWVPARLAIVPGPLVAIVVVTIISMVLPFKVSRIELDGSVLDAVRLPSLPHGNWGAVAIAVITVTLITSVQSLLTAVSIDRMHTGPRTDFNRELIGQGAANIASGALGGLPIAGVIVRSSANVNAGAKTRASTIMHGFWVLVFAVPFAGLVEKIPTAALAGLLIVIGIELLKPAHIETALRNGDLAIYLVTVTSVIFLNLLHGVLIGLLLAVVVTGWRVVRARIEAEPVGDGWHVVIEGACTFLALPRLTGVLASIPERTSVTVHLLTNYLDHAAHQAIGDWQRRHCATGGTVEVRDTTEPAARRRNSHLSLVEQVSSPGGA

SEQ ID NO: 83957 - protein, 466 aa, Silicibacter sp. TM1040
MHGTFTDNDLSHVIEADKAHVWHHLVQHKPFETSDPRIIVEGKGMRVWDQNGKEWLDAVSGAVWTVNVGYGRESICKAVYDQMMKMCYFAQAAGSVPGALYAEKLIEKMPGMSRVYYCNSGSEANEKAFKMVRQIAHKKYGGKKTKILYRDRDYHGSTLAAMSAGGQDERNAQYGPFAPDFVRVPHCMEYRKHELGLEHLSGEEFGIAAANLIEEVILREGPETVGALCLEPVTAGGGVIEAPEGYWPRVQEICKTYDVLLHIDEVVCGIGRTGTHWFGYQHYGIKPDFVTMAKGVASGYAAIACMVTTEEVFELFKDDTSDKLNYFRDISTFGGCTAGPAAALENMRIIEDEGLLENCTKMGERMISNLRVLQEKHAVIGDVRGKGLFLGAELVTDRDTKEPVEEALAQKVVAECGNHGVIIGVTNRSVPGRNNTLCFSPALIATADDIDKITDAVDKALTTVFG

SEQ ID NO: 83958 - protein, 259 aa, Wolbachia endosymbiont of Drosophila simulans
MINEKIVRENLKKVIEQKSGKDVIALGIISSIIIKGQDVGFVLEVAGNTQANEELRRNCEQAVKAIPGVTKVTVVATCQKQTGQQKAKLHIEGVKNIIVVASGKGGVGKSTVALNLALSLAKLKHKVALVDADIYGPSIPKMLGAEKLKPEIQDSKAMPIEKYGLHTISIGYFIDKDRAAIWRGPMITKALYSLLMGTKWSDIEYLIIDTPPGTGDVHLSLMENFNLTGAIIVSTPQELSLIDARKIYDMFTKLSVPVI

SEQ ID NO: 83959 - protein, 55 aa, Zea mays
LLHGPLQHLRCDGSDSRTLDETLENMHALNRMFSLDMEKAIIEQKIKAKVEKTQN

SEQ ID NO: 83960 - protein, 126 aa, Oryza sativa Japonica Group
MASNKIAPLLALTLLILFFGCAVTNCTGKPVAPTPPSHDDHGRCPIDALKLRVCANLLNGLIGVKIGRGPDDCCPLLAGIADLDAAVCLCTALKANVLGLINLNLPVDLSIILNKCGKNYPSGFTC

SEQ ID NO: 83961 - protein, 442 aa, Silicibacter sp. TM1040
MSHVFPRHTKSDLPTAVGGDGCYLIDANGKRYFDGSGGAAVSCLGHSDAAVIKAVQEQVEKLAFAHTGFMTSEPAEALADLLISKAPGTLDRVYFVSGGSEATEAAIKLARQYHLERGEPQRRHLIARRQSYHGNTLGALAAGGNAWRRQQFDPLLIGVSHIAPCYEYVDRSDGESSFDYGQRVANELEAEILRLGPDTVMAFMAEPVVGATLGAVPAVEGYFKRIREICDTYGVLLILDEVMCGMGRTGHLFACDADGVAPDILCIAKGLGAGYQPIGAMLCSSAIYDAIAQGTGFFQHGHTYLGHPVATAAGLAVVNQMLERDLVSRVAEKGTQLQAALMERFAQHPNVGDIRGRGLFRGLELVQDRDSKAPFDPAHGLAARIKRAALEAGLICYPMSGTRDGRMGDHILLAPPFILSETQIEEICDKLAIAIEEGLASI

SEQ ID NO: 83962 - protein, 608 aa, Silicibacter sp. TM1040
MSEHSPEISDAVQSGQYQVLARKYRPETFADLVGQDAMVRTLKNAFAADRIAQAFIMTGIRGTGKTTTARIIAKGMNCIGEDGQGGPTTEPCGKCEHCTAIMEGRHVDVMEMDAASRTGVGDIREIIDSVAYRAASARYKIYIIDEVHMLSTSAFNALLKTLEEPPAHVKFIFATTEIRKVPVTVLSRCQRFDLRRIEPEVMIDLLRRIATSEQAEIADDALALITRAAEGSARDATSLLDQAISHGAGETTADQVRAMLGLADRGRVLDLMDMILRGDAAAALTELSAQYAEGADPMAVLRDLAEITHWVSVVKITPDAAEDPTISPDERARGQDMAARLPMRVLTRMWQMLLKALEEVAAAPNAMMAAEMAVIRLTHVADLPSPEELLRKLQDTPPPPHPGGPGGGHPMQGMGSPAAGGGGGAPAYASAPPQGAPGGDPRGGHTMSTSGGQSAVLAQRADSALARYPSFEHVIELIRHHRDVKLLVEVETGVRLVSYQPGRIEFTPAANAPQDLAARIGTALQNWTGSRWVVSIAPDGDAPTIAELRDAAQNALRAEASAHPLVQAVLQNFPKAKITKIRTQEELAAEVQAEALPEVEDEWDPFEE

SEQ ID NO: 83963 - protein, 876 aa, Arabidopsis thaliana
MKTMNGFLLLSTIAFAVFHLVQAQSQSGFISLDCGLIPKDTTYTEQITNITYISDADYIDSGLTERISDSYKSQLQQQTWTLRSFPEGQRNCYNFNLKANLKYLIRGTFVYGNYDGLNQMPKFDLHIGPNKWTSVILEGVANATIFEIIHVLTQDRLQVCLVKTGQTTPFISSLELRPLNNDTYVTQGGSLMSFARIYFPKTAYFLRYSDDLYDRVWVPFSQNETVSLSTNLPVDTSSNSYNVPQNVANSAIIPAEATHPLNIWWDLQNINAPSYVYMHFAEIQNLKANDIREFNITYNGGQVWESSIRPHNLSITTISSPTALNSSDGFFNFTFTMTTTSTLPPLINALEVYTLVENLLLETYQDEVSAMMNIKKTYGLSKKISWQGDPCSPQIYRWEGLNCLYLDSDQPLITSLNLRTSGLTGIITHDISNLIQLRELDLSDNDLSGEIPDFLADMKMLTLVNLKGNPKLNLTVPDSIKHRINNKSLKLIIDENQSSEKHGIKFPLVAILASVAGVIALLAIFTICVIFKREKQGSGEAPTRVNTEIRSSYQSIETKDRKFTYSEILKMTNNFERVLGKGGYGRVYYGKLDDTEVAVKMLFHSSAEQDYKHFKAEVELLLRVHHRHLVGLVGYCDDGDNFALIYEYMANGDLKENMSGNRSGHVLSWENRMQIAMEAAQGLEYLHNGSRPPMVHRDVKTTNILLNELYQAKLADFGLSRSSPVDGESYVSTIVAGTPGYLDPETNLLSEKTDVYSFGVVLLEIITNQPVIDTTREKAHITDWVGFKLMEGDIRNIIDPKLIKEFDTNGVWKAVELALSCVNPTSNHRPTMPHVVMELKECLDSEIARKQGSQDMFSRDSIELTFSPTGFSPGPR

SEQ ID NO: 83964 - protein, 275 aa, Alkalilimnicola ehrlichei MLHE-1
MSNNTLCFIGGGNMARSLIGGLLADGFDPQAVRVADPDAGKRDDLANRFGVRVYADNLEAAADADTVILAVKPQVVRTACEQLVAGSGDAGRLFISIAAGVREPDLTRWLGGQAAVVRTMPNTPSLVGTGATALYANDRVKERQRELAESLMRAVGLVVWLDDEAQMDTVTAVSGSGPAYFFLLMEAIEDAARDLGLPGETARLLTIETALGAAKMALESDESPAQLRQRVTSPGGTTEHALHVLEDGEYRALMTRAVQAAAKRAQELGQMLGEQ

SEQ ID NO: 83965 - protein, 237 aa, Alkalilimnicola ehrlichei MLHE-1
MDIAQRLQVVHERLRAAEHRFGRDPGSVKLLAVSKTQPVSAIRAALAAGQHAFGENYLQEALDKQQALADTPAEWHFIGALQSNKTRDVAGHFDWCHTVDRLKIARRLSQQRPEERPPLNVCIQVNISGEASKAGVLPAGAAELAAQVAELPRLRLRGLMALPAPAEGLAAQRRPLAALRELQEHLVSSGLALDTLSMGMSGDLEAAVAEGATLVRIGTAIFGPRQTTPANGKENKR

SEQ ID NO: 83966 - protein, 362 aa, Zea mays
MESDASTSPRRRSTSCYSDSGDSSCSEPFSECGSDDLSFTPAAAAGIHRLLLSCAAEASEDAISSLVAELECPSQSLDSLRRAAMELRLLAKHNPDNRVRIAAAGGVRPLVRLLSHADPLLQEHGVTALLNLSICDENKATIVEAGAIRPLVHALKSAASPAARENAACALLRLSQLDGASAAAIGRAGAIPLLVSLLETGGARGKKDAATALYALCSGARENRQRAVETGAVRPLLDLMADPESGMVDKAAYVLHSLVSSGEGRAAAVEEGGIPVLVEMVEVGTSRQKEIATLSLLQICEDNAVYRTMVAREGAIPPLVALSQSSSARPKLKTKAESLIEMLRQPRSPSLRTRPAAVVAAE

SEQ ID NO: 83967 - protein, 401 aa, Pseudomonas putida GB-1
MFQPSPWRADFPAIAALQRQHQTYLDSAATSQKPQALLDALSHYYGHGAANVHRAQHLPGALATQAFETSRDKVAAWLNAADSRQVVFTHGATSALNLLAYGLEHRLEAGDEIAVSALEHHANLLPWQQLAHRRNLRLVVLPLDAHGCIDLNQALQLIGPRTRVLAVSQLSNVLGTWQPLPALLAHARAQGALTVVDGAQGVVHGRHDVQQLGCDFYVFSSHKLYGPDGVGVLYGHSQALGLLRHWQFGGEMVQLAEYHSASFRPAPLGFEAGTPPIAGVIGLGATLGYLASLDAQAVAAHETSLHQHLLRGLADREGVRILGTPQAALASFVIEGVHNADIAHLLTEQGIAVRAGHHCAMPLLKGLGLEGAIRVSLGLYNDSDDLQRFFTALDQGLELLR

SEQ ID NO: 83968 - protein, 269 aa, Pseudomonas putida GB-1
MSTEDPRFAGVARLYGDQGLQRLGQAHVAVVGIGGVGSWVAEALARSGVGEITLFDLDDVCVSNTNRQAHALEGQVGRPKVEVMAERLRAINPACKVHAVADFVTRETMVEYIHEQLDCVIDCIDSVMAKAALIAWCRRRKIAIVTTGGAGGQIDPTQIQIADLNKTFNDPLASRVRSTLRRDYNFSRNVSRNYGVPCVFSSEQLRYPKGDGSVCLQKSFVGEGVRLDCAGGFGAVMMVTATFGMVAASKAIEKLVAGARRPSERIKPE

SEQ ID NO: 83969 - protein, 257 aa, Arabidopsis thaliana
MRATQTHVITFCMLVIIVTSSTRAQKSPHVPNNHELSIAIEEMEKANYFSFVMLINMLPSVNPRFLANVTFLMPKDKTLSTSNIINQQDSVTEFLLRHSIPSSLLFEHLNLIPNGSIVPSSLPHYTLEISNGGRSNYFLNNVKIISRNICSLGSIKCHGIDGILQSPSTVDDDSPRNNHTLPFISCPSSHNNSDQNSHNNSDQNSSRPADHTLTAPPPVSSPISQPKSDSPSIHDVKMLTSIVIPLFGLLASLIGMG

SEQ ID NO: 83970 - protein, 327 aa, Pseudomonas fluorescens PfO-1
MTGQNIMKAVVIQAFGGPEVLTVHDIQLAEPGPGQVVVKVMAAGINFMDTGARRGLGAAWELPLTLGAEGAGVVLASGPQVTEFAVGARVAWHYVPGSYAEQVIAPVSQLVPLPDDIDFSTAASLMMQGLTASNLVDKVHAIQPGDVAFVHAAAGGVGLMLTQMIKLRGGKVIGRVSHADKVEAVLAAGADYVVIGRAQNIAGQVMRLTEGQRVNVVYDGTGAEGFADSLEMLDYFGTLALYGPFMNPTPPIDIFSMPRSIKLTYPSVMHYVRDREVLLEKSRQLFAWVSTGKLKTFIGKRYSLDEAQQAHIDIESRNTTGKLIIVP

SEQ ID NO: 83971 - protein, 487 aa, Drosera adelae
GPEVSTREKKKLGRISQIIGPVLDVTFPSGKMPYIYNALIVKGRDTLGQPINVTCEVQQLLGNNRVRTVAMSATNGLMRGMEVVDTGAALSVPVGSVTLGRIFNVLGQPIDNLGPVATPTTSPIHRSPPDFIQLETRLSIFETGIKVVDLLAPYRRGGKTGLFGGAGVGKTVLIMELINNIAKAHGGVSVFAGVGERTREGNDLYKEMKESGVINEQNLSESKVALVYGQMNEPPGARMRVGLTALTMAEYFRDINKQDVLLFIDNIFRFVQAGSEVSALLGRIPSAVGYQPTLSTEMGSLQERITSTKEGSITSIQAVYVPADDLTDPAPATTFAHLDATTVLSRGLAAKGIYPAVDPLDSTSTMLQPKIVGDEHYETAQQVKQTLQRYKEVQDIIAILGLDELSEEDRLTVARARKMERFLSQPFVVAEVFTGSIGKYVSLVETIRGFELILSGELDGLPEQAFYLVGNIDEATEKAMNLEMENK

SEQ ID NO: 83972 - protein, 639 aa, Coprinopsis cinerea okayama7#130
MPVVSPPTPAPSPGPIMTPSYPYETGFPPITGSQLARRQFLANVLASCTPEELLFVSATIAPRLKRDFLLSLPTELSLYILSFIDDPRTLARAAQVSRYWRSLVQEESVWKGLCESYGYEMGDDSESQNHGGVGKGKEKDDGSLSYRRCFKSSYITMSNWRKGGHLLRSHRIPVLTPESGVVTSLALDGDWVILGLANAKIHVYSATTGVLAKTLVGHESGVWGVCLVSKGGWRVPDPIQDPPPAADRSTPSGRRSLRHKLARLSLDNAPLSGMGDYLPASLRIAVGLDVIGDEDPEEEAEPEPRPQAKRKFSDMCYSSVGWGQPSSIIVSGGCDKALMVWDALSGQRIYRLSGHTSTIRCIRVLQNRPIAVSGSRDATLRVWDIQRGRCLRVLEGHQQSVRCLDACGNKVVSGSYDTTCRIWDVDTGECLHVLSGHFHQIYSVAFDGRYVASGGLDTTVRLWDANTGECIALLQGHTALVCQLQLSPNLLITGGSDGRVISFSLDTLTISHRIAAHDCSVTSLQFVDAGGDKERFLVTGGNDGRVRLYDVDSGNFVRELSGGETVWRVVVGWGVCVVVCKRGGKTVVEIWSMRPGNEVDGEGEGGEDGLPSELRRGVLERRRSRVLASGWKASSSGSA

SEQ ID NO: 83973 - protein, 487 aa, Shigella flexneri 2a str. 301
MKPSTEWWRYLAPLAVIAIIALLPVPAGLENHTWLYFAVFTGVIVGLILEPVPGAVVAMVGISIIAILSPWLLFSPEQLAQPGFKFTAKSLSWAVSGFSNSVIWLIFAAFMFGTGYEKTGLGRRIALILVKKMGHRTLFLGYAVMFSELILAPVTPSNSARGAGIIYPIIRNLPPLYQSQPNDSSSRSIGSYIMWMGIVADCVTSAIFLTAMAPNLLLIGLMKSASHATLSWGDWFLGMLPLSILLVLLVPWLAYVLYPPVLKSGDQVPRWAETELQAMGPLCSREKRMLGLMVGALVLWIFGGDYIDAAMVGYSVVALMLLLRIISWDDIVSNKAAWNVFFWLASLITLATGLNNTGFISWFGKLLAGSLSGYSPTMVMVTLIVVFYLLRYFFASATAYTCALAPMMIAAALAMPEIPLPVFCLMVGAAIGLGSILTPYATGPSPIYYGSGYLPTADYWRLGAIFGLIFLVLLVITGLLWMPVVLL

SEQ ID NO: 83974 - protein, 193 aa, Triticum aestivum
RSRNSSVASILLSADNTIPWPPAVMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 83975 - protein, 299 aa, Sinorhizobium meliloti 1021
MITVFGSINMDLIATTARLPKPGETVAGTDFSTAAGGKGANQALAARRAGASVRMAGAVGSDAFAEGALALLKEAGTDLDLTKTVGEPTGTAHIIVGGDGENVIVVVASANARVSGDDAANVVAQMSAGDTLMLQLEIPSASVEKALSEAKRRGIRSIINIAPLTPDAARLGRMADIVIANETEFELLAGKAGIAGAEREEAMNGLHAETRQTVIVTLGAEGVVAIHEGELHRAKGLTIEPVDTVGAGDTFCGYLAAGLDAGLAFSEALRRAAIAGSLACLKPGAQPSIPLAAEVAARL

SEQ ID NO: 83976 - protein, 448 aa, Acidobacteria bacterium Ellin345
MKSQLGTLATELKRKIEAREARIGIVGMGYVGLPLALLFSEEKFRVTGFDIDNRKVEALNAGGSYIVRIPGTEIQGAQKSGFSATADYGKISEMDAVIICVPTPLNEFHEPDLSYITQTVDAIAPRLREGQIVILESTTYPGTTEEVVVPLLEKGNAKGLKVARAEDEGDFFVAFSPEREDPGNDTVARRDIPKVVGGVGKLASEIAAAVYGTIFNRTVPVSSPAAAEMTKLLENIYRCVNIALVNELKQLCHRMDIDIFEVIDAAKTKPFGFQAFYPGPGLGGHCIPIDPFYLSWKAKQFDFRTKFIELAGEVNIAMPYYVIDKTVEALNQHKKSLNGSKVLVLGLAYKKDIDDLRESPSLTIIELLRKGGAEVFYNDPFFAKVGHGRHYDLNMTNTPLENLGQYDAVLIVTDHSDYDYQRIVKESKLVVDSRNATKGITSEKIVRC

SEQ ID NO: 83977 - protein, 358 aa, Rhizobium sp. NGR234
MMREYSIATIPADGIGPEVIAAGRTVLATLEKRLGDVKFTVENFDWGSDYYRKHGVMMPSDGLEQLKKFDAIYFGAVGAPDVPDHITLWGLRLPICQGFDQYANVRPTKILPGITSPLRNCGPGDLDWVIVRENSEGEYSGHGGRAHRGLPEEVGTEVAIFTRVGVTRIMRYAFKLAQSRPRKLLTVVTKSNAQRHGMVMWDEIAAEVAEEFPDVTWDKMLVDAMTVRMTLKPQSLDTIVATNLHADILSDLAGALAGSLGVAPTANIDPERRFPSMFEPIHGSAFDITGKGIANPVATFWTAAQMLDHLGEQDASARLMRAVERVTGARILTPDVGGTATTREVTEAVCDAIHSSNV

SEQ ID NO: 83978 - protein, 456 aa, Rhizobium sp. NGR234
MSKQATTLPKGFRGDMPNGFNPQDTSHLTSEDLAHITRRQRLLGPAYRLFYKSPVEVSRAKGVFLYDRHGNEYLDAYNNVVSLGHSHPRVVEAIQKQLEVLCTHTRYMQEPLLDYAEALINTFGGELGRTGCAMFTCTGSEANDLALRIARYHTRKTGVIVTAEAYHGNSGAVAAISPSLGKKSALDPYLRTVAAPDSYRLPVEEIGRRMAEDVARQIADMERHGGGLAAFIADSVFSSDGLYVDPTDVLAPVAEVVRKAGGLFIADEVQSGFGRTGTHLWGHSRHKVDPDIVTMGKPMGNGYPVAGVVLRPELVAEFGSSMRYFNTFGGNSVAIAAARAVLDTILEEGLMDNAAKVGSEILDGLRDLQTKYEFVGDVRGAGLYFAVELVKDRDRKTPDMDRALAAVNALRDRRILISATGVDAHILKIRPPLIFTSANAARLLEGVDEALRSVQI

SEQ ID NO: 83979 - protein, 432 aa, Oryza sativa
MLAPATIRTAVRASQASRLGFVSLPAVRQYKSTWAHVKAGPPDAILGVTEAFKRDQDPRKINLGVGAYRDENGKPYVLPSVRQAEELVITSKGDKEYLPITGLADFTKNAAILAYGKDSAPVKENRIAITQSISGTGALRIGGAFLQRHYPEAKSIYLPTPSWGNHTPIFRDSGLEVKQYRYYDKKTVGLDFKGMIDDIKAAPAGSIVLLHACAHNPTGVDPTVEQWKEISNVVKEKGHFPFFDMAYQGFASGDTDKDAFAVRHFVSEGHQIALSQSFAKNMGLYGERVGAFSVVCADPDERARVDSQIKIIVRPLYSNPPMHGAKIAATILADQQLYQQWLGEVKGMADRINGMRSTLKNLLVEDLNSKLNWDHITNQIGMFAFLGISPEQVAKLVNEHHVYLTGDGRISVAGITNHNVKHLAESLHKVTS

SEQ ID NO: 83980 - protein, 218 aa, Listeria monocytogenes str. 4b F2365
MGKIAPSILSADFANLARDIKEVENCGADYIHIDVMDGHFVPNITFGPAVVQAIRPETKLPLDVHLMIENPDTYIPEFAKAGADYITVHVEACTHLHRTLQLIRYYGVKAGAVLNPATPIDVLQHVLNELDMVLFMTVNPGFGGQKFIPEVLEKISAFKKIVDEKGLDIEIEVDGGVDHETAKLCRDAGANVFVAGSYIYGNKNRQTPIDKLRAIVGE

SEQ ID NO: 83981 - protein, 256 aa, Saccharothrix mutabilis subsp. capreolus
MTAPTEPAGRADRPVALVTGASGAIGTAIATALAAAGFDLGVHHHTDAAGGRRTAAAAAALGARAVPVQGDLAREKACVAAVERVVESFGRLDVLVANAGRHRDALLLRLSEDDWDRHQEANLKSAYLCVRAALPSMLRQRHGRIVLVSSVAGLVGSPGQAAYSAAKAGLAGLARTVAHEHGRYGVTCNCVAPGLIADTPSHDGLSEARRRQILDRTAAQRAGRPEEVAAAVAFLSSPAAAYVTGQVLAVDGGMTA

SEQ ID NO: 83982 - protein, 340 aa, Triticum aestivum
MAAPPDSKSDKSPEELLCAAAEAGNDDAIAEIISSGADPTYFDASGMTPLMRAASGGHAAAARLLLDAGAPWNALSPEGLSAGDLTSDPATYDLLLDHALRSELILGTVARRQAASANSSDGVPAETYLDSRVSFSEDRVMDAESKAVMMEWERPLMEAHARAVCAAGGGKVLNVGFGMGLVDQAIQRYEPEEHTIIEAHPEVYARMLKLGWGEKKNVRILFGRWQDVIPQLGSYDGIFFDTYGEYYEDMREFHEHLPKLLNPGGVYSYFNGLCGDNAFFHVVYCQLVAMELASLGYSTQFVPLPVRDCLKAEVWEGVKQKYWQLDTYHLPVCQAESESE

SEQ ID NO: 83983 - protein, 655 aa, Listeria monocytogenes str. 4b F2365
MMIGKRLSDRYKILHAIGGGGMANVYLAHDIILDRDVAVKILRIDLADESNLIRRFQREAQSATSLVHPNIVSVYDVGEENDLHYIVMEHVDGMDLKQYIHENHPISYDKAVDIMLQIVSAVAIAHQHHIIHRDLKPQNILIDHDGVVKITDFGIAMALSETSITQTNSLLGSVHYLSPEQARGGMATQKSDIYSLGIVLYELLTGKVPFDGESAVSIAIKHLQADIPSARAQNLEIPQSLENIIIKATAKDPFLRYQNAEEMEKDLQTCLNQDRLNEPKYIFPTDDGDTKAIPIIATKDTMQNLDKTIVPEGKVAAAEVAPEENKGKKKKKMSKKKKIALIVSSVIIIFIIGILLLWLLGKSPDEVAVPDVSGKTEDQAVALLQKEGFVIGKTAEKNSDEVAEGKVINTDPEAGEMKEKGTKINLFVSIGSKKITMDDYTGRSYTDTKALLEEQGFNNISSEEAYSSEVEKGLIISQTPTQGTDVVAKSTDVKFVVSKGAEPISLKDLRGYTKTAVEDYASPLGLKVSSKEENSNTVEKGQVISQSPSAGTAMNPGDTIEIVISAGPKEKQVKEVTKTFNIPYTPSDEENPQPQKIQIYIQDKDHSMTSAYREMSITQNTSVEITFQIEEGSSAGYKIISDDKVIDEGTVPYPN

SEQ ID NO: 83984 - protein, 313 aa, Picea sitchensis
METDEIIMVLAQASKLHAKIEDAIERVLQYDTEINGENAAPAADEAQGGCVNGGKFSQSEMGVDGAMEARSLSSIRDALEVLEDQLDCFQILLQQQQADREAALSDLGESKRIFLGRLRRYQGREREVVDEALAFAGEPTVENDSLHQPPHPTLLPERLSFARSDEEHAQYYEDPDISLKNDAIKSLGWREETEEEKDSGLENSQTCRGVVADVYIKNDQTECKGIFSKVLCQSIERLQKPIVHAVSFAAKTALVVASIATVAVLTTVVNSKLSKESMRKAHSSPSAVALSSPSTGPKKSANLVKLHDSLEGL

SEQ ID NO: 83985 - protein, 234 aa, Brassica napus
MGDTEEVKLLGVWFSPYAIRPKIALRIKSVDYDYFEEDLFGSKSELLLKSNPVHKKVPVLIHNNKPILESLNIVEYIDETWNASGPSILPSHPHDRAQARFWSAFVDDKWFPALKAAAITKSEEAKEKGMKEVEGGLLQLEEAFVSISKGKPFFGGEAIGFMDICLGSFVGILKAREKLKGEKLLDESKIPFLCKWANEFLSDDTVKNVVPEIDKVVEFLGELEVRAQSAVSKT

SEQ ID NO: 83986 - protein, 458 aa, unidentified eubacterium SCB49
MSKYDVIVLGSGPGGYVTAIRASQLGLKTAVVEKENLGGVCLNWGCIPTKALLKSAQVFDYLNHAEDYGLSVTGADKDFTKVVKRSRNVAEGMSKGVQFLMKKNKIDVINGFGKLKPGKKVDVDGTEYSADHIVIATGARSRELPNLPQDGKKVIGYREAMTLEKQPKSMIVVGSGAIGVEFAHFYNTMGTEVTIVEYLPNLVPVEDIDVSKQFEKSFKKAGIKVMTSSSVESVDTSGDTVKATVKTKKGEEILEADVVLSAVGIATNLEGIGLEDVGIVTDKGKVMVNEWYQTNMPGYYAIGDITPGPALAHVASAEGILCVEKIAGEHCEPIDYGNIPGCTYATPEIASVGMTEAQAKEAGYELKVGKFPFSASGKASAAGTKDGFVKVIFDAKYGEWLGCHMIGAGVTDMIAEAVLGRKLETTGHEVLKTIHPHPTMSEAVMEAVADAYDEVIHL

SEQ ID NO: 83987 - protein, 396 aa, Acidobacteria bacterium Ellin345
MAKISHFECARCGEKLAPATLLNVCPKCAGPLWVRYEFGRPDREAVKLGPATMWRYSSVLPDVEPVTLGEGFTPMLPSRKHANVFIKDEGLNPTGSFKARGLGMGVTMARFYGVKKIAIPSAGNAASALAAYCAAAKIEAHIFMPKDVPMANRIECESYGAHVTYVDGLISDCAKMVAERKQAEGWFDISTLKEPFRVEGKKTMGYEVAEQLGWELPDAIIYPTGGGVGLLGMWKAFEEMEQLGWIGSKRPKMICAQATGCAPVVKAWEEHRETMEMWKDAHTSAAGLRVPKPYADREILHAMKASGGTAVAVTDDEIMAAFSSWAREEGVFAAPEGAAALAAYWKLIESGYLRPEEKVVLFNTGSGLKYIDVFEKYFRKKEQPKSRALGGIIQPY

SEQ ID NO: 83988 - protein, 132 aa, unidentified eubacterium SCB49
MSKQYPLHKSESEWKKELGEERYRILREKGTERPHTGAYNLTFEKGSYACGACKTPLFNSDSKFDSGCGWPSFDQSIEGSVEYIKDTTFGMIRTEILCANCGSHLGHVFNDGPTETGQRYCVNSLSVDFKKE

SEQ ID NO: 83989 - protein, 199 aa, Brassica napus
WIKSIVSISSDLMHDFKTGHWTLTSPRSMLVSQAIGTGIGCVVAPLTFFLFYKAFDVGNPEGEYKAPYALIYRNMAILGVEGFSALPQHCLQLCYGFFAFAVAANLVRDMSPEKIGKWVPLPMAMAVPFLVGGYFAIDMCVGSLIVLVWNKRDRVKAGLMVPAVASGLICGDGLWILPSSVLALAGVKPPICMSFMPSK

SEQ ID NO: 83990 - protein, 513 aa, Mycobacterium avium 104
MIPDPSALNAARRTADLAALAEGEPLDVLVIGGGITGAGIALDAAARGLRVALVEKRDLAFGTSRWSSKLVHGGLRYLASGNVGIARRSALERGILMTRNAPHLVHAMPQLVPLLPSMSRATRALVRGGFLAGDALRFLAGTPASTLPRSQRVSAQRVVQLAPTVCRDGLDGGLLAYDGQLIDDARLVTAVARTAAQHGARILTYVAASRATGTSVRLTDVRGGGSFDVSAGAVINAAGVWAGEIDGSLRLRPSRGTHLVFDAAAFGNPTAALTIPIPGELNRFVFAMPEQLGRVYLGLTDEAAPGPIPDVPEPSVEEITFLLDTVNTALGTALAATDVIGAYAGLRPLIDTGEGRTADVSREHAVVESASGVISVIGGKLTEYRYMAQDVLDRAVRVRRLRAAKCRTRNLPLIGAPANPGITGAPQVALPESLVSRYGAEAAKVVATAGCERPSEPVVDGIDVTRAEFEYAITHEGALEVSDIVDRRTRIGLVPRDRERVVAVAEEFLARFG

SEQ ID NO: 83991 - protein, 405 aa, Escherichia coli O157:H7 EDL933
MSSVDILVPDLPESVADATVATWHKKPGDAVVRDEVLVEIETDKVVLEVPASADGILDAVLEDEGTTVTSRQILGRLREGNSAGKETSAKSEEKASTPAQRQQASLEEQNNDALSPAIRRLLAEHNLDASAIKGTGVGGRLTREDVEKHLAKAPAKESAPAAAAPAAQPALAARSEKRVPMTRLRKRVAERLLEAKNSTAMLTTFNEVNMKPIMDLRKQYGEAFEKRHGIRLGFMSFYVKAVVEALKRYPEVNASIDGDDVVYHNYFDVSMAVSTPRGLVTPVLRDVDTLGMADIEKKIKELAVKGRDGKLTVEDLTGGNFTITNGGVFGSLMSTPIINPPQSAILGMHAIKDRPMAVNGQVEILPMMYLALSYDHRLIDGRESVGFLVTIKELLEDPTRLLLDV

SEQ ID NO: 83992 - protein, 388 aa, Escherichia coli O157:H7 EDL933
MNLHEYQAKQLFARYGLPAPVGYACTTPREAEEAASKIGAGPWVVKCQVHAGGRGKAGGVKVVNSKEDIRAFAENWLGKRLVTYQTDANGQPVNQILVEAATDIAKELYLGAVVDRSSRRVVFMASTEGGVEIEKVAEETPHLIHKVALDPLTGPMPYQGRELAFKLGLEGKLVQQFTKIFMGLATIFLERDLALIEINPLVITKQGDLICLDGKLGADGNALFRQPDLREMRDQSQEDPREAQAAQWELNYVALDGNIGCMVNGAGLAMGTMDIVKLHGGEPANFLDVGGGATKERVTEAFKIILSDDKVKAVLVNIFGGIVRCDLIADGIIGAVAEVGVNVPVVVRLEGNNAELGAKKLADSGLNIIAAKGLTDAAQQVVAAVEGK

SEQ ID NO: 83993 - protein, 635 aa, Zea mays
MSGAIGGAEVHGFRGAAAQLPRSRVLGRPIRVAPPAAARPGGASAGSIRAVSAPAKKDASEVKRSKVEIIKEKSNFLRYPLNEELVSEAPNINESAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPYVKKDILFAQQTAENIAALLTPQSGAYYDLWVDGEKIMSAEEPPEVTKARNDNSHGTNFPDSPEPIYGTQYLPRKFKVAVTAAGDNSVDILTNDIGVVVVSDDAGEPIGFNIYVGGGMGRTHRVETTFPRLADPLGYVPKEDILYAIKAIVVTQRENGRRDDRKYSRMKYMIDRWGIDRFRAEVEKYYGKKFESFRPLPEWQFNSYLGWQEQGDGKLFYGVHVDNGRVGGQAKKTLREIIEKYNLDVSITPNQNLILCGIDQAWREPITTALAQAGLLEPKDVDPLNLTAMACPALPLCPLAQTEAERGILPILKRIRAVFNKVGIKDSESVVVRITGCPNGCARPYMAELGFVGDGPKSYQIWLGGTPNQSTLAESFMDKVKLDDIEKVLEPLFTYWNGTRQEGESFGSFTNRTGFDKLKEVVNKWAESPSAA

SEQ ID NO: 83994 - protein, 254 aa, Bifidobacterium longum DJO10A
MALIVQKYGGSSVADTESIKRVAKRVVETEKKGNKVAVVVSAMGDTTDDLIDQALSIDSNPPEREMDMLMTAGERISMSLLAMAIHAEGSRAHSFTGQQAGFFTDARYGAAHIKAVRPDRVKNALSLGDIAIVAGFQGINAKGDATTLGRGGSDTSAVALAVALGADICEIYTDVDGIFTADPRIVPSARRIPSIDYESILEMASCGSKVLALRCVEYAQRFNMPLHVRSSFSRRPGTLVVPDGIDPRTLPNLD

SEQ ID NO: 83995 - protein, 229 aa, Mycobacterium avium 104
MLAAIRRDIRAARERDPAAPTTLQVIFAYPGVHAIWGHRVNHWLWRRGARLAARICAEITRILTGVEIHPGAVLGPGLFIDHATGVVIGETAEVGEDVTIYHGVTLGGSGRDTGKRHPTIGDRVIIGAGAKVLGAIKIGDDSRIGANAVVVKEVPSSAVVVGVPGQVIARTHPGPGGPDDSLMPDLVGVSLQSLLTRVTKLEAKVDGSQTGRVIRPPEAGVWYGEDFSI

SEQ ID NO: 83996 - protein, 348 aa, Acidobacteria bacterium Ellin345
MTYKITLIPGDGIGPEVTSAAVRVLEATGLKFEWESFAAGAEAYEKYKEYIPKELNESIERTRIGLKGPVTTPIGGGFSSINVELRKRFELYANVRPIRNLPGVHTRYPGVDLVVVRENTEGLYSGIEHEVVPGVVESLKIITEKASTRISKFAFNYARKMGRKKIHSIHKANIMKMSDGLFIRCSRNISKEYPEIIYGEHIVDNTCMQLVMNPYQYDILLLENLYGDIVSDLCAGLVGGLGLAPGANIGERASIFEAVHGSAPDIAGKNIANPTAVIRSGILMLRHLDEQDAANRVKAAVHHVYREGKHLTRDMGGTTSTSEFADKVVEAIHSKDLVVPAPPVQSPA

SEQ ID NO: 83997 - protein, 126 aa, Schizosaccharomyces pombe
MPEALNENVSDTASNGPVAKTRAPPNTSFRQQRIKSWQPLLTPKIVLPLFFVLGIIFGPLGGGLLYASSIVQELVVDYTDCETLASYDEFSAVPSKKYTASFDQSGTIGFDKESTYWKLEKILDKD

SEQ ID NO: 83998 - protein, 243 aa, uncultured marine alpha proteobacterium HOT2C01
MRKAGNLAASTLDLLVEKVKPGVSTEELDNIAFDYIVRHGGLIAPLFYKGYPKSVCTSINHVICHGIPSSRILENGDIVNIDVTVIVDGWHGDTSRMFPVGRINAKAQKLIDCTFHAMHEGINAAQPKATLGDIGSAIQTYAEKQNYSVVRDFCGHGLGKVFHEFPNILHYGDKGKGEIIEPGMFFTVEPMINFGKYDVRMLGDGWTAVTKDKSLSAQFEHSIGITKDGVEIFTKSPAGLDKP

SEQ ID NO: 83999 - protein, 727 aa, Zea mays
MAAGSIRVTMEVGADGVALITIANPPVNALHPIIIAGLKDKYAEALRRDDVKAIVLTGAGGKFCGGFDINVFTKVHQTGDVSLMPDVSVELVSNMMEEGKKPSVAAIQGLALGGGLELTMGCHARISTPEAQLGLPELTLGIIPGFGGTQRLPRLVGLPKAIEMMLQSKFITAKEGNERGLIDALCSPDELIKTSRLWALEIANCRKPWMRSLGRTDRLGPLSEARAVLNAARQQAMKIAPNMPQNQACLDVMEEGILCGGQAGVLKEAVVFKELVIAPTSKALVHVFFAQRSTTKVPGVTDVQLKPRPIRKVAVIGGGLMGSGIATSLLVSNISVVLKEVNPQFLQRGEKTIAGNLEGLVKRGSLTKDRMHKAMALLKGALDYSDFKDVDMVIEAVIEKIPLKQSIFADIEKICPKHCILATNTSTIDLNVVGKKTNSQDRIIGAHFFSPAHIMPLLEIVRTEKTSPQAILDLITIGKIIKKVPIVVGNCTGFAVNRTFFPYTQGSHLLVSLGIDVFRIDRVISTFGMPMGPFQLQDVAGYGVALAVKDIYADAFGERNLDSDLVDLMVKDGRQGKVNGKGYYIYEKGGKPKPDPSVKHVIEEYRKHANTMPGGKPVTLTDQDILEMIFFPVVNEACRVMDENVVIRASDLDIASVLGMGFPKYRGGLVFWADTVGAPYIHSKLSKWAEIYGPFFKPSSYLEQRAKSGVPLSAPGASQQGSARSRM

SEQ ID NO: 84000 - protein, 494 aa, Drosera regia
PIPTTSGPEVLTREKKNLGRIIQIIGPVLDIAFPPGKMPYIYNALVVKGRDTLGQPINVTCEVQQLLGNNRVRAVAMSATDGLTRGMDVVDTGTALSVPVGSATLGRIFNVLGEPIDNLGPVDTRTTSPIHRSAPAFIQLETKLSIFETGIKVVDLLAPYRRGGKIGLFGGAGVGKTVLIMELINNIAKAHGGVSVFAGVGERTREGNDLYKEMKESGVINEQNIPESKVALVYGQMNEPPGARMRVGLTALTMAEYFRDVNKQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPKIVGDEHYETAQQVKQTLQRYKELQDIIAILGLDELSEEDRLTVARARKIERFLSQPFVVAEVFTGSPGKYVGLAETIRGFQLILSGELDGLPEQAFYLVGNIDEATEKAMNLEMENKL

SEQ ID NO: 84001 - protein, 417 aa, Geobacillus stearothermophilus
MMKGCRVMVVLLGLCFVFGLSVPGGRTEAASLRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFSTERTYRGALTGNHYPELGMNAFSAVVCAPFLGSYRNPTLGIDSHWLENDGIVNTISMNGPKRGSNDRIVPYDGTLKKGVWNDMGTYNVDHLEIIGVDPNPSFDIRAFYLRLAEQLASLQP

SEQ ID NO: 84002 - protein, 366 aa, Zea mays
MEAKKPYVIAIVVQLIYAGMFVVSKAAFNHGINTYVFIFYRQAAASLLLLPIALVLERKNARTMLSPWLLLKLFLLALIGLNLYNVSLKFTSATVASAATNAMPVVTFCFALLLKMEAVRPRSASGVAKLAGVSLCLAGVLAIAFYAGPALSPVNRHRAFATSSPAPAAAAASGRTATWVKGTFLMVLANMAWSLWILLQARLLRECPSKMLVTVAQCVFSALQSFVVAVVAERDFSRWSLRLDVSLLAVLYTGLLVTGVTYYLQAWCVELKGPVFFAVWTPLCFVFTIFSSSFFLGEIVHLGSIVGGILLVGGLYSVLWGKSKETKVATCGKVNSALDADADEENNRHKQPQEKVEETASSASIV

SEQ ID NO: 84003 - protein, 483 aa, Dionaea muscipula
  misc_feature (477)..(477): Xaa can be any naturally occurring amino acid
LKFRHVKKKTWGRIIQIIGPVLDVAFPPSKMPYIYNALVVKGRDTLGQPINVTCEVQQLLGNNRVRAVAMSATDGLMRGMEVVDTGAALSVPVGSATLGRIFNVLGEPIDNLGPVDTRTTSPIHRSAPAFIQLETKLSIFETGIKVVDLLAPYRRGGKIGLFGGAGVGKTVLIMELINNIAKAHGGVSVFAGVGERTREGNDLYKEMKESGVINEQNIGESKVALVYGQMNEPPGARMRVGLTALTMAEFFRDVNKQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPKIVGDKHYETAQRVKQTLQRYKEVQDIIAILGLDELSEEDRLTVSRARKIERFLSQPFVVAEVFTGSPGKFVGLAETIRGFQLILSGELDGLPEQAFYLVGNIDEATEXAINLER

SEQ ID NO: 84004 - protein, 421 aa, Arabidopsis thaliana
MNHEATSLTGVSGAGQPSAATPSDPPPPSSVPMFIPKTEPGIYMSKKTKSKVSAPSQSKRQCTAATSKTRSKAPALRRLSSKKSTRSASAAGQTEEHVFESSDLQDGDVTQIAPPLFLSGYQENRRLLSARDPQVSSETSYNNCFLTAEGLGRYKLIGGRYFNDMRFLSLDGNNTASTLQLLSTAGLLLTVTEIDSYVQEVVMEFYANLPDGEEGDQLAYFVFVRGNMYEFSPAIINQIFQLPNPPYPLNMSKIKVPESMDEVDVARSNSKANSWKMLTSQLLSPEIALLNKIYCHNWMPTVNRSVLKPERACSNAVANPSSTLHLVLPNLIDQMLRFQRIVRSGEGDTTSSAPLKFTMEVKPILVLQTDSPTLDAGLENLIVSLTTMRLCLAGAEYSDVSYSVPDDVGDENVEEEDDVVT

SEQ ID NO: 84005 - protein, 126 aa, Zea mays
MAEDNSAAWPQADQALSQEILDLVQQATHYRQLKKGANEATKTLNRGISELIILAADTSPLAILLHLPLLCEDKNVPYVYVPSKMALGRACGVARPVIAASITTNEASDLMGQIRTLKDKVERLQI

SEQ ID NO: 84006 - protein, 633 aa, Zea mays
  misc_feature (242)..(242): Xaa can be any naturally occurring amino acid
  misc_feature (268)..(268): Xaa can be any naturally occurring amino acid
EFPGSRTESSHRGTGAAGSLTVDRSTGVIPGQSRARTETLEEHLEEVVFEGVYSSACSSSGWSYLTKGWVEGSRTSSLQQRHQGGKRKEYWRKPWACWSNPQSRVSSRSDEPKPSYPSSSSANPPRLRYSQGSARQLQQQHQQARSSHQPTTISSDSSQILPPTLHFPPLPRHPAMAGLLHLQSTLLPSASALRRRAGVPVPSSSRRRCRIEAKIREIFMPALSSTMTEGKIVSWTAAEGDXRLAKGDPVVVVESDKADMDVETFYDXFLAAVLVPAGDSAPVGSAIALLAESEEDIPVAQSQAASFSSTSPLPSPPQETAAQEASPSPPPPPPPGPVSVSAPTPPLPATQGERVVASPYAKKLAKDLGVDLFSVTGSGPCGRIVAKDVEAALAAPKKAAPVTAPRPDVPLGSTVPFTTMQGAVSKNMVESLAIPTFRVGYTITTDALDQLYKKIKSKGVTMTALLAKATAMALVQHPVVNSSCRDGKSFTYSSSINIAVAVAIDGGLITPVLQDADKLDIYSLSRKWKELVDKARAKQLQPHEYNSGTFTLSNLGMFGVDRFDAILPPGTGAIMAVGASEPTIVGTKDGRIGIKNQMQVNVTADHRVIYGADLAAFLQTLAKIIEDPKDLTF

SEQ ID NO: 84007 - protein, 261 aa, Haemophilus somnus 129PT
MSEPENLAQNQPHFFEETTHFGFQTVAKSEKQKLVANVFHSVAAKYDLMNDLLSFGIHRVWKRFTIDCSGVRKGHKVLDLAGGTGDFSAKFSRIVGETGKVILADINSSMLDVGREKLRNLGIVGNVDYVQANAEELPFADNTFDCVIISFGLRNVTDKDKALRSMFRVLKPGGRLLVLEFSKPILDPLSKIYHFYSFNVLPKIGEIVVNDSDSYRYLAESIRMHPKQDILKEMMINAGFEQVGYYNLTAGIVALHRGYKF

SEQ ID NO: 84008 - protein, 444 aa, Rhizobium sp. NGR234
MSTDLMPNRFTPGEATIPPRESELIARRDSVLGASYRLQYRRPVLFVRGEGIWLYDPDGRRYLDFYNNVPSLGHCNPEINAAVADQASRISANTRYLEPRLVDYAERLVATFPGELNRVVFTCTGSESNDLALRIARLTSGNEGVIVSSHAYHGTSAATAMVSPNLGDAVKLSPAVRMVSLPGPAGISEAQAADFFEAQVRAAITDLNRRGTGIAALLIDSIFSSDGVWVDPPGFIVGGVRAVREAGGLVIADEVQPGFGRTGTHMWGFERHEVVPDLVTLGKPMGNGFPIGAVVGRKAPMDRFGATARYSNTFGGNTVGIAAADAVLTILQRDQIPEHAHAMSERLRLGLEHLAKLHPGIRGIRNAGLFFGIDIGLDGAEEASRRAMALDIVNLMRDDGVLISTTGANEDTLKVRPPLICQAAHVDRFLEAMECALKKAVAQM

SEQ ID NO: 84009 - protein, 291 aa, Zea mays
TRPAPFVLHTDCPHYWRYHLPGETEEDFATRLATNLENLILKEGPETIAAFIAEPVMGAGGVIPPPKTYFDKVQAIVKKYDILFIADEVITAFGRLGTMFGCDYYNIKPDLVSLAKALSNAYVPIGATLVSPEISDVIHSQSNKLGSFAHGFTYSGHPVACAVAIEALKLYRERDIPGHVKQIAPKFQDGIRALADSPIIGEIRGLGMIMGTEFTNNKSPTDLFPAEWGVGAIFGEECQKRGMLVRVAGDAIMMSPTLIMTPGEVDELVRIYGEALKATEERVAALQSKKN

SEQ ID NO: 84010 - protein, 770 aa, Arabidopsis thaliana
MVAPALLLELWTEILVPICAVIGIAFSLFQWYVVSRVKLTSDLGASSSGGANNGKNGYGDYLIEEEEGVNDQSVVAKCAEIQTAISEGATSFLFTEYKYVGVFMIFFAAVIFVFLGSVEGFSTDNKPCTYDTTRTCKPALATAAFSTIAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKLVKEIEPALKNQLIISTVIMTVGIAIVSWVGLPTSFTIFNFGTQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGIHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYF

SEQ ID NO: 84011 - protein, 368 aa, Physcomitrella patens subsp. patens
MLFTPSSQADVVLKVTTTFICGSDLHMYCGYMPGMKSGDVVGHEFMGIIDEVGPGVKNFKKGDRVVASALIACFNCWACKEQSFSLCETTNPSKETSVACGDRTGGIYGYCHLTGGYDGGQAEYVRVPMADNNLLLVPDGLKDEQVIFLSDILPTGWHANELARVGEGDNVAIWGCGPVGMMAATSAFNRGANRVVVIDSQQYRLDFLKSNLPKVETINRNDKKVYSALRDLFPHGPDVAIEAAGFHYVPNPLHKVEVAVGMETYTSEIINELIYCVRKGGRIGIVGDYITYCNHFNLGAFMEKGLTMAAGQVYIHKYWPTLLSKIESGEIDPSFVITHTLPLGEAPKGYQIFDDKVEGCVKVEQSTH

SEQ ID NO: 84012 - protein, 363 aa, Listeria monocytogenes str. 4b F2365
MTKRILMLEDGNYFIGDAIGSEKETIGEVVFNTGMTGYQETITDPSYYGQIITFTYPLVGNYGVNRDDFESINPAVKGVVVREAAEFPSNWRNQITLDEFLKEKGIPGIAGIDTRKLTKLIRKEGTLKGILAAETANKEELLHHLRSVRLPVDQVHEVSSAKAFASPGDGKRVVLVDYGVKSSILRELNKRNCYVTVVPYNTTAEEILAMHPDGVMLSNGPGDPKDVPEALEMIRGIQGKLPLFGICLGHQLFALANGADTFKLKFGHRGANHPVKELATGRVDFTAQNHGYAVEKDSLIGTDLKVTHIELNDETVEGLAHKEYPAYTVQYHPEANPGPSDVNYLFDEFMEMMNGKEEGELHA

SEQ ID NO: 84013 - protein, 450 aa, Triticum aestivum
  misc_feature (388)..(388): Xaa can be any naturally occurring amino acid
  misc_feature (400)..(400): Xaa can be any naturally occurring amino acid
MQKDTGSGDVSPSHVGRVRHRRRPNETATDGNRANGTVLLVSDQNKYKSMLIRTYSSLWMIGGFVFVVYMGHLYIWAMVVVIQIFMATELFNLLRRSSEEKQLPGFRLLNWHFFFTAMLFTYGRFLSRELVNTVTSDHLLYKLVSGLIKYQMFICYFLYIAGFVWFILTLKKKTYNYQFKQYAWTHMILLTVFAQSSFTVANIFEGMFWFLLPASLIVINDIAAYLFGFFLGRTPLIKLSPKKTWEGFIGASVTTIISAFLLANVMGHFQWLTCPRKDLSTGWLTCDPGSMFKPEHYFLGDWVPQWFPWKEVFLLPVQWHALALGLFASIIAPFGGFFASGFKRAFKIKDFGDSIPGHGGITDRMDCQMVMAVFAYIYHQSFISPHNXSVDTILDQIVRXNLTYEEQRSLYQQLGEIFRERQFMQSLRIYLRMDPPTPPEQLRIGSIMEF

SEQ ID NO: 84014 - protein, 427 aa, Coprinopsis cinerea okayama7#130
MPSFDVHRARAQFPSLESGFLFADNAGGSQIAQEVIDRLTDYIINTNAQLGATYSLSRTSTQRVLVEAPQEATKLFNAKSPNEIVFGSSSTLNLENLARSLEKDIKAGDEFIITGEHEANVGPWKKLASRTGAVIKYWKARPTEESNPYSIALKVEDALSLVSSRTRIIAFTACSNILGSIVPVKDVVKALRAQVRAMGAPKVEISVDCVAYAPHRLIDVQDWDVNFAVLSYYKVYGPHISALYVRETSLEQSVSSLVHHFIDVDASPSYKLQPGGPGYELVYATTGVIQYLRSLTSANDLKASFEAIAEHEQTLLKPLLEFLTAPAQWERGVRIVGQSTVDLSRVPTVSFVVVGPKALRSRDIVKAFDEKETIGIRNGHVYAYTLLNDLDPKIDMDDGVVRISLVHYNTVNEVLRIIDVLKEVLSA

SEQ ID NO: 84015 - protein, 272 aa, Methanosarcina barkeri str. Fusaro
MVDQNQKIGFIGAGKMGSALMQGIIKAGIVKPENLGAADVYEPFLNDLKAKLGINISTDNSVIARASDILLLAVKPQTLGSVLENLKADITSDKLIISIAAGVPLATYENALPAGTRVIRVMPNIAATVSEAASGIAPGKNATPEDVKTALEIFSAVGTAVQVSESIMDAVTGLSGSGPAFIFPVIEAMADGAVLEGMDRKSALTLSAQTVLGAAKMMLETGLHPGELKDMVTSPAGTTIQGVHALEEAGVRAAFMNAVIRATERSKELGKK

SEQ ID NO: 84016 - protein, 449 aa, Alkalilimnicola ehrlichei MLHE-1
MKNSDIVKRDLDVLWHPCTQMKDHEWLPLIPVKKGEGVWLEDFDGNRYIDAISSWWVNLFGHCHPHISGAVQQQAAELEHVILAGFSHEPVVRLSEKLVQITPPGLSRCFYTDNGSSAVEVALKMSYHYWRNTGKPEKLKFITLSNSYHGETLGTLGVGDVALYKETYKPLLMEAITVPSPDAFLREPGSSWAEHAERMFAHMEAALERHAHETAAVIVEPLVQCAGTMRMYHPVYLERLREACDRHGVHLIADEIAVGFGRTGTMFACEQAGISPDFMCLSKGLTAGYLPLATVLTHDRIYQAFYDDYATLRAFLHSHSYTGNPLACAAALATLELFERDDVIARNRELAREMGEAFAHLADHPHVGEVRQTGMVLAAEMVPDKHKPEPYPWEERRGMIVYQHALKNEALMRPLGSVVYLMPPYVITPEQIRHLARVATEGIDLATRA

SEQ ID NO: 84017 - protein, 403 aa, Alkalilimnicola ehrlichei MLHE-1
MTAALPPLRLKPGEDKRLRAGHLWVFSNEVDIDATPLKAFEPGQDALLVDSRGHALGTVYVNPGSLICARLVSRDSRYRLDESLLVHRLKLALGLRERLFDAPYYRLVHGEADGLPGLVIDRFGDACVVQVNTAGMERVRDSIVTALGRVLGEGPVLLRCDSAVRELEGLTRYQAWGSGPEAQTLEVVENGVRFQVPATTGQKTGWYYDHRMNRQALRPWVPGRRVLDVFSYMGAWGVQAAVAGAAEVFCVDSSEQALDGVAENAALNGVSDQVAGVQGDAFDALAELRQANERFDVVVVDPPAFIKRKKDFRQGFKAYQRLNRMAMQLLNKEGLLVTASCSAHLPEQRLLDAAQAGARHLERSLRVVALGHQGPDHPVHPAIPETRYLKAAFCRVLPAGSMP

SEQ ID NO: 84018 - protein, 447 aa, Aspergillus oryzae
MSKPRRNVRFPHRASETRRLSISDASDAASEPGSPSKNGSVSKPETIVEEPQMSDYEKKKQTFITRTIWTFVMIFGFFIAMFSGHIYIIGLVTAIQIISFKEVIAIANVPSKEKNLRFTKSLNWYFLATTMYFLYGESVIYYFKHVLLVDKVLLPLATHHRFISFTLYVMGFVFFVASLQKGHYRFQFTQFAWTHMALYLIVVQAHFVMNNILEGMIWFFLPASLVITNDIFAYVCGITFGRTQLIQLSPKKTVEGFLGAWICTIIFGYFMTNVLMRYKYFICPVNDLGSNVLTGLECTPNPAFMPQPYQVPEWTGVDKTFYVEPIQFHILIFATFASLIAPFGGFFASGLKRTFKIKDFGESIPGHGGITDRMDCQFIMGFFAYMYYHSFIAVYKATVGDVIETAINGLTVEEQLEVVRGLGKYLYNQGTVSETILECLNTELKRR

SEQ ID NO: 84019 - protein, 988 aa, Oryza sativa
MGSSPTNTGRTPHGLGLRGRLAGLFSSPSPCHHQHSDEVVAKLKEEVEKQRDLKETYMARLESTQAYLRFCLEVAQVHDFLHLVSNSNGGDDEPHRDAGDQEPATAAAADDDDEDAAEAPPCDPYFAATRDLAVQHGWATWRGLDVAVKWMRAEFFAAADQRSRGEAFFAQELDALSRQRHPHVLRLMAACLRPPASCFLVTELLTGATLAQWLHGGDGGGRSRERRRQPSSPPPPPPLVDRVSRALEIALAMRYLHEQTPAVVHRDLKPSNVLLDGDSRVRVADFGHARFLPDGTAALTGETGTYVYMAPEIIRCEPYTEKCDVYSFGIILNELVTGEHPYIDTGYGPSKRPYKSLYYGSSPQRPPSPTPTPPPPSPRRLAAMPAVKWLMHWHPNQGATLNSQILAEACACAESLGGSKDGRWKTSIIFYRAMARDGASAAAAGGGGPPQQHPDVPRELLGVALHERPGLYFSILRAHRLVLQADSAFPQVMEKLQSYKARVTLNFEGFQYQLGDFCLRIGKCVPNNSETLRGIMMEVEYYPLSSIEKSRAVMEDFFDIWQETVAKKSLPDLVCLYTLPKEEGPCPPQSILVRASSCGSGRFKVLKIGGKWKSSTPVELSASSSRGVKAGRRARCEAASIGAHQAAHLWQSGCLCARPVGLSGEISVRGADLESGEDSSDSVTSDAGSAKAAPDDVLHIAHALCKVCAKSPRAVIDFVRRVSPATVGRSIDWDVVREEESSKMGDGRSRWTDMEVRVFLESCLEEMAAFTITSNSPKPQAWQNLIHKMYTKCKKKVNKAQLEYIWGQCKKRNDPLKHIDLHHAVFSGRTVVGNHSAVAGAAPQAPQGAVQWQTIDMAQLAAAYRPPPPTPPPTAADRGKGKRLAANTTASGSSSKKSRSDSAGLALERIADIRQQSYQSRVAQMEAEKSMGLDACMELVENDGHEIGGSVCHAGRCKEEDDPAVDPTAGGGDVHRSGARRYEGSAPE

SEQ ID NO: 84020 - protein, 293 aa, Hordeum vulgare subsp. vulgare
MSPTLSLKLKKSSHTPQSSVSSSTMLRLFKKEAACQSPSTLPVAMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSATCLNFADSAWLLAVPSALSDLADVRRAAVEAVADFQRREAADGSLAIAVPKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 84021 - protein, 467 aa, Prochlorococcus marinus str. NATL2A
MSSIKIQKICCIGAGYVGGPTMSVIADKCPDLEIRVVDINKERIDAWNDSDLNKLPIFEPGLDRIISRTRGRNLFFSTEMEKSISDADMIFISVNTPTKTKGLGAGQASDLSWVEASARQVAKYAKGHTIVIEKSTLPVRTAQAIKEILKTTDKEMQKNEISKTFSVLSNPEFLAEGTAINDLEKPDRVLIGGEDSDSIDALVKIYLNWVPYEQIICTNLWSSELSKLAANAFLAQRISSINSISAFCEATGADVQEVAKAIGTDKRIGNQFLSAGPGFGGSCFKKDILNLVYLSGYFGLPEVANYWNQVVVLNTWQQDRIYKIVLEKLFGTVNGKNIAILGFSFKANTNDTRESPAIRISSDLLEEGAILSIYDPKVTFERIEEDFEKFSFNNQGIWKMASSIPEALKNVDAVIILTAWDEFFGLDWNYLASLMRSPAWVFDTRSVVNRQEVEDTGVNLWKLGEGN

SEQ ID NO: 84022 - protein, 343 aa, Aspergillus oryzae
MAPVPASLLRALSIPDPSKASLSTAGLGSGFTGTGAIRATVPSADGQYEEERRYFVKTSADGKAAEEMFRGEYESLNAIATSVPGFCPRALAWGPLEESNGKSFYLATEFLDLGGGGRTGQSLAQRLGKLHSTPAPLDPETEKRRFGFPVPTFCGDTKQPNRFHDSWADFYANERLITILETSEKRNGRDASLRDLVERTAQTVVPALLGDDHLGYDKNGNGEGITPVVVHGDLWSGNADRGRIVGSGCKGDEEVGDVVYDPSSCYAHSEYELGIMKMFGGFGSTFFTAYHKIVPRTEPVEEYEDRVRLYELYHHLNHYAIFGAGYRSGAVSIMQNLIRKYGN

SEQ ID NO: 84023 - protein, 295 aa, Sinorhizobium meliloti 1021
MSASESEIQARLLAQALPYMQRYEHKTIVVKYGGHAMGNAELGRAFASDIALLKQSGVNPIVVHGGGPQIGAMLNRMGIESKFEGGLRVTDEKTVEIVEMVLAGSINKEIVALINQTGEWAIGLCGKDGNMVFAEKAKKTIRDPDSNIERVLDLGFVGDVVEVDRTLLDLLARSEMIPVIAPVAPGRDGHTYNINADTFAGAIAGALNATRLLFLTDVPGVLNKKGELIKQLSVAEARALIADGTISGGMIPKVETCIEAIKAGVQGVVILNGKTAHSVLLEIFTEHGAGTLIVP

SEQ ID NO: 84024 - protein, 164 aa, Sinorhizobium meliloti 1021
MISRRDLLMAGAALAAVVALRGLVWPVRAVAGEAFEITRTDAEWRALLGEDRYRVLREEGTEPPFSSALDNEKRNGVFHCAGCELPVYSSDAKYDSGTGWPSFWQALPGAIGTREDDTLFVTRTECHCRRCGGHLGHIFDDGPPPTGKRHCINGLALSFVPETA

SEQ ID NO: 84025 - protein, 217 aa, Sinorhizobium meliloti 1021
MSATNKQNAASVFGRPWIFIRGVPSMKFLPPEGPTEIAFAGRSNVGKSSLINALVGHKGLARTSNTPGRTQELNYFVPDGYSGEAGDLPPMALVDMPGYGYAQAPKEQVDAWTKLVFDYLRGRSTLKRVYVLIDARHGIKKNDEDVLALLDKAAVSYQIVLTKTDKIKAAGVPRLVAETLEKIKKRPAAFPEVLSTSSEKGEGIEDLRAAIELAVTR

SEQ ID NO: 84026 - protein, 193 aa, Oryza sativa Japonica Group
MGSGSFLKLLANNFDVLAGPLVSLAYPLYASVRAIETKSPVDDQQWLTYWVLYSFITLFELTFAPVIEWLPFWSYAKLFFNCWLVLPCFHGAAYVYDHFVRPMFVNRQIVNVWYVPRKENLSKPDDVLSAAERYIEQNGPEAFEKLISKSTRPSTSKRSTKQSILEEVESEHMARAERESWGENPFYDKNYRC

SEQ ID NO: 84027 - protein, 405 aa, Trichodesmium erythraeum IMS101
MDLLEYQAKALFSEMGIPVLPSQRIDYPKDLKKLKIPYPVVLKSQVHTGERSSLGGIKFVENTIDAVAAAQTIFNLPIKDEYPAVLLAEAKYNADQELYLAVVLDPIVRRPVLLGSKQGGIDTETAIKSMQKVVVNQEFSPFYARRLMVKIGLEGKLIELVSHIVEKMYQLFVEKDLDMIEINPLGISPKGEVMALDGKVSVNDYALGRHPELLSIVGQNISDNYEIKQKEVKEIEDSSLLVFNNINAVSNRKIIPDYRLKFKELQGNIGILCNGKGLTMATVDMVIQAQGKPANFLNIKLGDYLEVKNSLRSQMFTALDLVSQRDNIKVVLINVIGIVETSDELITIVYEYLNKLTSIDQKKIRFVLRLLGGRISKARERLSDLPVEVIENLEDAVSQAVYLSK

SEQ ID NO: 84028 - protein, 833 aa, Arabidopsis thaliana
MELEPNKSLSADMPSLLSRSSEAFNGGTGYRSSSDLSMFSSSLPTLFHEKLNMTDSDSWLSFDESSPNLNKLVIGNSEKDSLEDVEPDALEILLPEDENELLPGVIDELNFTGLPDELDDLEECDVFCTGGGMELDVESQDNHAVDASGMQISDRGAANAFVPRKRPNTAGRVSVEHPNGEHPSRTLFVRNINSSVEDSELSALLSRLGRSEVCTLHVKSRGFVMISYYDIPSCSMPANAVALTRNTLLRKRTLDIHFSIPKENPSEKDMNQGTLVIFNVDTTVSNDELLQLFGAYGEIREIRETPNRRFHRFIEYYDVRDEETALKALNRSEIGGKCIKLELSRPGGARRLSVPSQSQDLERTEVTNFYNQVGSHVANSPPGNWPIGSPVKGSPSHAFTRPHGLGMVRPVNSDNMPGLASILPAHPSSFHGFSPVSNDQGLLNHSNQTILNKGLMHNISYGQPHSLPEHITGGISNSMRFIAPHSSGFGTSSDHRYRWGSPPQHMNYPGYTGVSSSSSSTERPFTVRHGFPFAERQASLLGKYQHHVGSAPSSIHFNTQMNCYTGSPEIPLGFSDMGINRNYNSAHGKANLGVSLPGNSSEQDFTGFGMSSMPTVPFGGSRGLQSVRPEPFAEQGRIHNHESHNQNQFIDGGRYHIDLDRIASGDEIRTTLIIKNIPNKYTYKMLVAEIDEKHKGDYDFLCLPTDFKNKCNMGHAFINMVSPLHIVPFQQTFNGKIWEKFNSGKVASLAYAEIQGKSALASYMQTPSSMKEQKQLFPEVSYHDDGQDANDHEQLFSSIWNITAPDSDWSYTMDLIENPRENGNSKNAAEESS

SEQ ID NO: 84029 - protein, 277 aa, Salmonella bongori
QKRSDIEIVAINDLLDAEYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDTYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAMKAASEGAMKGVLGYTEDDVVSTDFNGEVCTSVFDAKAG

SEQ ID NO: 84030 - protein, 174 aa, Zea mays
MVKHYRPPGKKKEGNAAKFVIRSQAIKQLQISLPLFRKLCILKGVTPREPKKKFKGTHQTYYHVKDVSFLHHEPLVEIHRAIRVHERKIKKAEAKKNHERANRLRQKTPKPKIDRIIRQRYPRFVDALGELDDCLTMVHLFAALPASESKKIDVECVHKCRRLAHEWQAFVSRT

SEQ ID NO: 84031 - protein, 207 aa, Candida albicans SC5314
MISMTNIFTPIEEALEAYKNGEFLIVMDDEDRENEGDLIMAAELITQEKMAFLVRYSSGYVCVPLSEERANQLELPPMLANRSDRHGTAYTITCDFAEGTTTGISAHDRALTTRSLANPNSKPQDFIKPGHILPLRAVPGLLKKRRGHTEAAVQLSTLAGLQPAGVICELVRDEDGLMMRLDDCIQFGKKHGIKIININQLVEYISK

SEQ ID NO: 84032 - protein, 333 aa, Caulobacter crescentus CB15
MHLARFPRARFAHLPTPLEPMPRLGAELGIDLWVKRDDCTGLAGGGNKTRKLEFLLGEALIQGADTLVTQGAVQSNHVRQTIAAGARFGLKTEVILEERTGSKASDYMGNGNVLLDKLMGASLRYVPGGTDMVAELDSTAENVRQRGGKPYVIPGGGSNTVGALGYVDCARELVVQADQMDLKIDRLVTATGSAGTHAGLVAGFAALSVDIPILGFGVRAPKPKQEENVYNLAVATAETIGAGGRVRREAVVADCDYVGEGYGLVDQGVIDALALAARTEGLLLDPVYSGKAMKGLIDQARKGAFKGERVVFLHTGGAQGLFGYQTVLEPALG

SEQ ID NO: 84033 - protein, 75 aa, Glycine max
  misc_feature (14)..(14): Xaa can be any naturally occurring amino acid
APPPFAGAAHLGGXALKYSKAPHGVVLATGFGAITGAVLGSEVAEHWYQFYKMDKQGANLRFIYWWEDKVSGQKS

SEQ ID NO: 84034 - protein, 92 aa, Triticum aestivum
  misc_feature (39)..(39): Xaa can be any naturally occurring amino acid
  misc_feature (43)..(44): Xaa can be any naturally occurring amino acid
  misc_feature (46)..(46): Xaa can be any naturally occurring amino acid
  misc_feature (48)..(48): Xaa can be any naturally occurring amino acid
  misc_feature (50)..(50): Xaa can be any naturally occurring amino acid
  misc_feature (52)..(52): Xaa can be any naturally occurring amino acid
  misc_feature (57)..(57): Xaa can be any naturally occurring amino acid
  misc_feature (62)..(63): Xaa can be any naturally occurring amino acid
  misc_feature (65)..(65): Xaa can be any naturally occurring amino acid
  misc_feature (67)..(68): Xaa can be any naturally occurring amino acid
  misc_feature (73)..(73): Xaa can be any naturally occurring amino acid
  misc_feature (75)..(76): Xaa can be any naturally occurring amino acid
  misc_feature (78)..(79): Xaa can be any naturally occurring amino acid
  misc_feature (84)..(85): Xaa can be any naturally occurring amino acid
  misc_feature (90)..(90): Xaa can be any naturally occurring amino acid
SIGWSVGALLGYAQGASDKRVIACIGDGSFQVTAQDVSXCCGXXKXAXIXLXKNGGXTIEVXXHXGXXNVIKXWXXTXXVEAIXXGEEKXWT

SEQ ID NO: 84035 - protein, 426 aa, Xanthomonas axonopodis pv. citri str. 306
MTLWVLGLNHQTAPVDLRERAAFAGDALPRALESLRALPQVSEAALLSTCNRTELYAMAEEAHSLVNWLETHAPGLSGYLYQHQEAEAVRHLFRVATGLDSMVLGEPQILGQVKDAWAVARAHGALGSGLDRLFQQTFSVAKRARTDTRVGANPVSVASTAVRLAQDSFARLNESTVLLIGAGETIELAAKHLSEGRVRRLLIANRTLAHAQTLASQHGGFALPLTDLERHLAEADVVFSATAAREPLVTRVQVEQALRARKRKPMLLFDLAVPRDIEASVGELSDAYLYTVDDLERAVEDNRRGRREAADQAEAIIDLQVARYVETLQATAHQAPLKRLRAFGDSTRDELLAKARQQLHNGKPADEVLEQLAHALTNRLLHPPTAALRDAALNNDLELTAAADRLFPEKPGYQHPPHSYPDREDR

SEQ ID NO: 84036 - protein, 311 aa, Xanthomonas axonopodis pv. citri str. 306
MFSGNANKPLAQSICKELGVRMGKALVTRFSDGEVQVEIEESVRRQEVFVIQPTCAPSAENLMELLVLIDALKRASAQSVTAVIPYFGYSRQDRRMRSSRVPITAKVAAKMICAMEADRVLTVDLHADQIQGFFDVPVDNVYASPLLLADIWRAYGTDNLIVVSPDVGGVVRARAVAKRLDDADLAIIDKRRPRANVATVMNIIGDVQGKTCVLVDDLVDTAGTLCAAAAALKQRGALKVVAYITHPVLSGPAVDNINNSQLDELVVTDTIPLSEAARTCAKIRQLSVAELLAETIRRIAFGESVSSLYVD

SEQ ID NO: 84037 - protein, 1214 aa, Nicotiana tabacum
MKPHNSAMYQHHFSLNKIFLLSFSLQPLFILLLIIFFLPPASPASVNGLFKDSQQLLSFKSSLPNTQTQLQNWLSSTDPCSFTGVSCKNSRVSSIDLTNTFLSVDFTLVSSYLLGLSNLESLVLKNANLSGSLTSAAKSQCGVSLNSIDLAENTISGPVSDISSFGACSNLKSLNLSKNLMDPPSKELKASTFSLQDLDLSFNNISGQNLFPWLSSMRFVELEYFSVKGNKLAGNIPELDFTNLSYLDLSANNFSTGFPSFKDCSNLEHLDLSSNKFYGDIGASLSSCGKLSFLNLTNNQFVGLVPKLPSESLQFLYLRGNDFQGVFPSQLADLCKTLVELDLSFNNFSGLVPENLGACSSLEFLDISNNNFSGKLPVDTLLKLSNLKTMVLSFNNFIGGLPESFSNLLKLETLDVSSNNITGFIPSGICKDPMSSLKVLYLQNNWFTGPIPDSLSNCSQLVSLDLSFNYLTGKIPSSLGSLSKLKDLILWLNQLSGEIPQELMYLKSLENLILDFNDLTGSIPASLSNCTNLNWISMSNNLLSGEIPASLGGLPNLAILKLGNNSISGNIPAELGNCQSLIWLDLNTNFLNGSIPGPLFKQSGNIAVALLTGKRYVYIKNDGSKECHGAGNLLEFGGIRQEQLDRISTRHPCNFTRVYRGITQPTFNHNGSMIFLDLSYNKLEGGIPKELGSMYYLSILNLGHNDFSGVIPQELGGLKNVAILDLSYNRLNGSIPNSLTSLTLLGELDLSNNNLTGPIPESAPFDTFPDYRFANTSLCGYPLQPCGSVGNSNSSQHQKSHRKQASLAGSVAMGLLFSLFCIFGLIIVAIETKKRRKKKEAALEAYMDGHSNSVTANSAWKFTSAREALSINLAAFEKPLRKLTFADLLEATNGFHNDSLIGSGGFGDVYKAQLKDGSVVAIKKLIHVSGQGDREFTAEMETIGKIKHRNLVPLLGYCKVGEERLLVYEYMKYGSLEDVLHDRKKNGIKLNWHARRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGRTPTDSVDFGDNNIVGWVRQHAKLKISDVFDRELLKEDPSIEIELLQHFKVACACLDDRHWKRPTMIQVMAMFKEIQAGSGIDSSSTIAADDVNFSAVEGGIEMGISESIKEGNELSKHL

SEQ ID NO: 84038 - protein, 629 aa, Solanum peruvianum
MVKVMEKDTVVVSLVVWLILVVHHLKLIYANMEGDALHSLRVNLQDPNNVLQSWDPTLVNPCTWFHVTCNNDNSVIRVDLGNAALSGLLVPQLGLLKNLQYLELYSNNISGVIPSDLGNLTNLVSLDLYLNNFVGPIPDSLGKLSKLRFLRLNNNSLTGNIPMSLTNISSLQVLDLSNNRLSGAVPDNGSFSLFTPISFANNLDLCGPVTGRPCPGSPPFSPPPPFVPPPPISAPGGNGATGAIAGGVAAGAALLFAAPAIAFAWWRRRKPQEYFFDVPAEEDPEVHLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPSEPPLDWPTRKRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLQNKYVEAEVEQLIQVALLCTQSNPMDRPKMSEVVRMLEGDGLAERWDEWQKVEVLRQEVELAPHPGSDWLVDSTENLHAVELSGPR

SEQ ID NO: 84039 - protein, 232 aa, Brassica napus
MVGMAVVGQWTLCVASPSPRVKSATCNSNSCPTTVNLRSELSAFRPQFRLFSRVSPTRRRRLCASSSADSGIFLPHLVASMEQVEETYIMVKPDGIQRGLVGEIISRFEKKGFKLIGLKMFQCPKELAQEHYKDLSAKSFFPSLIEYITSGPVVCMAWEGVGVVASARKLIGKTDPLQAEPGTIRGDLAVQTGRNIVHGSDSPENGKREIALWFKEGELCEWDSVLAKWLRE

SEQ ID NO: 84040 - protein, 597 aa, Solanum peruvianum
MTTLTTSNNILLSKQAIFIIIVMLLLIIFLILIACKYKPWRFFYSHPVSSNCVFRNKNTIKGEDIERPLISDDLHLVESQSHEYSRGYAHDAGSHQNQGAYGSPWTQGLVHKQRINPQLTHTDSFVLDVCDTSEDISIGQTLKRPLVFNQLAEEQKHIRPEDVKYRPNLAIQNEKFGDFAPKDTKDQRSILMLEVISGPCQGLQHSMQSTDTSRLPLTLGRVTPSDILVMDSEVSGKHAMINWNINKLRWELVDMGSLNGTLVNSNAVHNPHSGSRQWGDPIELANGDIITLGTTSRIFVHIRSQNDQVPFGIGIASDAMAVRRGGKKLPMEDVCYYHWPLPGIDKFGLFGICDGHGGADAAVSVSKIMPQMVASILSDSYRRERVLSQSDASDVLREAFSQTEASIDHHYEGCTATVLLVWADGDGNFYAQCANVGDSACVVNIDGKQTKMTEDHRITSHSERLRIQATGEPLKDGETRLCGLNLARMLGDKFLKQQDVRFSSEPYISQVVYIHQASKGFALLASDGFWDVINVKKAIQLVQQAKERISTEEEISAEKIANSLLSEARTLRTKDNTSIIFLDFENAHRILSCKLDS

SEQ ID NO: 84041 - protein, 371 aa, Alkalilimnicola ehrlichei MLHE-1
MAFNSIDEIIEDLREGRMAVILDDEDRENEGDLVMAASMVRPDDINFMARYGRGLICLTLTRERCEQLRLPLMVQDTEQAQSTNFTVSIEAATGVTTGISAADRARTVQAAVAPHAKPEDLVQPGHIFPLMAQPGGVLTRAGHTEAGCDLARLAGFEPSAVIVEILKEDGTMARRDDLMAFAREHNLKIGTVADLIAYRVRNERSVERVGECDLPTEHGIFHLYAYQDNVDNALHFALVKGRPQPDTPTLVRVHVQNTLSDVFASDGPHCGWPLRAAMRQVAEAGEGVVVVLRRRDDSDDILKRMRAYQVQASQADESEEARSSSDLRTYGLGAQILTDVGVRRMRVLSAPKRMHAISGFGMEVVEYVEPE

SEQ ID NO: 84042 - protein, 239 aa, Debaryomyces hansenii CBS767
MSSGASLVEKAKKSAAYQAVDENFPEGAKVVGVGSGSTVIYVAERISQLKNKESFVCVPTGFQSKQLIIDAGLRLGTIEQYPEVDIAFDGADEVDTELNLIKGGGACLFQEKLVAAAASKFVIVADFRKRSPSKLGIQWRKGVPIEIVPCAYAKVSKDLEAMGAKKVELRQGGSAKAGPVVTDNNNFLIDADFGEIEDPAKLHTDIKQLVGVVETGLFVQMAYKTYFGEESGEVKCWSK

SEQ ID NO: 84043 - protein, 165 aa, Azoarcus sp. EbN1
MKAPFRIGQGFDVHALVPGRALIVGGVHIPFERGLLGHSDADVLLHALTDALLGAAGLGDIGRLFPDTDAAHAGADSRVLLREAFAAVRAAGFGVVNVDATVICRAPRILPHAPAMVANIAADLGIDAAAVNIKGKTTEKLGFTGRGEGIAAQVVALLMRHGDET

SEQ ID NO: 84044 - protein, 540 aa, Azoarcus sp. EbN1
MNLSQALLTALRDHGAREIFGIPGDFALPFFKIIEESGILPLHTLSHEPGVGFAADATARYRCCLGVAAVTYGAGALNMVNPVAGAYAEKSPVVVISGAPGAGESHSGLLLHHQAKTLDSQFEIYREITCDQARLTDARSAPREIARVLASCLRESRPVYIELPRDMVGVPCEPVIPLVPPASDREVLSACVDEILVRLRSAASPVLMVGVEVRRFGLEAKAAELARRLGVPVVTSILGRGLLAGTDAPLVGTYLGVAGQQQVTDLVEQSDALLLLGVIISDTNFGVSSKQIDLRKTIQALDRRVTLGYHTYPEVPLAALVDALLERLDKKIAPAMRFDPPHYPRGLQADDASITPNDIALAINDLMDTHGRMPIAADVGDCLFTAMDIEPTALVAPGYYATMGFGVPAGLGLQAASGVRPLILVGDGAFQMTGWELGNCRRYGWDPIVIVFNNSSWEMLRTFQPESAFNNLDDWRFAAMADGLGGDGARVGTRAELKAALDHALATRGRFQLIEAIIPRGVLSDTLSRFVAGVKRLSQK

SEQ ID NO: 84045 - protein, 473 aa, Glycine max
MSVQDYLDKHMLSRKLEDAVNAAVRAKTSDPVLFISNHMRKAVQSVITKIKARQILDSRGIPTVEVDLHTNKGVFRASVPSGNSTSMYEAVELRDGDKGVYLGNGVAKAVKNINDKISEALIGMDPTLQSQIDQAMIDLDKTEKKGELGANAILAVSIAACKAGAAEKEVPLYKHIADLSGKTSPTLPVPAFTVISGGKHAGSNLAIQEIMILPIGASKFEEALRMGTETYHHLKAVITEKYGAHNCNVGEDGGFAPNISSFREALDLVKEAISRAGYDEKIKIALDVAATDFCIGKRYDLDFQSPQKSGQNFKSAEDMIDLYKELCSEYPIVSIEDPFDKEDWEHIKHISSLGICQVVGDDLLMSNAKRIERAITESACNALLLKVNQVGTITEVIEVVKLAKEAHWGVVTSHRCGETIDSFIADLSVGLASGVIKAGAPCRGERLEKYNQLLRIEEELGDQAVYAGEDWRQ

SEQ ID NO: 84046 - protein, 284 aa, Oceanicola granulosus HTCC2516
MTGKIAFQGQLGAYGHQACLEAHPDLEPLPCPTFEQAIESVRKGDAELGMIAIENSTYGRVADVHHLLPESGLHIVDEHFLRVHISVLGVPGAQLSDLRRVRSMSILLGQCRGFIREHGLDTLSWTDNARAAQDVAELGDPSEGALASELAAQIYGLNVLARHVEDHDRNTTRFLIMSREPDFNRRGHGPMITSFIFRVRNIPAALYKAMGGFATNGVNMTKLESYMVDGNFSATQFYAEVEGHPDDRSLQLALEELDYFTDRIRLMGVFPADRRRYERRGSGD

SEQ ID NO: 84047 - protein, 342 aa, Azoarcus sp. EbN1
MSSSLRIAINGYGRIGRCFLRALYESPLKNTLQIVSINEPADLATIAYLSRFDSTHGVFPGKIEIGADCLIVDGRKIGVTHACVPEEVDWKGIGVDLLIECSGCYTQRQDFDRFVEAGCERLLISQPGRSAQDVDLTVVYGINHGELGRDQRIVSNASCTTNAVVPVLDQLHRAFGIGHVFLTTLHSVMNDQPLIDGYHHSDLRRTRSAMQSMIPVGTGLAQGVERFLPQLAGRVQAKAIRVPILNVSAIDVVVELGCDATAREINLLLSEAAAAQPGLIAYSVDPHASIDFSHNPHSVIVDGSQTRINGPRFANLLLWFDNEWGYANRMLDVANYWSKRFR

SEQ ID NO: 84048 - protein, 156 aa, Oceanicola granulosus HTCC2516
MRIAICAVGRLRAGPERTLIDDYLTRFDRTGRALGLGPARVLEVEDRKGGGREAEAALLDKAAPAGAVRIALDEHGRTLTSPDFAARLGAWRDEGRGEAAFLIGGADGLGGGLAEGADLRLSLGQMVWPHMLARLMLAEQLYRAATILAGSPYHRV

SEQ ID NO: 84049 - protein, 482 aa, Physcomitrella patens subsp. patens
GKLTVCVLQHVTEDVRDVYTLGKKLGAGNFGITYLCTEKSTGDDYACKTISKKKLKSKDDVADVRKELQIMHHLSGHPNIVAIKGAFEDEASVHFVMELCAGGELFTRITEKGHYSEAAAASAMRTIVSVIETCHILGVIHRDLKPENFLLLNKREDSPLKATDFGLSTFFKPGEVCKDVVGSAFYVAPEVLRRKYGPESDIWSAGVILYILLSGVPPFWADTEDGIFAEVLKAKVDFDTDPWPKISKDAKDLIRKILNPDVKARLTASEVLAHPWVREKGVASTKPMDSSVQNRLKRFAAMNKMKKLAVRVIAQSMSEEEIAGLRNIFKIMDVDGSGTITFEELKQGLQKVGSNMREADVRDLMDAADVDKNGTIDYGEFLAATINMNKVEREENMLAAFRYLDKDNSGYITGEELQNACAEFNMGEMNLEDLMRDVDLDNDGRIDYQEFVAMMRKGTGTAPPQRGARMEPSFGFSAALQL

SEQ ID NO: 84050 - protein, 136 aa, Euglena gracilis
MSTTTPPPAKGGKDKKGAKAGVKKGKTGGSGQSKKAGLTFPVGRTGSLLRAGRYAKRVGKGAPVYLAAVLEYLSAELLELAGNASRDNKKKRITPRFLTLAVRNDEELNKLLSGVTIASGGVLPNIQQVLLKKKGK

SEQ ID NO: 84051 - protein, 853 aa, Serratia sp.
MKFGFIAHPTSVGLKRYVKMIDLLQRNSTELHSGYKRDLWRRENLVPFMNFAKITSATGATCEGVIKYMPLVADEMLADARGIANRVVSGIEELVEDGAELVGLGGFTSIVGRRGEATAEKSPVPVTSGNSLTTYAGYKALMQIQSWLDIQPEQEPVAIVGYPGSICLALSRLLLAQGFSLHLLHRAGHKDEDELLSHLPEQYRSRVTLTSDPEDLYPRCKLFVAATSAGGVIDPYKLQPGSVFIDVALPRDINSDTRPDRDDILIIDGGCVTATDAVKLGGESLNVTIKQQLNGCMAETIVLALENRRENFSLGRYLALDNVLEIGELAEKHGFLVYPLASYGERIDRQRVINLKRYYHHDIYSDEPDTEQPPASQLAFIDAIIAQDPAREDTLDRYHQFINPMMVEFLKLQHCDNVFRRASGTQLFTADGEAFLDMVAGYGCINLGHNPQPIIDALKAYLDAQGPNFIQYISIPEQAAKLAEVLCHFAPGNMGRVFFSNSGTEAVEAAMKLAKASTGKAGIAYLKNSYHGKTLGALSITGREKHRRHFKPLLASMIEVPFADIEALRQTLSRDDIGALMIEPIQGEGGVHVPPPGYLRTVQEICRQTDTLLMVDEVQTGLGRTGKLFACEWEGIEPDVLMLSKSLSGGVMPIGATLCRAIFGNGPYGTADRFLMHSSTFGGGNIAAVVALSALREILAQDLVGNAERLGTYFKQALTDVAARYPFVAEIAGRGLMLGIQFDQTFAGAVGASAREFATRLPGDWHTTWKFLPDPVQAHLKAAMERMEQSLGEMFCMKFVTKLCQDHNILTFITANSSTVIRIQPPLTISKAEIDRFVSAFATVCDELSTFLE

SEQ ID NO: 84052 - protein, 343 aa, Listeria monocytogenes str. 1/2a F6854
MKAVVKTNPGYDQMELKDVEEPQVYGDKVKIKVAFTGICGSDIHTFKGEYKNPTTPVTLGHEFSGVVVEVGPDVTSIKVGDRVTSETTFETCGECIYCKEHDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTGGYGAERVFDCSGAVPAVNQGLPLTKKKGDFVQVGLFAEKKNAIDEESIIQREIAYIGSRSQKPSSWILALDLLANGKINTDKMITKVYGLDDWREAFEAVMAGNEIKVLVKS

SEQ ID NO: 84053 - protein, 157 aa, Pasteuria nishizawae str. North American
MHALADGLPLILGGVHVPHSQGLVGHSDADVLLHAITDALLGALALGDLGTHFPPTDPAYRDCDSFLLLRHVQRLVTENRYSIMNIDSTIVAEAPLLRSFIDPMRRGIANHLNLPVGRVGVKATTTERLGFVGRREGIAAEAVVLLVAGTVQKEGDG

SEQ ID NO: 84054 - protein, 478 aa, Streptomyces avermitilis MA-4680
MENMNTPDVIVIGGGTGGYSAALRAAALGLTVVLAERDKVGGTCLHRGCIPSKAMLHAAELVDGIAEARERWGVKATLDDIDWPALVATRDDIVTRNHRGVEAHLAHARVRVVRGSARLTGPRSVRVEGAPDDLPGGAGDFTARRGIVLATGSRPRTLPGLVPDGRRVVTSDDALFAPGLPRSVLVLGGGAIGVEYASFHRSMGAEVTLVEAADRIVPLEDVDVSRHLTRGLKKRGIDVRAGARLLDAELLEAGVRARVRTVRGEIRTLEAERLLVAVGRAPVTDGLDLAAAGLATDERGFVTPSDWDRLETAVPGIHVVGDLLPPPSLGLAHASFAEGLSVAETLAGLPSAPVDYAAVPRVTYSSPQTASVGLGEAEARARGHEVDVNTMPLTAVAKGMVHGRGGMVKVVAEEGGGQVLGVHLVGPHVSEMIAESQLIVGWDAQPSDVARHIHAHPTLSEAVGETFLTLAGRGLHQQ

SEQ ID NO: 84055 - protein, 126 aa, Brassica napus
MSEETASSPSLTKKKSLGWMEWMRGWSSVFGEILFQRITASHLQNPLPLPPVNDLTCIVTGSTSGIGRETARQLAEAGAHVVMAVRNTKAAQELIQQWQNEWSGRGLPLNIEAMELDLLSLDSVAR

SEQ ID NO: 84056 - protein, 107 aa, Zea mays
PKKTPCLGFRGARLGLWTPEWPGFQARAILEAVLAMTNQGVQGFPEIMVPFVGTPQELGHKGTFIRQVAEKGFANGGKTFGSKVGTMIEIPRAVLVADEIADQAEFF

SEQ ID NO: 84057 - protein, 461 aa, Opitutaceae bacterium TAV2
MHTKQINRLPNPMTPDTATYLDALRTQVRHAPAMRRLGRVAAVTGLIIESEGPNVGLGDICVIRSERDAFEVMAEVVGFRGERVLLMPLGETTGLHAGCSVSAGDRPPIPVSGAQLLGRVLDALGRPFDGAGPVPTRRVDAVHSRPPHPLRRQRIREALPTGVRALDAFTPLGRGQRLGLFAGSGVGKSTLLGMIARGSAADVVVIGLVGERGREVREFLEKDLGAEGLARSVVVVATSDSPAPLRLRAAFTATAIAESYRDQGKNVLLLMDSVTRFAMAQREIGLAIGEPPATRGYTPSVFALLPRLLERAGAGETGAITALYTVLVEGDDMNEPIADAVRGILDGHLVLSRALAHANHYPAIDVLESVSRLTRDICSATEVESAARARELLAIYKRNEDLITIGAYQKGASAALDRAVTLHEPLKQFLRQRVDEIVARADVFNRLAEVMGREERREVMA

SEQ ID NO: 84058 - protein, 363 aa, Xanthomonas axonopodis pv. citri str. 306
MGIKCGIVGLPNVGKSTLFNALTKAGIAAANFPFCTIEPNVGIVPVPDPRLNQLADIVKPQKLIPTAVEFVDIAGLVAGAASGEGLGNKFLAHIREVDAITHVVRCFENDDVIHVNNKVDPIADIETIDTELALADLDSVEKALNRAERSAKGGDKDAAARKPVLAKLQAALADGKAGRAAGLDEEEKALVRDLFLLTLKPVLYIANVLEDGFENNPHLDAVRAHAAAEGAEVVPVSAAIEEELSQLDDTDRDSFLADLGLEEPGLNRVIRAAYTLLGLQTYFTAGVKEVRAWTVKAGSTAPQAAAVIHTDFEKGFIRAETIGFDDFIKYRGETGARDAGRLRLEGKEYRVQEGDVLHFRFNV

SEQ ID NO: 84059 - protein, 570 aa, Lysinibacillus sphaericus
MTHLACIAASDGIAIAKAYRFVQPNLTFSQTTVQDVQAEQQRLAAALAKTEQELRPSKQQTLKKFSAEEAAIFEAHLLVVKDSELIGPINQKTADEGVNAEFALHEVSSMFVALFESMDDEYMSARASDIKDVTNRILAHLLGAHIPNPSSISEQVIIVANDLTPSETAQLDRNFVLGFITDIGGRTSHSAIMGRSLEIPAVVGTGVATTTIQDGDILIVDGLSGQVFVNPTADVIVSYQEKAQSYHTQQAEWSTLVNEQTVSKDGVHVELAANIGSPGDLEGVLRHGAEGIGLYRTEFLYMGRENLPSEDEQFTAYQTVLEGMQGKPVVIRTLDLGGDKHLPYLPLQEEMNPFLGHRAIRLCLEQQELFRTPLRALLRASVYGNLKIMFPIIATIQEFRDAKAILLEEQEKLKAAGEEVSADIEIGMMVEIPATAVMADVFAKEVDFFSIGTNDLIQYTMAADRMNEKVSYLYQPYNPAFLRLIQMVIHAAHQEQKWVGMCGEMAGDELAVPLLLGLGLDEFSMSATSILKTRSLLKRLSVKDMQALATEALQVATAEEVMEKVKQAVK

SEQ ID NO: 84060 - protein, 250 aa, Escherichia coli O157:H7 EDL933
MAVTKLVLVRHGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 84061 - protein, 382 aa, Escherichia coli O157:H7 EDL933
  misc_feature (2)..(2): Xaa can be any naturally occurring amino acid
  misc_feature (9)..(9): Xaa can be any naturally occurring amino acid
MXLKEKTQXLFANAFGYPATHTIQAPGRVNLIGEHTDYNDGFVLPCAIDYQTVISCAPRDDRKVRVMAADYENQLDEFSLDAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLVEIVKAVIGDKGGVRMTGGGFGGCIVALIPEELVPAVQQAVAEQYEAKTGIKETFYVCKPSQGAGQC

SEQ ID NO: 84062 - protein, 224 aa, Triticum aestivum
  misc_feature (23)..(23): Xaa can be any naturally occurring amino acid
MDSGDAWGRSSSTSSAAAAAARXLQSRYDLYMGFDDADAGGDEVEARGAEAYNCPFCGEDFDFVGLCCHIDDEHAVEAKSGVCPICATRVGADLIGHLTMQHGSYFKMQRRRRVRKVSSGSHSLLSLLRKDLRDGSLQSFLGGSSYVSNPPAAAPDPFLQSLICSLPVAEPSKDFRSDSSDKTFLLNKFPDEKIVERYVTSSFVLSAASLRFLFATMLLYLLSG

SEQ ID NO: 84063 - protein, 455 aa, Pectobacterium atrosepticum
MQTQSSSFPLLDQWVARQRQHLAGYAPVEKKGRVMAVSGILLECSLPQARIGDLCWVARQDDSQMMAEIVGFSPDNTFLSALGALDGIAQGATVTPLYQPHRIQVSERLLGSVLDGFGRALEDGGESAFVEPGQVTGRTQPVLGDAPPPTSRPRISQPLPTGLRAVDGLLTIGQGQRVGIFAGAGCGKTTLLAELARNTPCDTIVFGLIGERGRELREFLDHELDDELRSRTVLVCSTSDRSSMERARAAFTATAIAEAYRAEGRQVLLILDSLTRFARAQREIGLALGEPQGRGGLPPSVYTLLPRLVERAGQTEDGAITALYSVLIEQDSMNDPVADEVRSLIDGHIVLARRLAEQGHYPAIDVLASLSRTMSNVVDTDHTRNAGGVRRLMAAYKQVEMLIRLGEYQPGHDELTDSAVNAHSEITQFLRQSMREPMPYGVIQQQLAGVSRYAP

SEQ ID NO: 84064 - protein, 243 aa, Glycine max
MALTSCLKTGVVPMSPTTGLYLSGSLLKSDSGFAVPTKLQSVRKSDRERLRIQAVFSFPPAFLTRNGRAEKQKQLKQDLLEAIEPLERGATASPDDQLRIDQLARKVEAVNPTKEPLKSDLLNGKWELIYTTSASILQAKKPKFLRSITNYQSINVDTLKVQNMETWPFFNSVTGDIRPLNSRKVAVQLKVFKILGLIPVNAPETARGELEITYVDEELRLSRGDKGNLFILKMFDPTYRIPL

SEQ ID NO: 84065 - protein, 338 aa, Escherichia coli O157:H7 EDL933
MRVLVTGGSGYIGSHTCVQLLQNGHDVIILDNLCNSKRSVLPVIERLGGKHPTFVEGDIRNEALMTEILHDHAIDTVIHFAGLKAVGESVQKPLEYYDNNVNGTLRLISAMRAANVKNFIFSSSATVYGDQPKIPYVESFPTGTPQSPYGKSKLMVEQILTDLQKAQPDWSIALLRYFNPVGAHPSGDMGEDPQGIPNNLMPYIAQVAVGRRDSLAIFGNDYPTEDGTGVRDYIHVMDLADGHVVAMEKLANKPGVHIYNLGAGVGSSVLDVVNAFSKACGKPVNYHFAPRREGDLPAYWADASKADRELNWRVTRTLDEMAQDTWHWQSRHPQGYPD

SEQ ID NO: 84066 - protein, 156 aa, Alkalilimnicola ehrlichei MLHE-1
MNIIEGDFQNPGSARFAIVAARFNDFVVGHLVEGAADALRRHGVPDDHIDLIRVPGSFELPLAVQQTAEAGRYSAVIALGAVIRGGTPHFEYVASECTKGVAATMMDTGLPIAFGVLTVDTIEQAIERSGTKAGNKGAEAALSALEMVSLMKKLAE

SEQ ID NO: 84067 - protein, 61 aa, Ehrlichia ruminantium str. Welgevonden
MGYRGYPKSICTSKNFVVCHGIPDDLPLKDGDILNIDVTVILDGWYGDTSKCVGSVNHQLK

SEQ ID NO: 84068 - protein, 468 aa, Methylobacillus flagellatus KT
MLAQLFRTKPVEIGHHSGLKKCLSAFDLALLGIGCAIGTGIFVLTGIAAAVYSGPAVVISFVIAGFAAAFAGFAYAELASSVGGSGSAYGYSYVAFGEFIAWVIAWILLLEYGVGAAAVANGWSGYFINTLANFGIAIPEAWTKAPSQGGIINLPAFGIIWLLVFILISGVKQSSTVNNIMVAIKLSTIAIFLAIAVGHINSDNWHPFMPFGWFSSQADGSNIGILAGASLVFFAYFGFDAVSTAADEARNPQRDLPIGLIASVTFCTLIYILVSGVLTGVVHYSDLNVSSPVAYALSKLGYSWSSSLVATGVLAGLITVLLVLLYGLTRILYAMSRDGLIPAAFSKVNPDRQSPTRVILFCGSIISIVAGFFPLGTLAETVNIGTLASFVMVCVGVIVLRKRQPDLHRPFKNPGGPIIPLLGIISCSALMAFLPGETWHRFLIWVGIGIIMYFAYSMHHSKLRQRNS

SEQ ID NO: 84069 - protein, 186 aa, Zea mays
  misc_feature (113)..(113): Xaa can be any naturally occurring amino acid
  misc_feature (145)..(145): Xaa can be any naturally occurring amino acid
MENSSHKRAREAGDLVAGGCGEEGSPQADAKRLRPQDLLDMLEDDTDAAAAGDLASVMRSLEEEIASFDEAAEAPAPAPELGFLLEASDDELGLPPASSSEEEEAGRAGAHEXAPALDGQIWGFEDEIVDGGCFGGYSPEAAAAXSAAAAAWDDDGFGAGLFAFGGDDACGPSDLAALRHETMPAV

SEQ ID NO: 84070 - protein, 196 aa, Oryza sativa Indica Group
MASSPYHAAVGVAVLAILLAAPAAEAGAPTAAPLANYSLEDACKKTGPHYGLCIATLSADRSAKSSDTVGLARVAVLAAQKNASETATYLSSIYDDDSIEKKTVQLQQCLEDCSERYEAAVEQLTDATVALDTGGYEEAMALVAAGQAEVKMCQRGFKAVPQHRNILTLRNREVDQLCSIAFTITKLIRVSPSAEE

SEQ ID NO: 84071 - protein, 300 aa, Azoarcus sp. EbN1
MEAPQNLSVELECALTAAAGISFSRAEVWTTSSGSISRALEIRAGEQRYFLKLNDAAALPMFEAEVDGLAALAACNAFRVPRVLASGATADEAFLLLEWLQLRPLASAEDGQRFAEALAKLHHDTGERFGWARDNFIGANPQTNVQHDGWARFFVRCRLTPQLQLARSRGHGGALGREADQLLERVPALFLDYRPRPSLLHGDLWSGNAAIDADGTPVIFDPAVYRGDREADLAMSELFGGFPTAFYAAYRTAWPLDEGYEQRKALYNLYHVLNHLNLFGRSYLGQAERMIRALVFELRR

SEQ ID NO: 84072 - protein, 147 aa, Physcomitrella patens subsp. patens
MRQLQQLSPSKPHINPSVLVIVIILSVVFFCSGVLHILARCLGRRRTRAPAGELHSPGNSIRGQLQHLFSMHDSGVEQVFIDTLPVFLYGSIRGLKDSADCAVCLNEFANEDKLRLLPKCKHAFHMECIDTWLLSNSTCPLCRRSLL

SEQ ID NO: 84073 - protein, 448 aa, Trichodesmium erythraeum IMS101
MNMNFKSSNPASSLALPPGDLGLPFIGQNKKIFKNPQNFIEEVYQKYGPVYKTNFLGKNFIYFQGYEAIKFILTNENKYFTYSQILRNYQRIFGENDITVLAGKEHRERQKILAKTIKSKNLNNYIDIIHDLSQSYFLKWIKSDYVDLYSEINNYTLDMILKLLLGIDYASKSEISNYLKDMSSGLNTIPVVFPWTKFGSALESKNKLFNQFEQIIVRRKKENNFGSDILGILLTVQEQMNYELTPREIVGQMVNLLSLGKKELSSALSSFFILTSEHLDVLKLLQIEQEKMDVSEPLSLDKYKKMVYLEQVIKEVLRLVPPVSGGLRKIIEDCSFQGFRIPKGWHAYYYISSVLKDPEIYKQPEIFNPERFNPTNAEDKKKPLCYIPFGGGARECIGKEFAYLVIKIFISALLDNCSWKFKENQDLTINTFPVARPAHKIEVCFTPK

SEQ ID NO: 84074 - protein, 145 aa, Listeria monocytogenes str. 4b F2365
MDESKKNERLQQLTDIQYNVTQKAGTERPFQNEFYDNEAKGIYVDIVSGKPLFSSNDQYDAGCGWPSFTKPIDEAEVIEHRDLTHGMIRTEVKSADADSHLGHVFPDGPQDKGGLRYCINSAALRFIPVDKLEEEGYQAYKKIFE

SEQ ID NO: 84075 - protein, 476 aa, Caulobacter crescentus CB15
MIRARRSRIVATLGPASSSFDMIVTLAKAGADVFRLNFSHGAHETHAAVYAAIREAEKVVNRPLGVLADLQGPKLRVGKFADGPVMLKAGQAFRFDSDPAPGDETRVHLPHPEILTAMRPGATLLLDDGKLRMTVTDAGPGYANTKVVNSGKLSERKGVAVPDVVIPMSPLTAKDREDLAFALRLGVDWVALSFVQAPEDMAELRRIVEGRAAVLAKIEKPQALKVLGPILDLCDGVMVARGDLGVEMAPEEVPVAQKEILRAARERGIPVIVATQMLESMTSSPTPTRAEASDVANAVYEGADAVMLSAESAAGDYPEESVSMMNRIIERVERDPKWPELMYAEQSHDDVDADVLVVAAAGAAKSGSTKCLVAFTTTGATARRLSRERPLQPVLALSPEISAVRRMCLVWGVEPRVSAQPDSLEVVTTDASSKALELGLVAPGERLLVVAGTPFGAPGAANLLRLAHAPAPARRR

SEQ ID NO: 84076 - protein, 108 aa, Brassica napus
MVGGGNRRDEGSMPIQNTNLFAALDTRRKKKKSDKSKGRQDPVKEPEPQAFWAPTPLKAKAGADIDSDDEDDDYFATTAPPKALWSTSEASRSDAKEVHVEVRKSISC

SEQ ID NO: 84077 - protein, 422 aa, Rubrobacter xylanophilus DSM 9941
MSHRSAPVEARERVAFAPCAARSFLRRLREEDGVPEAVLLSTCNRTELYVVAEAEPARDRLLGLLAEDRGVEPGSLYRDTYWHTDAEAVRHLYRVSASLDSMVVGEAQILGQVRDAYRMATEERCTGPVLNRLFHTALRVGKRVRAETGIGDSSLSVPHVAAKLAGEVFGSLEGRRALVLGAGEMSELLVRHLRDRGVAEIRIANRTRERAERLAALFGGRAADLGDLPRELARADIVVSSTGSGEWVIRGPEVAAALESREEPLFLIDIAVPRDVDPVVQSIEGAFLYDIDDLQAVVERNAEDRQEAAAAAEEMIGPAVVEFMSWLSTLHVAPLIKELRDGAERIRRHEVSRALRKMDLSPEQEEAVERMSRSIVNKLLHGPISEIKARAGAGDPLDSAEVRRRLLSLRGPGVELHPSREP

SEQ ID NO: 84078 - protein, 511 aa, Synechococcus sp. WH 5701
MPQRYIKKILDARVYDVAIETPLTEARSLSKRFGNNILLKREDLQPVFSFKIRGAYNRIAQLSEEQKAKGVICASAGNHAQGVALAAKNLGIKAVIVMPQTTPEIKVRSVRDHGAKVVLKGDAFDEAAAHAQELIAKHGYTYIPPYDDPDVIAGQGTVAMEIMWQFSKPIHAIFICVGGGGLIAGMAAYIKYLRPEIKVIGVEPEDSNCLQAAMKAGKRVVLDEVGIFADGVAVKQIGKYPWEICKDHVDEVITVSTDEICAAIKDVFEDTRSIAEPAGALGVAGIKKYIEREKVEGENLIATLSGANMNFDRLRYISERTEVGEKREAILAVTIPEKPGAFKTFINALHKRSITEFNYRYADATNATIFVGIQIAAGGHGREDLVQDLRESGYSVVDLTDSDLAKQHIRHMVGGHAPTITNEKVFQFEFPERPGALLKFLMSLGTRWNISMFHYRNHGAAYSRVLLGAQVDDDEVQDFEKMLDKVGFRYENMTDNEAYQLFLGQGNARSS

SEQ ID NO: 84079 - protein, 853 aa, Serratia marcescens
MKFGFIAHPTSLGLKRYVKMLDLLQRNSTEQHSGYTRELWERQNLVPFMNFARITSATGATCEGVIKYMPLVADEMLADARGIAARVVQGIEELAGDGAELVGLGGLTSIVGRRGEATAEKSPVPVTSGNSLTTYAGYKALMQIQSWLEISPEEEPVAIVGYPGSICLALSRLLLAHGFSLHLLHRAGNHDRSELLSHLPEEYHSRVTLTSDPEDLYPRCKLFAAATSAGGVIDPARLQPGSIFIDVALPRDIASETRPARDDILIIDGGCVTATDAVKLGGESLNVTIKQQLNGCMAETIVLALENRRENFSLGRYLAPEKVLEIGEIAERHGFFAYPLASYGERIDRQSVTNLKRYYHHDIYAGEPADAALPASRLAFIDAVIAQTPAREDTLDRYHQYINPMMVDFLKLQRCDNVFRSAAGTQLYDDAGEAFLDMVAGYGCLNLGHNPQPVVNALKNYLDAQGPNFIQYISIPEQTAKLAEVLCRLAPGNMGRVFFSNSGTEAVEAAMKIAKASTGKPGIAYLRNSYHGKTLGALSITGRDKHRRYFTPLLDAMVEVPFGDLAALREALNREDVGALMIEPIQGEGGVHIPPAGYLQAVQQLCRETGVLLMVDEVQTGLGRTGKLFACEWDGIEPDVLMLSKSLSGGLIPIGATLCRTELWQKAYGTADRFLVHSSTYGGGNLASVVALSALREILAQDLVGHAERMGAYFKQALSEIAARYPFVSEVRGRGLMLGIQFDQAFTGAVNASAREFATRLPGDWHTTWKFLPDPVQAHLRAAMDRMEQALGEMFCMKFVTKLCQDHKILTFITANSSTVIRIQPPLIISKAEIDRFVGAFATVCEELSTFLD

SEQ ID NO: 84080 - protein, 329 aa, Bartonella henselae str. Houston-1
MKKIAIGTLGGTIAMAADNLGQMQPILTSDILIKSVPDLDSVADIHAQTLIQIPSGSLSFKSLFEIIEWATQQIKAGAEGIVLTQGTDTVEETAFFLSLYWNKAEPLIVTGAMRLPHEAGADGPANILAATRVAAHPQSRNRGVLVVINDTIHSPYWVQKSHTIKIETFQSSPVGVLGIILEGKLIYFTDRNFFPTTFDLPKNYDHQVAILYSSLSSDTQLMKFCFESGHYAGVVIAGFGSGHCSFEEADIVRQYTQKMPIIIASRTYTGPTTRKTYGYKGSEVDMIASGALMSGYLSALKARLLLWAFLAQGLSLEQINAHWDDWTIS

SEQ ID NO: 84081 - protein, 476 aa, Methanosarcina barkeri str. Fusaro
MKMQINGKAVEACSGEFFDIINPATGELIDRVPKGTEDDAAIAVESASSAFNGWASTSPQQRARILYTAAGIVRQRKDELAVLLTREQGKPLAEAKNEIEGFAHVLEYYCGLASSFHGDFVPVPQNGYAFTVKKPLGVCTAIIPWNMPALIMAWKIGPAMISGNTLVLKPASNTPLTNLALASILSEAGLPPGVLNIVTGPGEVVGESLVKSPKVKKISFTGEVRTGKRIAELAAGGMKRVTLELGGSDPMLVCDDANLEAAVAGALRGRFYNCGQACTAVKRLFVFESVAERFIKKLEAGIRNLRVGNGLHENIDLGPLNNRRQWEYIKELVADAEEKDEGRIVAGGRVPEGSACSKGYFFEPTLIVDVDRKSRLLNEEVFGPVLPVVRVKDLDEAIEEANNTCYGLGASIWTKNLDRARIGCEQLNAGIIWLNQHLKVAPEVPFGGTRESGIGNENGPDALSEYLDLKTVMLKI

SEQ ID NO: 84082 - protein, 473 aa, Caulobacter crescentus CB15
MVLLGGAGDLALRMLLPSLYFLELDRLLPHDLRIIGVARADHDAASYKALVREQLGKRATVEEAVWNRLAARLDYVPANITSEEDTKKLAERIGAHGTLVIFFSLSPSLYGPACQALQAAGLTGPNTRLILEKPLGRDLESSKATNAAVAAVVDESQVFRIDHYLGKETVQNLTALRFANVLFEPLWDRNTIDHVQITIAETEKVGDRWPYYDEYGALRDMVQNHMLQLLCLVAMEAPSGFDPDAVRDEKVKVLRSLRPFTKETVAHDTVRGQYVAGVVEGGARAGYVEEVGKPTKTETFVAMKVAIDNWRWDGVPFFLRTGKNLPDRRTQIVVQFKPLPHNIFGPATDGELCANRLVIDLQPDEDISLTIMNKRPGLSDEGMRLQSLPLSLSFGQTGGRRRIAYEKLFVDAFRGDRTLFVRRDEVEQAWRFIDGVSAAWEEASIEPAHYAAGTWGPQSAQGLISPGGRAWKA

SEQ ID NO: 84083 - protein, 180 aa, Cryptomeria japonica
LQHTLTGHGDAVSSVEFSKDGLLVGSGSVDKSIRLWSSSTGTFERSLHGHTEGISDVAWSSDSRYICSASDDKTLKIWDVHTGDCVKTLKGHSNFVFTVNFNDHSNLIVSGGFDETVRIWDVKTGKCLRVIHAHTDPVTAADFNRDGSLIVSSSHDGSCKIWDASNGNCLKTLIDDKTPA

SEQ ID NO: 84084 - protein, 879 aa, Listeria monocytogenes str. 4b F2365
MRKFVYQFSEGSKEMKNILGGKGANLAEMTNIGLPVPPGFIISTDACNDYTANNKNLSEAIFEEVKIHLAELEKQTGKIFGFAENPLLVSVRSGAPFSMPGMMDTVLNLGLNDQAAEGLANLTGDARSAYDSYRRFIQMFGDVVFEIPSYQFEQALSRIKKANNYRLDTELTATDLSNLIDAYKLIFSQATGIDFPQDPLEQLRLAIIAVFDSWMNPRAVIYRRLHDIDASFGTAVNIQAMVFGNTGETSGTGITFTRNPSTGEKKVFGEFLLNAQGEDVVAGIRTPEPISALEERMPTVYKELLQTCELLENHYLDMQDIEFTIEKGKLYVLQTRSGKRTAKAAIQAAIDFVHEGKITRQEAIMRVETKQLNQLLHPTFLESALKNGQVIATGLPASPGAATGQIFFEAKEAVQAAERGIPVILVRNETSPEDIEGMARSNAILTAHGGMTSHAAVVARGMGKCCIAGCAELTINEKDKTIILPTGDTLHEGDALSLDGSSGKVYLGEIALREAKIGGHFDELMAWADAEKRLMIRVNADTPADFKKALLFGAEGIGLCRTEHMFFDEKRIPYVRQMILAELLNERESVLAILKEMQKADFNELFRIADGRSVNIRLLDPPLHEFLPTMKQEIEQLAGAMNRTVPQITNRINGLREANPMLGHRGCRLAITFPEIYRMQAEAIIESAIIVHNEGIDVHPEIMIPLIATKNELSYIKKELQQAVQAIFDREQVVIPYDIGTMIEIPRACVTADEIAEEAAFFSFGTNDLTQLTYGFSRDDATKFLADYYEKDILPKDPFVSIDKNGVGALVEMAVTRGRMTSEHLKMGVCGEHGGDPESIQFFHQLGLSYVSCSPYRVPIARLAAAQAALAEKQLVPTI

SEQ ID NO: 84085 - protein, 257 aa, Mycobacterium leprae
MAADIDLQGDRESELMHALATVRSRLAAASQAAGRNVGEIELLPISKFFPATDVAILSRLGCRSVGESRAQEASTKAAEFAELLGVSREEKSSIHWHMVGQIQRNKVRSLAQWAHTAHSIDSLQLVAALDRAVAAALAGGRREQPLQVYVQISLDGDISRGGVNVTAPGAVDRVCAQVEESKSLELVGLMGIPPLGWNPDQAFEQLRLEHRRVLRSHPDAIGLSAGMSNDFEIAVKHGSTCVRVGTALLGPSRLRSP

SEQ ID NO: 84086 - protein, 180 aa, Cryptomeria japonica
LQHTLTGHRDAVSSVEFSKDGLLVGSGSVDKSIRLWSSSTGTFERSLHGHTEGISDVAWSSDSRYICSASDDKTLKIWDVHTGDCVKTLKGHSNFVFTVNFNDHSNLIVSGGFDETVRIWDVKTGKCLRVIHAHTDPVTAADFNRDGSLIVSSSHDGSCKIWDASNGNCLKTLIDDKTPA

SEQ ID NO: 84087 - protein, 316 aa, Oryza sativa Indica Group
MASPMHARRAKLKSQLVSAKAKLKHHVTPRRLLLLSAAAASAFLLLLTLRTLSAAAANTSSPAPVVVHRSQQQQRDDQCDRVPAGVAEALVHYATSNATAWGRGRRRSAEEVAATARAVSRRAPCNLLVFGLGHGAALWAALNHGGRTVFLEEDDALVSGASPASLAIEAYRVAYLASAADADELLALRDSEHCTGAAATQLSPGHFDRSPCKLAVRGLPAAFYEAEWDVIVVDAHAPPPPTTTAMMGAIYTAAVAARARRPAAETETDVVVHDVDKPVQDRFSTAFLCGGYLKEEVGNLRRFAIPSHKEGMPFCP

SEQ ID NO: 84088 - protein, 477 aa, Escherichia coli O157:H7 EDL933
MNKKSLWKLILILAIPCIIGFMPAPAGLSELAWVLFGIYLAAIVGLVIKPFPEPVVLLIAVAASMVVVGNLSDGAFKTTAVLSGYSSGTTWLVFSAFTLSAAFVTTGLGKRIAYLLIGKIGNTTLGLGYVTVFLDLVLAPATPSNTARAGGIVLPIINSVAVALGSEPEKSPRRVGHYLMMSIYMVTKTTSYMFFTAMAGNILALKMINDILHLQISWGGWALAAGLPGIIMLLVTPLVIYTMYPPEIKKVDNKTIAKAGLAELGPMKIREKMLLGVFVLALLGWIFSKSLGVDESSVAIVVMATMLLLGIVTWEDVVKNKGGWNTLIWYGGIIGLSSLLSKVKFFEWLAEVFKNNLAFDGHGNVAFFVIIFLSIIVRYFFASGSAYIVAMLPVFAMLANVSGAPLMLTALALLFSNSYGGMVTHYGGAAGPVIFGVGYNDIKSWWLVGAVLTILTFLVHITLGVWWWNMLIGWNML

SEQ ID NO: 84089 - protein, 224 aa, Flavobacteria bacterium BBFL7
MQPEKQHNLKLLTMAIVGRQFPSIDVDAMNEMGDTFKLNVFEEAKNKNKKVLLFWYPKDFTFVCPTELHAFQAALEEFEKRNTVVIGASCDTPEVHFAWLNTAKDDGGIEGVTYPILADSNRNLANMLDILDVEQEYNDDLEGYILKGDNVTFRATYLIDEEGTVFHEGVNHMPVGRNVNEFLRMIDAYTHVQKNGEVCPANWEEGKDAMSADRKSTAAYLSQN

SEQ ID NO: 84090 - protein, 456 aa, Photorhabdus luminescens subsp. laumondii TTO1
METIRMSKHYDYIAIGGGSGGIASINRAAMYGQKCALIEAKALGGTCVNVGCVPKKVMWHAAQIAESIHQYGPDYGFDATINRFNWKTLIASRTAYIDRIHQSYGRGLGNNKVDVIQGFARFVDAHTVEVNGEKITADHILIATGGRPVWPDIPGAEYGIDSDGFFALEEMPKRVAVVGAGYIAVEIAGVLHALGSETHLFVRQHAPLRSFDPMIVETLLEVINTEGPTLHTESVPKSVSKNADGSLTLQLQNGKEQTVDTLIWAIGREPVTDNLNLSVAGVELNEKGYIRVDEYQNTNVKGIYAVGDNTGAVELTPVAVAAGRRLSERLFNNKPEEHLDYTNIPTVVFSHPPIGTVGLTEPQAKAQFGEEQVKTYQSSFTAMYTAVTQHRQPCRMKLVCVGPEEKIVGIHGIGFGMDEMLQGFAVALKMGATKKDFDNTVAIHPTAAEEFVTMRG

SEQ ID NO: 84091 - protein, 275 aa, Agrobacterium tumefaciens str. C58
MYDVSANGANIPALGFGTFRIPEDDVRRILPEALKLGFRHVDTAQIYKNEGAVGEVIAQSGISRHDIFLTTKVWVDRYRHDDFLASVDESLAKLKTDYFDLLLLHWPKSDVPLAERMGALNAVRKAGKARNIGISNFNVALTEEAVKLSDTPLATNQIEYHPYLDQTKVISAARKHGMSVTAYYLMADGKVPNDPVLKDIGAKHGKTAAQVTLRWAVQQPDIVALSKTATESRLKENFDIFDFALSEEEMQAIHALAKPNGRIVSPGHLAPDWDD

SEQ ID NO: 84092 - protein, 88 aa, Glycine max
  misc_feature (34)..(34): Xaa can be any naturally occurring amino acid
MPEEDLVDIKFRLYHGSDIRSFRYSSADNGRYAXKRIVSDWPKGKTVVPKSANEVKLISSGKILENNKTVGQCKVPFGETAGDHKGGL

SEQ ID NO: 84093 - protein, 184 aa, Physcomitrella patens
MSASKDGDPRIQYISDSIRTIPDFPHKGIMFRDVTTLLLDHKAFKDTIDIFVERYRDQKVDVIVGIEARGFIFGPPIALAIGAKFVPMRKPRKLPGPVIREEYSLEYGTDCIEMHVGAIEKNERVVIVDDLIATGGTLGAAIKLLDKVEAEIVECACLVELVDLKGREKLSGKPLYILVEYEGE

SEQ ID NO: 84094 - protein, 115 aa, Xylella fastidiosa Ann-1
MTAIVKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGLTRCSVFR

SEQ ID NO: 84095 - protein, 98 aa, Synechococcus sp.
ASYKVTLINEEMGLNETIEVPDDEYILDVAEEEGIDLPYSCRAGACSTCAGKIKEGEIDQSDQSFLDDDQIEAGYVLTCVAYPASDCTIITHQEEELY

SEQ ID NO: 84096 - protein, 483 aa, Arabidopsis thaliana
MIARRIWRSHRFLRPFSSSSVCSPPFRVPEYLSQSSSSPASRPFFVHPPTLMKWGGGSRSWFSNEAMATDSNSGLIDVPLAQTGEGIAECELLKWFVKEGDSVEEFQPLCEVQSDKATIEITSRFKGKVALISHSPGDIIKVGETLVRLAVEDSQDSLLTTDSSEIVTLGGSKQGTENLLGALSTPAVRNLAKDLGIDINVITGTGKDGRVLKEDVLRFSDQKGFVTDSVSSEHAVIGGDSVSTKASSNFEDKTVPLRGFSRAMVKTMTMATSVPHFHFVEEINCDSLVELKQFFKENNTDSTIKHTFLPTLIKSLSMALTKYPFVNSCFNAESLEIILKGSHNIGVAMATEHGLVVPNIKNVQSLSLLEITKELSRLQHLAANNKLNPEDVTGGTITLSNIGAIGGKFGSLLLNLPEVAIIALGRIEKVPKFSKEGTVYPASIMMVNIAADHRVLDGATVARFCCQWKEYVEKPELLMLQMR

SEQ ID NO: 84097 - protein, 484 aa, Agrobacterium tumefaciens str. C58
MHLNDPTLFCEKVPVAGRWIGCDDRETATIRNPATGKIVGQVPELGATETQAAITAAVIAQKAWARRTAGERAAILKAWHRLVMENRDDLGMILTLEQGKPLAEAKGEIAYGASFIEWFAEEARRINGETVPGHQADKRILVLRQPVGVVAAITPWNFPNAMITRKVGPALAAGCAVVLKPAPQTPFSAIALAILAERAGLPLELFSIVTGPAAEIGGVLTASPDIRLLTFTGSTRTGEHLYRQCAPTIKKLGLELGGNAPFIVFNDADLDAAVEGALIAKFRNNGQTCVCANRLYVQSGVYDAFAEKFARAVSGLKVGNGLEEGSILGPLIDGNAVAKVEAHIADALSKGAQIAAGGSRYALGGNFFEPTILRNVTADMQVAREETFGPLAPLFRFEDEEDVIAQANNTDFGLASYFYARDLSRVFRVAEALEYGMVGVNTGAISTAEAPFGGVKMSGLGREGSRHGIEEYTELKYVCIGNIL

SEQ ID NO: 84098 - protein, 2124 aa, Aspergillus oryzae
MGLNLEEIYGQNIIDEQKPNEYSEYQPKQGYGWANTLPERQGLYDPEYEKDACGVGFTAHIKGKPSHKIVSDARNLLCNMTHRGAVGSDARDGDGAGVMTSIPHKFFIKNFAREVGVDLPPLGQYAVGNLFFKPDQETLKDSTATFEELATSLGLRVLGWREVPHDSTILGPAALSREPIIMQPFVVLKSAYGDGNKPDNTDPGLFDERTFERQLYILRKRATHVLGLANWFYLCSLSNRNIVYKGQLAPVQVYQYYHDLVNVDYEGHFALVHSRFSTNTFPSWDRAQPLRWAAHNGEINTLRGNKNWMRAREGVLKSDIFGEELDSLYPVVEDGGSDSAAFDNVLELLMINGVLSLPEAVMLMIPEAWQGNPAVDPAKAAFYEWAACQMEPWDGPALFTFSDGRYCGANLDRNGLRPCRFYVMDDDRIICASEVGAVDIDPERVVQKGRLQPGKMLLVDTVAGRIIDDSELKYTVSHRQDFAAWLDKELLKLPAINEKLLQQNVDLSYTIDDTTVQNDPRLKAFGYSFEQVSLLLGPMAADSKEALGSMGNDAPLACIAQQPRLLYEYFRQLFAQVTNPPIDPIREAVVMSLECYVGPQGNLLEMDASQCHRLLLPSPILSIPEFTALKNINKAHNDWTVRTIDITFDKKKGVPGYLEALDAICDAATEAIQNGDKVLVLSDRATSAGRVPVSTLLATGLVHHHLVSNKWRALAALVVETAEAREVHHMCVLVGYGADAINPYLAMECILKMNREKLIRKQLPDDKVIENYKASCDGGILKVMSKMGISTLQSYKGAQIFEALGIDDSVIDRCFAGTASRIRGLTFELIAQDAFAFHERGYPSRSVIEIPGLPESGEYHWRDGGEEHVNDPVSIANMQDAVRTKNDKSYEAYAKAEHEQIKNCTLRGMLDFDFEQRTPITIDQVEPWTEIVRRFVTGAMSYGSISMESHSTIAIAMNRLGGKSNTGEGGEDPERSKRMENGDTMRSAIKQIASGRFGVTSHYLADADELQIKMAQGAKPGEGGELPGHKVVGPIAHTRYSTPGVGLISPPPHHDIYSIEDLKQLIYDLKCSNPRARVSVKLVSEVGVGIVASGVAKAKADHILISGHDGGTGASRWTGIKYAGLPWELGLAETHQTLVLNDLRGRVVVQTDGQLRTGRDLAIACLLGAEEFGFATTPLIAMGCIMMRKCHLNTCPVGIATQDPELRKKFSGTPEHVINFFYYVANEMRAIMAKLGIRTVNEMVGRAELLKTRDDIRTAKQERIDLSLILTPAHSLRPGVATYNVRKQDHRLHTRLDNKLIAESELALEKGLPCRIECDIVNTDRALGATLSYQVSRRFGGEGLPQDTIHANIKGSAGQSFGAYLAPGITLELEGDANDYVGKGLSGGRLIIYPPRGAAFKAEENIIVGNTCLYGATRGTCFFRGVAAERFAVRNSGATAVVEGVGDHGCEYMTGGRVLILGSIGRNFAAGMSGGIAYVLDMDQDFHSKVNMEMVEVSGLEDPTEVAFVRGLIEDHHHYTGSELAARILLDFTRALPHFVKVLPTDYKRVMEEEATRAEAAKKAEFTVPQLPSTSSTAEKLRAGDAKKAEMLDIEDSVNDSKTEKKRSALILDKTRGFMKYSRRSEKYRNPGTRTRDWAELSSRLTEDELKYQSARCMDCGVPFCQSDTGCPISNIIPKWNELVFQNQWQDALNRLLMTNNFPEFTGRVCPAPCEGACVLGINEDPVGIKSIECAIIDRGFEMGWMVPRPPKARTGKTVAIIGSGPAGLAAADQLNRAGHSVTVYERADRIGGLLMYGIPNMKLDKKVVQRRVDLMAAEGVRFVPNTAVGPDQEVSLDSLRRTNDAVIIATGATVARDLKVPGRELEGVHFAMQFLHRNTKSLLDSNLADGAYISAKGKHVVVIGGGDTGNDCIGTSVRHGAKSVTNFELLPQPPPERARDNPWPQWPRIYRVDYGHSEVKTHMGKDPREYCVMSTEFVDDGNGHVKGINTVRVEWTKSASGGWDMKTVEGSEQFFPADLVLLSMGFLGPEDRLLGDEIERDSRKNVKTPPGQYSSNVPGVFAAGDCRRGQSLIVWGINEGRQCAREVDAHLMDISSQLPVTGGIVRRPAIDAVRQCTEQPVSA

SEQ ID NO: 84099 - protein, 434 aa, Oryza sativa Indica Group
MADLDFFHTVQWRRAGVGRRWFATEASAASTAAELVDVPLAQTGEGIAECELLRWFVTEGDQVDEFQRLCEVQSDKATIEITSRFKGKVHQIHFGPGDIVKVALGFFFNLNRVDAANPSGEGSVPSGTLSTPAVRHLAKQYGLNISDIQGTGKDGRVLKEDVLSYAASKGLCKEPTSALEENIDQVELLEGRGSLPDANSYEDRRISLRGYQRSMVKSMTLAAKVPHFHYLEEINCDALVELKASFQNANKDHTIKHTFLPFLIKSLSKALSKYPLLNSCFVEETNEVIFKGSHNIGVAMATEHGLVVPNIKNVQSLSILEITKELSRLHEMASHNRLSTEDIAGGTITLSNIGAIGGKFGSPLLNLPEVAIIALGRIQKLPRFDDDENVYPSSIINVTVGADHRVVDGATVARFCNEWKSLVEKPELLLLHMR

SEQ ID NO: 84100 - protein, 171 aa, Larix laricina
APSKTGNSNVVSAFTGLKSMAQFPSSKTMSNAGAEWERKTTSNGARVRCMQVWPPYANKKWETLSYLPRLTPEQLVKEVEYLLKNKWVPCLEFEEDGEIKRVYGNSPGYYDGRYWVMWKLPMFGCTEASQVLNEVNECAKAYPNAYIRVIGFDNVRQVQCISFIVHKPEYN

SEQ ID NO: 84101 - protein, 465 aa, Glycine max
MSFHPNPNLNTAATTEPLNHMVLAMHLSDPKSKTLTLIPNSTLIILDRTLLLSDELLLRILSKLPDSSQQRNSNSLVCKRWLNLQGRLVRTLRVLDWSFVLSGRLINRFPNLNHVDLVPGSFTSSSVNTTTTIVVSHRLLSMHVDSAWRIGVEKNLLPVETVDAGLKSLASGCPNLRKLEVAGCSEVGISTIGAECATLQELELQRCDDAVLGGVAGCENLQILKIVGCVKGFYESVVSDIGLTILAQGCKRLVRLELVGCEGSFDGVKAIGQCCVMLEELVIVDHRMDDGWLAGVSYCENLKTLRVQSCKVIDGSPGLEEHLGCCEALERVHLHKCQVRDRNAVGALFSVCRNAREIVLQDCWGLDDATLSLAVVCRRVKLFYVEGCSLLTTEGLESVIEHWKELECLRVDSCKNIKDSDISPELATLFSTLKELKWRPDTKYLFESDVGVSMGKKGGKFFKRT

SEQ ID NO: 84102 - protein, 106 aa, Triticum aestivum
AGRVSEKNCNALLLKVNQIGTLTESIQAAKDSYADGWGVMVSHRSGETEDVTIADIAVGLRAGEIKTGAPARSERLAKLNQILRIEEELGDQAIYPGKDFRKSVNL

SEQ ID NO: 84103 - protein, 262 aa, Rhodopseudomonas palustris CGA009
MIHSALINVMVKAARRAGRSLKRDFGEIENLQVSLKGPANFVSRADKRAEEMLYEDLSKARPGYGFLGEEGGVREGADKSHRWIVDPLDGTTNFLHGIPHFAISIGLEREGTMIAGVIYNPANEELYIAERGKGAFLNDTRLRVANRRELHDCVIGCGLPHIGRGDFAQNQREMAALQPKVAGLRRFGTASLDLGAVAAGRFDGFWERNLSPWDIAAGIVMIREAGGTVGDINGGDVLKTGDIVCGNETIHAELARILKPLS

SEQ ID NO: 84104 - protein, 372 aa, Glycine max
FFITAWNCLLISIYLHENKIFSNATLLLTILPCSALNELTNNHGEWRYQGNGKVIPKSGSTGYTEWFLSKDHLQVGDVVRSRKPSNACRPQNMDIPEGTVVGLERNADHGFALVRVHGIHDPVKIHMSTLERVTFGLVAGDWVRLRDENEKHSLVGILHAVNRDGRVAVGFLGLQTLWNGNSSELEIAESYCIGQFVRLKDSLSSPRFEWRRKRGGASAAGRISWILPNGCLVVKFPGMLPFGNEPSTYLADPSEVEVVEFKTCPGMIEKYQHVEDHHWAIRPVLIAIGLFTALKLGISVGKKVRRNNKVTAIETETQYLDGQNQNAATSATTTTTTKKPSTSSATIPVSSMWVPAVANMIFKESVTSSNGR

SEQ ID NO: 84105 - protein, 500 aa, Oryza sativa Japonica Group
MAMMAMGAASWAPIPAPARAAAAFYPGRDLAAARRRRGAAARRPFVFTPRAVSDSRSSQTCLDPDASTSVLGIILGGGAGTRLYPLTKKRAKPAVPLGANYRLIDIPVSNCLNSNVSKIYVLTQFNSASLNGHLSRAYGNNIGGYKNEGFVEVLAAQQSPENPNWFQGTADAVRQYLWLFEEHNVMEFLILAGDHLYRMDYQKFIQAHRETNADITVAALPMDEERATAFGLMKIDDEGRIIEFAEKPKGEKLKSMMVDTTILGLDTERAKELPYIASMGIYVFSKDVMLKLLRQNFPAANDFGSEVIPGATEIGMRVQAYLYDGYWEDIGTIEAFYNANLGITKKPVPDFSFYDRSAAIYTQPRYLPPSKVLDADVTDSVIGEGCVIRHCTINHSVVGLRSCISEGAVIEDSLLMGADYYETETDKKALSETGGIPIGIGKNAHIRKAIIDKNARIGENVKIINVDNIQEASRETDGYFIKSGIVTVIKDALIPSGTVI

SEQ ID NO: 84106 - protein, 496 aa, Staphylococcus aureus subsp. aureus Mu50
MELLKHLSQRQYIDGEWVESTNKNTRDIINPYNQEVIFTVSEGTKEDAERAILAARRAFESGEWSQETAEKRGKKVRAIADKIKEHREALARLETLDTGKTLEESYADMDDIHNVFMYFAGLADKDGGEMIDSPIPDTESKIVKEPVGVVTQITPWNYPLLQASWKIAPALATGCSLVMKPSEITPLTTIRVFELMEEVGFPKGTINLILGAGSEVGDVMSGHKEVDLVSFTGGIETGKHIMKNAANNVTNIALELGGKNPNIIFDDADFELAVDQALNGGYFHAGQVCSAGSRILVQNSIKDKFEQALIDRVKKIKLGNGFDADTEMGPVISTEHRNKIESYMDVAKAEGATIAVGGKRPDRDDLKDGLFFEPTVITNCDTSMRIVQEEVFGPVVTVEGFETEQEAIQLANDSIYGLAGAVFSKDIGKAQRVANKLKLGTVWINDFHPYFAQAPWGGYKQSGIGRELGKEGLEEYLVSKHILTNTNPQLVNWFSK

SEQ ID NO: 84107 - protein, 475 aa, Ochrosphaera neapolitana
MVDVASKTGIISQIIGPVVDVEFSSGDLPKVYNAIVIDAGDKKVTCEVQQLLGNNKVRAVSMTSTDGLKRGASVLDTGSPITVPVGVPTLGRIFNVLGEPVDELGPCNAESGLPIHRPAPSFTELETKPSVFETGIKVVDLLAPYKRGGKIGLFGGAGVGKTVLIMELINNIAKAHGGVSVFGGVGERTREGNDLYAEMKESKVIDEDKLENSKVALVYGQMNEPPGARMRVGLTALTMAEYFRDVNKQDVLLFIDHIFRFVQAGSEVSALLGSMPSAVGYQPTLATEMGVLQERITSTNEGSITSIQAVYVPADDLTDPAPATTFAHLDATTVLSRGLASKGIYPAVDPLDSTSTMLQPEIVGTEHYATAQRIKETLQRYKELQDIIAILGLDELSEDDRLTVSRARKVERFLSQPFFVAEVFTGSPGKYVSLNDSIDGFNRLLNGEFDDLPEQSFYLVGDINEAIAKAAKLKG

SEQ ID NO: 84108 - protein, 344 aa, Rhodopseudomonas palustris CGA009
MNLADLNQIARAMVAPGKGILAADESSGTIKKRFDVIGVESTETNRRDYREMLFRSKEAMSDYVSGVILYDETIWQNAADGTPLVKLIEQAGSIPGIKVDEGTQPLPNCPGETITVGLDKLAERLAKYYKQGARFAKWRAVIDIDTARGVPSHTAIMTNAHALARYAALCQQAQIVPIVEPEVLMDGAHDIDTCYNITEWVLKETFQQLYFQRVALEGMILKPNMAVPGKKSAKKASVQEVAEKTVKLLKACVPSAVPGIAFLSGGQSDEEATAHLDAMNKIGGLPWGLTFSYGRALQAAPQKAWSGKAENVAAGQAAFTHRARMNSLAAKGEWSAELETKKAA

SEQ ID NO: 84109 - protein, 180 aa, Thujopsis dolabrata
LQHTLAGHGGAVSSVEFSKDGRLVGSGSVDKTIRLWSSSTGAFKRSLHGHTEGISDVAWSSDSRYICSASDDKTLKIWDVHTGDCVKTLKGHSNFVFTVNFNDHSNLIVSGSFDETVRIWDVKTGKCLRVIQAHTDPVTAADFNRDGSLIVSSSHGGSCKIWDASSGNCLKTLIDDKMPA

SEQ ID NO: 84110 - protein, 292 aa, Musa acuminata AAA Group
RHEAVILPVKFPQFFTGKRRPWRAFLLYGPPGTGKSYLAKAVATEADSTFFSISSSDLVSKWMGESEKLVANLFQMARENAPSIIFIDEIDSLCGQRGEGNESEASRRIKTELLVQMQGVGNNDEKVLVLAATNTPYALDQAIRRRFDKRIYIPLPDLKARQHMFKVHLGDTPHNLTEKDFEYLARRTEGFSGSDISVCVKDVLFEPVRKAQDATFFCKTSDGMWVPCGPKQPGAVQTTLQELAAKGLGAKILPPPITRNDFEKVLARQRPTVSKADLEVHERFTKEFGEEG

SEQ ID NO: 84111 - protein, 180 aa, Chamaecyparis formosensis
LQHTLVGHGGAVSSVEFSKDGRLVGSGSVDKTIRLWSSSTGAFGRSLHGHTEGISDVAWSSDSRYICSASDDKTLKIWDVHTGDCVKTLKGHSNFVFTVNFNDHSNLIVSGSFDETVRIWDVKTGKCLRIIPAHTDPVTAADFNRDGSLIVSSSHDGSCKIWDASSGNCLKTLIDDKTPA

SEQ ID NO: 84112 - protein, 180 aa, Chamaecyparis pisifera
LQHTLAGHGGAVSSVEFSKDGRLVGSGSVDKTIRLWSSSTGAFGRSLHGHTEGISDVAWSSDSRYICSASDDKTLKIWDVHTGDCVKTLKGHSNFVFTVNFNDHSNLIVSGSFDETVRIWDVKTGKCLRIIHAHTDPVTAADFNRDGSLIVSSSHDGSCKIWDASNGNCLKTLIDDKTPA

SEQ ID NO: 84113 - protein, 340 aa, Propionibacterium acnes KPA171202
MLAILPHLQDPPQPALTHGPTRSGGSGTTREPLTPTETQPARGGQQDTQDYKTTPPARRGQGGGSPPPHKLNPLEGVKGESSPPYNKTVLTTRATLDKHHADVASMFDGVAKRYDLMNQIMTLGAVDTWRDLVVDAVEPEPGQTILDLAAGTGTSSATFAARGAQVYPTDISTGMLAVGKQRQPHLHFVAGDATCLPYADNSFDAVTISYGLRNVEDPHQALREMLRVAKPGGRVVICEFSYPTWAPFRHVYTKYLLAAIPAMARLASSNRQAYDYLAESILTWPDQPHLADMMTETGWQAVAWRNICGGVVALHRGWKGSVSPRSGDHHGDPGEGDGLR

SEQ ID NO: 84114 - protein, 283 aa, Agrobacterium tumefaciens str. C58; identical to SEQ ID NO: 925

SEQ ID NO: 84115 - protein, 101 aa, Synechocystis sp. PCC 6803
MSIYVGNLSYDVSEADLTAVFAEYGSVKRVQLPTDRETGRMRGFGFVELEADAEETAAIEALDGAEWMGRDLKVNKAKPRENRSGGGSFGGGRKSYGGSRY

SEQ ID NO: 84116 - protein, 180 aa, Chamaecyparis obtusa
LQHTLPGHGGAVSSVEFSKDGRLVGSGSVDKTIRLWSSSTGAFGRSLHGHTEGISDVAWSSDSRYICSASDDKTLKIWDVHTGDCVKTLKGHSNFVFTVNFNDHSNLIVSGSFDETVRIWDVKTGKCLRVIRAHTDPVTAADFNRDGSLIVSSSHDGSCKIWDASNGNCLKTLIDDKTPA

SEQ ID NO: 84117 - protein, 193 aa, Ehrlichia ruminantium str. Welgevonden
MKYRTLYSMVGYFRSTLPNLLTILRVLAIPAIVCSFYIQNDSSNYIAFIIFIFACITDFFDGYLARIWQTQSKFGRLFDPIADKLIVSATLIMLVYIGKVTKLTIIPVVIIICREILISGLREFLISMNFKIPVIKLGKVKTFIQMAAIAMLMLDYSIILYVADIILYIAAGLTVYSAYLYICVALRQIYSQE

SEQ ID NO: 84118 - protein, 365 aa, Silicibacter sp. TM1040
MGFKMGIVGLPNVGKSTLFNALTKTASAQAANFPFCTIEPNVGEVGVPDARLDKLAAIAQSKQIIPTRMTFVDIAGLVKGASKGEGLGNQFLANIREVDAIAHVLRCFEDGDVTHVDGRVDPVADADTIETELMLADLESIEKRRANLVRKLKGNDKEAQQQDRLLAAAQAMLEDGKPARLVEVDAEDQKAWTMLQLLTTKPVLYVCNVGESESVEGNAHSAKVAEMAAAQGNAHVIISAQIEEEISQLEPEEAQMFLDEMGLAEAGLDRLIRAGYELLHLETYFTVGPKEARAWTIRSGTAAPQAAGVIHGDFEKGFIRAETIAYDDYIACGGESGAKEAGKMRAEGKSYIVKDGDVMHFLFNT

SEQ ID NO: 84119 - protein, 307 aa, Silicibacter sp. TM1040
MTTKLIIDTDPGIDDAMAIFYAAAAPDIELLGLTTIFGNVTTKMATRNALRLLEAAELDLPVAHGAEKPLVLPPFEPSAHVHGDEGFGDIPAVNPKGQAIAEDAADFLIRMAREHKGELVVCPVGPLTNIAIAIERDPEFVKNCKRIVIMGGSLEAGGNITPHAEANIYHDPHAAEAVFAAAAGKVVMVGLDVTLKILCTPEDFDGIKERSPELGGMLKDMSVFYIKFYQEVANLNGCSLHDPAAVIACTHPDLFKTRAVKLAVSVEEETSGKTQLAEDGRGDTHVAMDVDAEAVKALFLKRLSLLP

SEQ ID NO: 84120 - protein, 210 aa, Photorhabdus luminescens subsp. laumondii TTO1
MTIKNHNYHMTRFITSAPDIRHLPQDMGIEVAFAGRSNAGKSSALNALTKQKSLARTSKTPGRTQLINLFEVEEGIRLVDLPGYGYAEVPEEMKRKWQKALGEYLQKRECLIGLVVLMDIRHPLKDLDQQMIQWAVAMQVPVMVLLTKADKLASGARKSQLNKVRDALLALNGDIQVEYFSVPKKIGIDKLHQKLDIWFSQKAVQVENHR

SEQ ID NO: 84121 - protein, 150 aa, Synechococcus sp.
MVSSSIGLRQCCPGSQRARGLPGADYAGQSAMKVGDRDQRPWGQFEILAQGSGYQVKRLEVLPGQQLSLQRHQQRQEHWLVVQGLARVQLGDRQFSLRVGQSLDIAIGEWHRLQNPGDELLALIEVQMGAYLGEDDIERRADDYGRCPTS

SEQ ID NO: 84122 - protein, 285 aa, Glycine max
MAKHDVEGGSFSAKDYHDPPPAPLIDAEELTQWSFYRALIAEFIATLLFLYITVLTVIGYKSQSDVKAGGDVCGGVGILGIAWAFGGMIFILVYCTAGISGGHINPAVTFGLFLARKVSLIRAIMYMVAQCLGAICGVGLVKAFQKAYYNRYGGGANELSEGYSTGVGLGAEIIGTSGGVYTVFSATDPKRNARDSHVPVLAPLPIGFAVFMVHLANIPVTGTGINPARSLGAAVMYNQQKAWDDHWIFWVGPFIGAAIAAFYHQFILRAGAAKALGSFRSNPTI

SEQ ID NO: 84123 - protein, 331 aa, Synechococcus sp. WH 7805
MTGFLTAARAEQEKIQHDTRRLRLFSGTSNPALAREIAAYLGVPDGPRVCKRFADGELYVQIQESIRGCDVFLIQPTCAPVNDHLMELLIMVDACRRASARQITAVVPYYGYARADRKTAGRESITAKLTANLLVKSGVDRVLAMDLHSAQIQGYFDIPCDHIYGSPVLVDYLSAQELGEVVVVSPDVGGVARARAFAKQMNDAPLAIIDKRRTGHNMAESLTVIGDVHQRTAILIDDMIDTGGTICAGAKLLRQQGASRVIACATHAVFSPPASERLSTDGLFEQVVVTNSVPIPSDRMFPQLQILSVANMLGEAIWRIHEESSVSSMFR

SEQ ID NO: 84124 - protein, 355 aa, Aspergillus oryzae
MPATTADTLSLVTRTVTVAPLVLLSVADHYGRSAKGTRKRVVGVLLGENSGQNVRVSNSFAVPFEEDEKDPSVWFLDHNFVESMRDMFKKINAREKLIGWYHSGPKLRAADLEINELFKRYTPNPLLVIVDVQPKEVGVPTDAYFAVDEIKDDGTTTSKTFVHTPSIIEAEEAEEIGVEHLLRDIRDVAVGTLSTRITSQLQSLQGLHLRLRDIGQYLQKVLDHELPVNHAILGNLQDVFNLLPNLSTPPATPRLSGSEQQSENSELARSMSIKTNDQLMAIYLSSLIRAITAFHDLIENKIQNRQQQEENEQKREQETNAAKGEKEAKKANGAINGEQKEELDGSKEKYKKKGQ

SEQ ID NO: 84125 - protein, 156 aa, Haemophilus influenzae
NRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKNESAVAKHFAALSTNAKDVEKFGIDTN

SEQ ID NO: 84126 - protein, 392 aa, Prochlorococcus marinus str. NATL2A
MTDKSQISIRALSIKPSLTLEISAKAKALKAEGKNICSLSAGEPDFDTPEFIVDATLKALKDGKTRYGPAAGDPELREAIAQKQSDINKVPTKTDNVLVTNGGKQAIYNLFQVVLNPGDEVLIPTPYWLSYPEITLLAGAKPIKIKSSTKDKFKIDINSLEEHVTEKTRLLIINSPSNPTGCVLTEQEMKTISDFLRRHPRILLMSDEIYEFLISPNQVHHSFAKIAPDLKNRIFTVNGFAKAWAMTGWRIGYLTGNAEVIKKAIALQSQSTSNVCSFAQKGAIAALQGSKDCVHEMANIYNKRRLLITERLKKIKHISFVPPNGAFYVFPEINLEEIDSISFCKLALEKVGLAIVPGIAFGDDKCIRISYAASNKMIEDGVNRLERLLNDF

SEQ ID NO: 84127 - protein, 180 aa, Echinochloa phyllopogon
PSGASTGIYEALELRDRPSDYLGKGVLKAVDNVNSIIGPAIYGKEPTEQVDIDNLMVQQLDGTSNEWGWCKQKLGANAILAASLAAVKAGSMVKIPLYQHIANLAGNKKIVLPVPALNVINGGSHAGNKLAMQEFMILPTGVSSFKEPMKMGVEVYHNLKSIIKKKYGQDATNVGDEGGF

SEQ ID NO: 84128 - protein, 398 aa, Rhodopseudomonas palustris CGA009
MTKTFRTLDDVDVKGKRVLLRVDLNVPMDAGKVTDTTRLERVMPTITELSGKGAKVILLAHFGRPKGRDDKNSLKPVAAALADVIKKPVGFADDCIGEPAAKAIAAMADGDILCLENTRFHPEEEKNDPAFVAKLAELGDIWVNDAFSAAHRAHATTEGLGHKLPAYAGRTMQAELVALNKALEAPVKPVIAIVGGAKVSTKIDLLENLVTKVQALVIGGGMANTFLHAQGVKVGKSLCEKDLAPTALRILDKAEAANCAIILPVDATVAYHFEANAPSFAYGLDAIPDDAMILDVGPRSIERIHAAIDDAATLVWNGPVGAFELTPFDKGTVEAAKHAAKRTKAGKLVSVAGGGDTVAALNHAGVADDFTYISTAGGAFLEWMEGKPLPGVEVLQVK

SEQ ID NO: 84129 - protein, 484 aa, Candidatus Protochlamydia amoebophila UWE25
MHMTQADIGLIGLAVMGQNLVLNMNDHGYTVAVYNRTTSKVDEFLDGPAKGTKVIGAHSLKDLISQLKRPRRVMLMVKAGEPVDNFIEQCLPYLEKGDILIDGGNSLFTDTNRRCNSLKEKGIIFIGTGISGGEEGARHGPSIMPGGNPEGWPHIKEIFQSISAKVEGEPCCDWVGDQGAGHYVKMVHNGIEYGDMQLISEAYYLLKEALHLNQNELYQVFADWNKGDLDSYLIEITSKIFKVNDEDGKPLVDKILDVAGQKGTGKWTVINALDLGMPLTLIGEAVFARCLSALKDERVAASELLKGPDAKFEGNREEFIQAIREALYSSKIISYTQGFMLMQQAAAEYKWQLNYGAIALMWRGGCIIRSQFLGKIKEAFKLNPNLKSLLLDEYFLQEIQKRQKGWRKVVSKSVELGIATPCFNTALVFYDGYRTAKLPANLLQAQRDFFGAHTYERGDRARGQYFHTDWSGTGGKVSSGSYNA

SEQ ID NO: 84130 - protein, 335 aa, Rhodopseudomonas palustris CGA009
MAVRVAINGFGRIGRNVLRAIYESGRKDIEVVAINDLGPVETNAHLLRFDSVHGRFPFEVKVDGDTIDAGRGKIKVTAIKDPSALPYKEVGVDIALECTGIFTARDKAATLLTAGAKRVLVSAPSDGADATIVYGVNHETLSKDHMVVSNGSCTTNCLAPVAKVLNDTVGIETGFMTTIHAYTGDQPTLDTMHKDLYRGRAAAMSMIPTSTGAAKAIGLVLPELKGKLDGVAIRVPTPNVSVVDLKIIAKKATTKEEINEAIKRAAEQELKGILGYTNAPNVSIDFNHDPHSSTFHMDQTKVQNGTLVRVMSWYDNEWGFSNRMADTAVAIGKLI

SEQ ID NO: 84131 - protein, 428 aa, Trichodesmium erythraeum IMS101
METAIESIQAREILDSRGRPTVEAEVHLVNGSMGLAQVPSGASTGSFEAHELRDGDKGRYSGKGVLTAVKNVEEQITPNLVKINALNQNLVDSKMIEIDGSPNKSNLGANAILAVSLATAKAAANSVGMPLYRYLGGPQASLLPVPLMNVINGGAHAANNVDIQEFMIVPVGATSFKEALRWGAEVFATLSGVLKDKGLLGGVGDEGGYAPNLGSNQEALDILIAAIEKAGYKPGEQVALALDVAASEFYKDGNYIYDGATHSPSELIDYLASLVDQYPIVSIEDGLHEEDWESWVQLTQKLGSKVQLVGDDLFVTNGSRLQKGIDMAAGNSILIKLNQIGSLSETLETIDLATRNSYRSVISHRSGETEDTTIADLAVGTRAGQIKTGSLCRSERVAKYNRLLRIEDELGDRAVYAGVIGLGPKSRS

SEQ ID NO: 84132 - protein, 592 aa, Glycine max
MGGGGTLVQGIRRLFKRRASSPASDDHNHNNVNANNSRVLVRDLRAQLASIPNTLDPVSDFDFDFSTLKPIKVPTPIPFRPSSMDHHKKGAQETEFFTEYGEASQYQIQEVVGKGSYGVVGSAIDTHTGEKVAIKKINDVFEHVSDATRILREIKLLRLLRHPDIVEIKHIMLPPSRREFRDIYVVFELMESDLHQVIKANDDLTPEHHQFFLYQLLRGLKYIHTANVFHRDLKPKNILANADCKLKICDFGLARVSFNDAPSAIFWTDYVATRWYRAPELCGSFFSKYTPAIDIWSIGCIFAEMLTGKPLFPGKNVVHQLDLMTDLLGTPPPESIARIRNEKAKRYLNSMRKKQPIPFSQKFPNADPLALRLLERLLAFDPKDRPSAHEEALSDPYFTGLANMDREPSTQPISKLEFEFERRKLTKDDVRELIYREILEYHPQMLQEYLRGGDQTSFMYPSGVDRFKRQFAHLEEHYGKGERSTPPLQRQHASLPRERVCAPKDESKQNNDSEKPSGSNLQQSPPGSDETGAQNGTSKPNYSARSLLKSASISASKCVVLKQNKDPEQEPITEVNDEAVDGVTGEIAALHA

SEQ ID NO: 84133 - protein, 507 aa, Synechococcus sp. WH 7805
MSATMTNPLRVGLRQERVIAPQCLVIFGASGDLTHRKLVPALFELFLQRRLPSEFALLGCARRPWSDEEFRQKMAEAMEKTVNENRVAWDQFSAGMFYEPVDLQQPEDLVKLGHRLDSIDRLRATRSNRTFYLSVSPKFYGSGCRALSDAGLLKDPQRSRVVIEKPFGRDYGSAQALNRIVQSCGQENQIFRIDHYLGKETVQNIMVLRFANTIFEPIWNRNYISSVQITAAETVGVEERAGYYETSGALRDMVQNHLTQMLAITAMETPGRFDPEAIRSEKAKVLQAARLADEKEPWNCCIRGQYGPGGTLDNPLAGYRQEPGVDPNSTTETYVAMKLFIDNWRWQGVPFYVRTGKRLPKRLSEVVLTFREAPVHLFDAAGGGPTANQLILRIQPDEGAEFRFEVKSPGSGMRSRPVEMEFSYDESFGEPSDEGYVRLLADAMLGDPTLFTRSDEVEAAWRLYTPLLELIEDSPWQLPIHPYESRTWGPAASDALMARDGLLWRRP

SEQ ID NO: 84134 - protein, 190 aa, Bordetella petrii
MPINVPIILTWLRIAMIPLVVGLFYIPGTWMAEPARDTLAAWAFIIAALTDWFDGWLARRWNQTSAFGAFLDPVADKLMVCAALIVLLDLGRVDAFISLIIIGREITISALREWMAKIGASASVAVHRLGKFKTAAQMVAIPCLLYNQQLFGLSSRLLGDVLIIIAAVLTVWSMFYYLRRAWPAIREKSQ

SEQ ID NO: 84135 - protein, 378 aa, Arabidopsis thaliana
MKKLLVTKLLGPQALERSRGIRADELERFHSSLLDKAVKKEIVEIGKEATKLSNNSLWRMSIGRSFSEKNGEAERVRGLVTELDGLTKKVLFATLLHRPLEKLGISLFKKEIMCVSDSFDEVLERVLVEHEQKLDDHQDRDMMDVLLAAYGDENAEHKISRNHIKAFFVELFFAGTDTSAQSIQWTMAEIINNPNILKRLREEIDSVVGKTRLIQETDLPKLPYLQAVVKEGLRLHPPLPLFVRTFQEGCKIGGFYVPEKTTLIGNAYVMMRDPSVWEDPEEFKPERFLSSSRSTQEEERREQALKYIPFGSGRRGCPGSSLGYIFVGTAVGMMVQCFDWSIKGDKVQMDEAGGLNLSMAHSLKCTPVPRNRPLLADQ

SEQ ID NO: 84136 - protein, 180 aa, Chamaecyparis obtusa
LQHTLAGHGGAVSSVEFSKDGRLVGSGSVDKTIRLWSSSTGAFERSLHGHTEGISDVAWSSDSRYICSASDDKTLKIWDVHTGDCVKTLKGHSNFVFTVNFNDHSNLIVSGSFDETVRIWDVKTGKCLRVIHAHTDPVTAADFNRDGSLIVSSSHDGSCKIWDASNGNCLKTLIDDKAPA

SEQ ID NO: 84137 - protein, 435 aa, Oryza sativa Japonica Group
MALHAAPPPPPPFTAGRLPTTSRRPCFSAGRIFRCSLPAAAARPRNAAFLAPLRTSSAVCTKAVSNSDGTPGTSSSPHVVCFGELLIDFVPTVNGVSLAEASAFKKAPGGAPANVAVGIARLGGSSAFIGKPQFELGRNIEKVFQPSSFSFKIKRLFFHYTLFNIQHMQVGDDEFGYMLADILKENNVNNQGLLFDAHARTALAFVTLRNDGEREFMFYRNPSADMLLEEKELDLDLIRKAKIFHHGSISLITEPCKTAHIAAAKAAKDAGVLISYDPNLRLPLWSSADDARDGILSIWETADVIKISEEEVSFLTKGEDPYDDSVIKKLMHPNLKLLLVTEGPEGCRYYSKEFNGRVGGLKVNAVDTTGAGDAFVAGILSQLSVDFSLLQDEGRLKEALKFANVCGALTVTERGAIPALPTRQQVVDALTKVVA

SEQ ID NO: 84138 - protein, 98 aa, Candidatus Protochlamydia amoebophila UWE25
MTKDTKDKKNSAFMRPVQVSEVLAEIVGNGPMPRTEVTKRVWDYIKKNKLQDQTNKRNINPDAKLGKVLGSDQSIDMFKMTSKIAKHLKEPEMSSTKQ

SEQ ID NO: 84139 - protein, 522 aa, Oryza sativa
MARAARGKAPRPRPRPPRGLAASLRRLLAGAGGGLGVAAAAYVGVDYLRYLSPAWHGRLMPALWAALALAAAARAPFYRHWSAELRAALPFLGSIAFMLGAFLCEAVSVRFVSAVMGLQWHRSVHFSGAMELTDYSVPGVKDAMDLGGDLLSSLIAIYCIFFNLDLGGRFKLFDCGRILWCDLAEICCLFYCFNRSAAPLPDTGQWLLLALNEKLPQSVVDLLRAHVITLHHYLMLFIMLGFSVLFGCIKAPGLGIATRYMFTMAIGRLLRTMTFVATILPSARPWCAAARYQIPGHPHPWAQKYYVPYASDSDAIRRVIRDDVAYAAVQSYPGEYRPDWGRMSFLVDILRPTPGEGPSWYHLLKKASGGCNDLMYSGHMLVAVLTAMAWTEAYGGWISVAIWLLVLHSAQREIRERHHYTVDCVVAIYVGILLWRMTRFIWSARDASRARRLAKLDEVHNRLIHAAKDSDVDEIRGLLKEVELAGQEKQGVSQRAILAFAAATIIFTLTCVVLALTLTSDG

SEQ ID NO: 84140 - protein, 641 aa, Rhodopseudomonas palustris CGA009
MTEFSKTPLLDTIRTPEDLRKLRIDQVRQVADELRLETIDAVSVTGGHFGAGLGVVELTTALHYVFDTPRDRLIWDVGHQAYPHKILTGRRDRIRTLRTGGGLSGFTKRTESDHDPFGAGHSSTSISAGLGMAVASELAGKKNNVIAVIGDGSISAGMAYEAMNNAGAMNSRLIVILNDNNMSIAPPVGAMSAYLSRLYSGKTYRSLREAGKQIGKHLPKLIADRAARAEEYSRGFMMGGGTLFEELGFYYVGPVDGHNLDHLLPILQNVRDADTGPFLIHVVTQKGKGYGPAEAAADKYHAVVKFDIATGAQAKAKSNAPSYQNVFGQSLVKEAQKDDKIVGITAAMPSGTGIDIFEKAFPKRTFDVGIAEQHAVTFAAGLATEGYKPFCAIYSTFLQRAYDQIVHDVAIQKLPVRFAIDRAGLVGADGATHAGSFDNAYLGCLPNMVIMAAADEAELVHMVATQVAIDDRPSAVRYPRGEGRGVEMPEVGIPLEIGKGRVIRQGNKVALLSFGTRLAEAEKAADELATLGLSTTVADARFMKPLDVELVLKLARDHEVLLTIEEGSIGGFGSHVMQTLAEHGMLDGEVKMRALVLPDVFMDHDNPVAMYARAGLDAKAIVKKVFDVLGKDAATETSKLA

SEQ ID NO: 84141 - protein, 233 aa, Cryptomeria japonica
APFMVNAYPYFAYRDNPKEVSLDYVLFGQSPGVKDPKGFTYNNMLDAQIDSVYSAMAALGHNDSIPVSISETGWPSKGDPADIGVNPENARNYNTRVIKHVTSNAGTPMRPNRVIDTYIFALFNENQKPGPITERNFGLLQPDGSKVYDIDLSCGYCGAAAPAPAPPPPAPLPMQWSRPAKGGRQAGAIWCIAKPSADPSVLQESLDFACGQGGADCSAIHQGGPCYTPNTVH

SEQ ID NO: 84142 - protein, 233 aa, Cryptomeria japonica
APFMVNAYPYFAYRDNPKEVSLDYVLFGQSPGVKDPKGFTYKNMLDAQIDSVYSAMAALGHNDSIPVSISETGWPSKGDPADIGVNPENARNYNTRVIKHVTSNAGTPMRPNRVIDTYIFALFNENQKPGPITERNFGLLQPDGSKVYDIDLSCGYCGAAAPAPAPPPPAPLPMQWSRPAKGGRQAGAIWCIAKPSADPSVLQESLDFACGQGGADCSAIHQGGPCYTPNTVH

SEQ ID NO: 84143 - protein, 277 aa, Synechocystis sp. PCC 6803
MSGVDRMSLRRNALKVLQETSRTFYIPISILPDQLLDAVASAYLCMRAIDEVEDHPDLDAETKARILNQISLNLQSATENSHSEDFIRGLDPYRNLLPEVTLRVGEWALLAPESIAPRVWDATAAMSDRMAFWALQNWQIRTESELDQYTFSVAGAVGLLLSDLWAWHDGTQTNRSHAIGFGRGLQAVNIVRNYKEDKRRGVSFFPQGWELADMHKYARYNLALADQYTKSLPHGPALNFCKIPLTLAYGTLDVLALGKEKLSRSDVMALVNRVIAS

SEQ ID NO: 84144 - protein, 256 aa, Rubrobacter xylanophilus DSM 9941
MAGERRPLMAANWKMNKTVREAQDYMAALLPRVADLAGEVDVAVFAPFTCLSEVARMAEGSGVLAGAQNFFYEDSGAYTGEVSAPMLLDVGARASIVGHSERRELFCETDESVARKARRAVEAGLLPVVCVGETEEERDAGRMWEKVSGQVRAVVEGLGDASGGRVVFAYEPIWAIGTGKTASPEDAQDAIGRIRGLLRELRGEGFAEEARLLYGGSIKPENISEIMAQKDVDGGLVGGASLEVGSFLQLVEAARG

SEQ ID NO: 84145 - protein, 392 aa, Rubrobacter xylanophilus DSM 9941
MDKRSVRDLELRGKKVLVRVDFNVPVKGGEVTDDTRIRRALPTIRYLLQRGARVALISHLGRPKGEPDPRYRMDPVARRLEELLGEPVRKLDTATGPEVGRALEELERGVILLENSRFYPGETKNDPAFAAELAGPFDLYVNDAFGAAHRAHATTVGVAERLPAAAGFLLEQELDYLDGVLRSPERPFVAILGGAKVSDKLGVIESLLGVADRLLVGGAMCFTFLKARGLGVGASLVEDDYLGEARRLMEGAADRLVLPVDVVVAERMEEGARTRTVPVEEIPEGWMGLDIGPRTVELFRRHILQARTIFWNGPMGVFEIDAFARGTEGVARAVAESGATSVVGGGDSVAAVRKLGLEDRMSHISTGGGASLEYVEGRELPGVAVLPEREEV

SEQ ID NO: 84146 - protein, 1499 aa, Oryza sativa Indica Group
MEKVWESGRRMSRSIGRGMGMEAWGVDEAFMPQNSGGGGGSRGRRRSGRGGTADDDEEALRWAAIERLPTYSRMRTAILSSAEEEAAAAAGAGKQQYKEVDVRRLGVGERQEFIERVFRVAEEDNQRFLQKLRNRIDRVGIELPTVEVRFEELMVQARCHVGSRALPTLLNTARNIAEAALGLVGVRPGRQATLTILRGVSGAVRPSRMTLLLGPPSSGKTTLLLALAGKLDPSLRRGGEVTYNGFELEEFVAQKTAAYISQTDVHVGEMTVKETLDFSARCQGVGTKYDLLTELARREKEAGIRPEPEVDLFMKATSMEGVESSLQTDYTLRILGLDICADTIVGDQMQRGISGGQKKRVTTGEMIVGPTKVLFMDEISTGLDSSTTFQIVKCLQQIVHLGEATILMSLLQPAPETFELFDDIILLSEGQIVYQGPREYVLEFFESCGFRCPERKGTADFLQEVTSKKDQEQYWADKHRPYRYISVSEFAQRFKRFHVGLQLENHLSVPFDKTRSHQAALVFSKQSVSTTELLKASFAKEWLLIKRNSFVYIFKTIQLIIVALVASTVFLRTQMHTRNLDDGFVYIGALLFSLIVNMFNGFAELSLTITRLPVFFKHRDLLFYPAWIFTLPNVILRIPFSIIESIVWVIVTYYTIGFAPEADRFFKQLLLVFLIQQMAGGLFRATAGLCRSMIIAQTGGALALLIFFVLGGFLLPKAFIPKWWIWGYWVSPLMYGYNALAVNEFYSPRWMNKFVLDNNGVPKRLGIALMEGANIFTDKNWFWIGAAGLLGFTIFFNVLFTLSLVYLNPLGKPQAVISEETAKEAEGNGDARHTVRNGSTKSNGGNHKEMREMRLSARLSNSSSNGVSRLMSIGSNEAGPRRGMVLPFTPLSMSFDDVNYYVDMPAEMKQQGVVDDRLQLLRDVTGSFRPAVLTALMGVSGAGKTTLMDVLAGRKTGGYIEGDMRISGYPKNQETFARISGYCEQNDIHSPQVTVRESLIYSAFLRLPEKIGDQEITDDIKIQFVDEVMELVELDNLKDALVGLPGITGLSTEQRKRLTIAVELVANPSIIFMDEPTSGLDARAAAIVMRTVRNTVDTGRTVVCTIHQPSIDIFEAFDELLLLKRGGQVIYSGQLGRNSQKMIEYFEAIPGVPKIKDKYNPATWMLEVSSVAAEVRLNMDFAEYYKTSDLYKQNKVLVNQLSQPEPGTSDLHFPTKYSQSTIGQFRACLWKQWLTYWRSPDYNLVRFSFTLFTALLLGTIFWKIGTKMGNANSLRMVIGAMYTAVMFIGINNCATVQPIVSIERTVFYRERAAGMYSAMPYAIAQVVMEIPYVFVQTAYYTLIVYAMMSFQWTAAKFFWFFFVSYFSFLYFTYYGMMTVAISPNHEVAAIFAAAFYSLFNLFSGFFIPRPRIPKWWIWYYWLCPLAWTVYGLIVTQYGDLEQIISVPGQSNQTISYYVTHHFGYHRKFMPVVAPVLVLFAVFFAFMYAICIKKLNFQHR

SEQ ID NO: 84147 - protein, 344 aa, Oryza sativa
  misc_feature (256)..(256): Xaa can be any naturally occurring amino acid
MDPAPATPRWNLERPYLTGRFHQEAKVAAAAQGAGSKPYSLDSFSRGGGGGGAESVIGSYAVSVQELLVIDDLLSALVGIEGRYISIKRVRGKEGYVVFQIDSSMDLALQELTRRIFPLCEDFVLVYHFVESRSHFKSGLVNHALAAALRAFLLDYQAMVAQLEHQFRLGRLSVQGLWFFCQRMMSSLNALAVLVEKAISNNTSGSATLNLLQSQAKAMAGDSAVRSLLEKMTECASAAYLRMLERWVYEGVIDDXPYGEFFIAENKSLQKESLTQDYDAKYWQQRYSLKDGIPSFLTNVAATILTTGKYLNVMKKREIPCPSSLAKRFNREGAGVKPPKFLKA

SEQ ID NO: 84148 - protein, 333 aa, Rubrobacter xylanophilus DSM 9941
MAVRIGINGFGRIGMLVAKAAMQRGDVEVVAVNDLMPMESLALLFKRDSTHGIWDEDVALEGSVLRVGDRQIKTFSEREPSGIPWGDVGADIVVEATGKFTSRDGAAGHLEGGAKKVVISAPAKGADATFVYKVNHETYDPDNHQVVSNASCTTNCIIPMVKVLQDNFGIESGFMTTCHAYTNDQSLLDAAHKDPRRARSAPNNIVPTSTGAARTAGVIYPELRGKVDGMALRVPVPDGSITDFVAELSREASVEEVNGAFRRAAEGELSGILEYSEAPIVSQDIVGNPASCIFDAPLTMSTGRTVKVLGWYDNEWGYSNRTVDLVSYIGERL

SEQ ID NO: 84149 - protein, 333 aa, Synechocystis sp. PCC 6803
MGHKYDVYGMGNALVDMEFEVTPEQLASLGIDKGVMTLVEEARENELIAQLAQQRGKQSSGGSAANTLVSLAQLGGTGFYACKVGKDEAGAFYLQDLNDCGLDTNPHHETAGEGITGKCLVFVTPDADRTMNAFLGISGSLSVTEMDWSALKQSQYLYLEGYLVTSPSAKAACIEAKAIAEQSGVKTCLSLSDPNMAKFFQDGLKEMLGSGVDLLFANEAEALEMAGTSDLNQAIAYCKSIAKNFALTRGGAGSLIFDGENLLTIGTPKVQPIDTVGAGDMYAGGFLYGLTHGMDYEKAGQLASETAAKVVTCYGPRLDTEILQEILQSVQAV

SEQ ID NO: 84150 - protein, 352 aa, Oryza sativa Indica Group
MGKPGKLALPSHESTIGKFLTQSGTFKDGDLLVNKDGLRTVSQSEEGEAPPIEPLDHNQLSLDDLDAIKVIGKGSSGIVQLVRHKWTGQFFALKVIQLNIQENIRRQIAQELKISLSTQCQYVVACCQCFYVNGVISIVLEYMDGGSLSDFLKTVKAIPEPYLDAICKQVLKGLMYLHHEKRIIHRDLKPSNILINHMGEVKISDFGVSAIIASSSAQRDTFTGTYNYMAPERISGQKHGYMSDIWSLGLVILELATGEFPYPRRESFYELLEAVVEHPPPSAPSDQFTEEFCSFVSACMQKKALDRSSAQILLNHPFLSLYDDLNIDLASYFTTAGSPLATFNTSNRYDDR

SEQ ID NO: 84151 - protein, 480 aa, Pseudomonas syringae pv. tomato str. DC3000
MQLKDSTLFRQQAYINGQWLDADGGQSIKVNNPATNEILGTVPKMGAAETRRAIEAADKALPAWRALTAKERGNKLRRWFELMIENQDDLGLLMTLEQGKPLAEAKGEITYAASFIEWFAEEAKRVYGDVIPGHQPDKRLIVLKQPIGVTAAITPWNFPAAMITRKAGPALAAGCTMVLKPASQTPFSALALAELAERAGIPAGVFSVVTGSAGDIGSELTGNPIVRKLSFTGSTEIGRQLMAECAKDIKKVSLELGGNAPFIVFDDADLDKAVEGAMISKYRNNGQTCVCANRIYVQDGVYDAFAEKLKVAVGKLKIGNGLEDGITTGPLIDEKAVAKVKEHIADAVSKGATVLTGGNSLEGSFFEPTILVNVSKDAAVAREETFGPLAPLFRFKDEAEAIALANDTEFGLASYFYAQNMSRVFRVAEALEYGMVGINTGLISNELAPFGGIKSSGLGREGSKYGIEDYLEIKYLCLSV

SEQ ID NO: 84152 - protein, 493 aa, Chlamydomonas reinhardtii
MAEEYDLVTLGAGSGGVRASRFAATLYGAKVACVELPFGFVSSETVGGAGGTCVIRGCVPKKLLVYGAAYAEEFADARGFGWALPAAGAGAEGGPAHDWASLMKLKEKEITRLNSTYGNILKNANVALIEGRGALKDAHTVEVTAADGSVRLLKAKHVLIATGGVATAIPMEGAEHAIMSDDALALQSLPPGPIVVLGAGYIATEFAGIFRGTHAAQYAVHLMFRGDKVLRGFDEECRDQVQDNLTRRGIHLHPGCKPTKLEKHGEGDLTLHYTDGTGAAQSLKCGLVMMATRRKPRVDGIGLEAVGVALDGQGAIKVDEFSRTNVPDVWAIGDVTNRINLTPVALMEGMAFAKSCFGGELTKPDYRNVASAVFCQPPLATVGYTEEQAVKEFAGNIDVYVSRFRPMKYTISGREEKTLMKLIVHAESDVVLGCHMVGPDAPEIMQGLAVALKCGATKAQFDSTVGIHPTAAEEFVTMRSRSRRVPATGTSKL

SEQ ID NO: 84153 - protein, 475 aa, Zea mays
MDMALASKASPPPWNATAAEQPIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKILNADNVQEAAMETDGYFIKGGIVTVIKDALLPSGTVI

SEQ ID NO: 84154 - protein, 426 aa, Pseudomonas syringae pv. tomato str. DC3000
MSQTNESLMQRRHAAVPRGVGQIHPIFAASAKNATVTDVEGREFIDFAGGIAVLNTGHLHPKIVAAVQEQLTKLTHTCFQVLAYEPYVELCEKINAKVPGDFDKKTLLVTTGSEAVENAVKIARAATGRAGVIAFTGAYHGRTMMTLGLTGKVVPYSAGMGLMPGGIFRALYPCELHGVSVDDSIASIERIFKNDAEPRDIAAIIIEPVQGEGGFYVAPKAFMLRLRELCDKHGILLIADEVQTGAGRTGTFFAMEQMGVAADLTTFAKSIAGGFPLAGVCGKAEYMDAIAPGGLGGTYAGSPVACAAALAVLDIFEEEHLLERCKTVGERLVTALKGMQAKYPVIGEVRALGAMIAVELFEDGDSHKPNAAAVAQVVAKARDKGLILLSCGTYGNVLRVLVPLTAEEELLTRGLAILDECFAEIA

SEQ ID NO: 84155 - protein, 437 aa, Methylobacillus flagellatus KT
MTTSNASLLQRSLAAVWHPCTQMKQHEALPLVPVKRGEGVWLEDFDGKRYLDGVSSWWVNLFGHNHPHIKQAIKAQLDQLEHVILAGFTHEPVVRLSEQLSLLTGLGHSFYASDGASATEIALKMSFHYWRNHGETAKTRFLSLQNGYHGETLGSLSVTDIALFKDTYAPLLREESIALPSPDWRRAEPGESAEQYALRCAGQAEAYIAQHHAGIAAVIVEPLVQCATGMAMYHPVYLQRLRALCDRYQVHLIADEIAVGFGRTGTMFAIEQAGIKPDFICLSKGITGGYLPLSVVQTTQDIYAAFYDDSVTRGFLHSHSYTGNALACSAALATLDIFAQHDVLNSNRRKAGYLNRRLAAWRDLPIRHLRNTGMIWAFDVTPSRPGFQQRFYQAALQRGLLLRPVGNTVYFMPPYIISEEEMDWMLEQARGALEESL

SEQ ID NO: 84156 - protein, 831 aa, Vibrio vulnificus YJ016
MHFDSGLLALLFVIIALFIGALVRHLLKGSQVPYTVALLILGIAIGLAHRGNIFADNYTFIGETLSLASEIDPHLFLFLFLPTLIFESAFAMEVHLFRRMFTQIVILAVPGLMLAIWLTAELVAWVLPEHWQWSWALCLMFGALISATDPVAVVALLKEVSSRKRLETLIEGESLLNDGTAIVFFSLFYGWVLMEFSNPGEAITAPPWQAVAQFFVVVFVGLAVGLILGGLCILWIDRVFNDPMIEISLTIAAAYSAFFISENFHVSGVVAVVTLAIMFASVGRTRISPEVAGFLHHFWEMMAHMANTLIFLLVGILVAIRVPLDDKEAWLALFVLYLGIMAIRACSITVFMPILKRIGIGITYEKAVVLCWGGLRGAVSLALAMTVASSDIIPKQIGDHVLFLCAGIVVLTILFNGSTMGHVLKWLNLSSLPPGKQATVDKAQHEINRVLHDMLPKMMTSDFLKGADWETVKQGAKLQVLKECNSPTEITQDELHTAYLRRLLETERKHYWTQFSQGLIGKQATNKLVEAVEHALDGDPIIGPRNELFTTWRLPDWVEPLRQYNSWNKLLLKVYFRRLALGYDVARGFIQAQEALESHIDTLAPDAEIAVMVRQQVELNKRLTFERIESLRMSFPEIIQALQSQAATRLLLNRERAVINDQLKQAVLDKPEAQKLLNMVEERMAALQKESIFDKSQEQKLINDIPWARELKSKTREELTSWIEHTVYDAGQLICENQRPLNRIGIVSRGSITELYETRSDDNLEKVRTTIGPGETFALISLLTGKTNAQYVSDTPTDIMWLPVDKLKLLMNQDPNLTAVVCQLFKQLKSV

SEQ ID NO: 84157 - protein, 413 aa, Chlamydomonas reinhardtii
MQTLRAHQATGVSQSGRVGRVTCAPVLASRVAEAAQPSSTVGRPAMEAPTAAAGRAGDASPASSTMFGRMPSGVVDHRLVASPGSVLTSSLIAKAANKSMEELSNPAYSAAKAAYQGVPGAYSEVAARKACPDFDPLPCDQFEVAFQALSQWMAERAVLPIENSLGGSIHAVYDLLIRYRLHIIGETSLAINHCLVALPGTAKGDLKRVMSHPQALAQCDGYLRRMAVVKEAVDDTAGAAQIVARQGLQGVGAICSRRAAELYGLDVLEEGIQDVKDNVTRFIVLSRDPLVTSESDPRTYKTSIVFSLQPGPGQLFKALSVFALRDIDLAKVESRPMRTNPIDGTSFTRQNFNYMFYVDFVGSLQEVRCQNALRHLQETAPFLRVLGSYPMDTELGTMSSDDPGMMQNMSRYN

SEQ ID NO: 84158 - protein, 190 aa, Aspergillus oryzae
MLDEKSIQVSPENKQCRGYENFGVLSGVSRCEDNGDRSPSLERSYELDRIRGCVGFDDERRECTVAPKEKPCYRCSGVGHISRDCPQAPSGDGYSGATGGQECYKCGHVGHIARNCSQGGYSGDGYGGRQHTCYSCGGHGHMARDCTHGQKCYNCGEVGHVSRDCPSEARGERVCYKCKQPGHVQAACPN

SEQ ID NO: 84159 - protein, 562 aa, Aspergillus oryzae
MATQLSNPAKRVSLEELPKSNIFTAKLPPDPAFETPKISHGAPREALGPRLVKGALYTFVRPEPAKETELLDVSPKAMADLGLKSGEELTPQFKAVVSGNHFFWTENSGGIYPWAQCYGGWQFGSWAGQLGDGRAISLFESTNPDTCIRYELQLKGAGRTPYSRFADGKSVLRSSIREYVVSEALSALGVPTTRALSITLLPESKVLRERVEPGAIVARFAESWLRIGTFDLLRARGDRNLIRRLATYVAEDVFHGWEALPAAVSLGKDQPTDAVNNPARGVPWDLVQKHEGVEENRFARLYREVARRNAKTVAAWQAYGFMNGVLNTDNTSIYGLSLDYGPFAFMDNFDPQYTPNHDDHLLRYSYKNQPTIIWWNLVRLGESLGELIGAGAKVDEESFVKEGVTEDAAPAIVKLAEDIIGRVGEEFRTVFLNEYKRLMGGRLGLKTQKESDFQDLFSEMLDTLEALELDFNHFFLRLSRVPLSALDTEEKRKEVAPIFFHSEGCGGVGYTEHSAKERIANWLERWRLRILEDWGPYGDVERQEAMKRVNPKVSESCSPSEV

SEQ ID NO: 84160 - protein, 448 aa, Bacillus pumilus SAFR-032
MSIKTVSKNQQFLEQQSQRESNARSYPRRFPLAMQKAEGMIVTDADGREFYDCLAGAGTLALGHNHPVVIEAIERMLHEKRPLHTLDITSEIKEEFVNEIFSHLPEEFAKRAKIQFCGPTGGDAIEAAIKLVKTATGNRSILSFHGSYHGATHATMSLSGNLSPKERVQGLIPDVHFMPYPYEYRCPFGIGGKDSHRISSSYIERVLNDPESGILPPAGMIFEAVQGEGGSIPASIEWMKEMRRITKEKGIPLIIDEVQSGIGRTGKMFAFEHAGIIPDVIVLSKAIGGSLPLSVVIYDQDLDQWNPGAHIGTFRGNQMAMAAGTATLKFIKETNLLDHVERLGDRMQAHLKDIQKQVPALGDVRGRGLMIGVEVVDPNEKQDVDGSYPANPELASLIQKNCFDKGLIVETGGRFGSVIRFLPPLIMTEEQLEKVIVIFKEAVYDAIN

SEQ ID NO: 84161 - protein, 545 aa, Mycoplasma penetrans HF-2
MRKITIGNYLLERLSEIGIKDIFGVPGDFNLGFLDDIIKNEDLNWIGCTNELNASYSVDGYARVNGIGAILTTYGVGELSAVNGIAGSYSEDVPVIHIVGTPKREYFKRHMILHHSLGTSDSFGAYKKIYENITSLTVWLDAKNAINQINNAIKYAVFYKKPVYIMIPQDVASFEIMADSDLLSFASGFDLEEHKEIIEDVKNKINNSNQAVIISGHKVIRYGLKSDLEKFVNRNGINVVTTGFGKGSVDETNELYLGVYSGLKTPDAAIAKIIDTADLVLIIGNKFTDLTSSFFQLNFNKDNVVEISDTHVKYDNKIFTNHSFGFLVKMLANDTNINYKGLSVLENRVAVEFNPTEEKITYNRLQVALNNYFVEKDILVSDVGTCTFLSQYIQLKKDMKFIMQPLWASIGFSFPASIGAQIASNSKVVNILGDGAFNMVFNELITVINKQIPITTILLNNNGYTIEKVIHGDGKPYNELPKVNYSQLIKAFDPEGEKSISLRVTNEIELQEALVISRSSDKFVFIEVCLEQNDIPEALKGFFNK

SEQ ID NO: 84162 - protein, 224 aa, Oryza sativa Japonica Group
MEESDAAAASAKAPNGEASGGGGRPVEVEDTLPGVLRSFVDGVCSQGGGGGGGEPLLRRIRAASCETAPRLREASRNSARDLLEWTRRGSGLRAILVISVGTITLIALTGLLIFMFFLLVATTNAVVVSVLMSLAAAGGFLAMFFACLVAVYIGVVSVAVFVISATVISAIVGVMIATGWLGFFWMIWFAARKSMDLTKHSIGVTNSAIQSYSASRHAKQKPID

SEQ ID NO: 84163 - protein, 285 aa, Brassica napus
MAERGGERGAERGGDRGGFGRGFGGGRGDRGGRGGPRGRGGRRGGRPTEEEKWTPVTKLGRLVQAGKIQKLEQIYLHSLPVKEYQIIDLLVGPTLKDEVMKIMPVQKQTRAGQRTRFKAFVVVGDTIGHVGLGVKCSKEVATAIRGGIILAKLSVIPVRRGYWGNKIGKPHTVPCKVTGKCGSVTVRMVPAPRGAGIVAARVPKKVLQFAGIDDVFTSSRGSTKTLGNFVKATFDCLQKTYGFLTPEFWKETSFKKSPYQEYTDLLAEKGTKKLITEVEDQQASS

SEQ ID NO: 84164 - protein, 280 aa, Synechococcus sp. WH 7805
MVLTIVGSGYVGTALARQLQLQRQAVPLVLTTTSELRLCELNQLADRVQICDATNPDHLRKALNKSRVAVFTLGPKGNRQGDVDLYRSTFEECFHCLSSVIAELPALQHIVYTSSCSVYGHASDAWVNENTPARPRTARGEVLLESERLVMQLMGENRKVCVLRLAALYGPGREIKDRLRGLAGKQLPGDGGSFSNWVHVDDAAGAALAAINGCWTGLVNVVNDEPLRDRDLVDRTLIQEGLERVQWTGAPGPAPPFSRCISNHRLKELGYRLQHPTLFS

SEQ ID NO: 84165 - protein, 266 aa, Sphingomonas xenophaga
MSNRLDGQVALLTGGATGIGAAVVARYIEEGAKVGVLVKDDEQVELVRSRHGDSVVAVAGDVRSYADNARAVAETVAAFGKLDVFVGNVGIWDFMVPLEQQDPEQLGKVFDEIFDVNLKGYFFGARAAIPELRKVKGSIIFTASTSSYYTGGGGTLYVASKHAVLGLIKQLAWELAPEIRVNGVAPGGTRTPLSGTQTGGFAEMKMEQMPGLDEMISSMTPLGRIAEPADHAGLYALLASRRDSSYLTGTMLLSDGGSGIGNRPDG

SEQ ID NO: 84166 - protein, 305 aa, Methanosarcina mazei Go1
MVKPEKFIPKAIEKISKEIKDGKAIIALSGGVDSSVCAELAYRAIGDRLQPIYIDTGLMRKGETERIRHIFSHMNLDVVYAKDRFLAALAGVTDPEEKRKAIGETFIRVFEEEARKLAADYLIQGTIYPDRIESEGGIKSHHNVGGLPSVMDFKKIVEPIEDLYKDEVREVAWALQLPDEICERMPFPGPGLAVRVLGEVTEEKLEVAREANFIVEEELLERFCPWQTFAAVLGKGTGVKGDVRAYGWIVAIRAVGSRDGMTAEALELPWEVLKHLESRITSEIPKVARVVYDITPKPPATIEFE

SEQ ID NO: 84167 - protein, 499 aa, Sphingomonas xenophaga
MATQLKSGTNEYGIKSEYGHFIGGEWISSDSGKTIDLINPATGAVLTKIQAGNAKDIQRAVAAAKAAFPKWADSSAAERQEILIEVARRLKARHQHYATLETLNNGKPIRESMHFDMPQAIGQFELFAGAAYGLHGQTMDYPDAVGIVHREPLGVCAQIIPWNVPMLMMACKIAPALASGNTVVLKPAETVCLSVIEFFVEMADLLPPGVINVVTGYGADVGEALVTHEDVRKVAFTGSVGTARRIMQYASTNIIPQTLELGGKSAHIVCADADIDAAVESATMSTVLNKGEVCLAGSRLFLHESIQDEFLAKFKVALEGIRQGDPLDFATQLGAQASQMQMDKVISYLELATEEGANVLTGGSANDKLADGNFIRPTVFTNVNNSMRIAREEIFGPVTSVISWKDEDDMMKVANDTNYGLAGGIWTRDIARAHRMARKLETGTVWINRYYNLKANMPLGGYKQSGFGREFSHEVLNHYTQTKSVVVNLQEGRTGMFDQ

SEQ ID NO: 84168 - protein, 292 aa, Methanosarcina mazei Go1
MELKRENVLIEALPYMQEFYDSIMVIKVGGNAMVSAQIMEDIIKDIVLLRYVGIKPVIVHGGGPEITEKMERMGKKAEFFQGLRITDDETMEIARMVLVGNINTKIVSLIGLFGGKGVGFTGYDGRMILGHKQAAKHVLIDGVETEVDIGWVGESEVINPEILHIMLEKGYIPVISPIAVDAKGNALNINADTVAGDIAAALHAKKLILMTDVSGLLRNIKDPGSRISRVKLDDIDLLIEEGVISGGMIPKIKGAAVAVKSGVERAHIINGSVSHSMLLELFTDGGVGTMIY

SEQ ID NO: 84169 - protein, 476 aa, Staphylococcus aureus subsp. aureus Mu50
MNESGDNKLSKSSLIGLVIGSMIGGGAFNIMSDMGGKAGGLAIIIGWIITAIGMISLAFVFQNLTNERPELDGGIYSYAQAGFGDFVGFISAWGYWFSAFLGNVAYATLLMSAVGNFFPIFKGGNTLPSIIVASLLLWGVHFLILKGVETAAFINSIVTVAKLIPILLVIICMIIAFNFDTFKTGFFGMTSEGVLPFSWASTMSQVKSTMLVTVWVFIGIEGAVIFSSRAKNKKDVGSATVIGLISVLIIYFLLTVLAQGVILQNHISQLDSPSMAQVLATIVGGWGSTLVNIGLIISVLGAWLGWTLLAGELPFIVAKDGLFPKWFAKENKNGAPVNALLITNILVQLFLISMLFTQSAYQFAFSLASSAILYPYMFSAFYQVKYTLEHRQQATTKQWTIGIIASIYAIWLIYAAGINYLLLTMLLYIPALLVYSIVQKNNQTRLIKSDYILFMIIIVLAVIGLIKLLMGTINVF

SEQ ID NO: 84170 - protein, 336 aa, Staphylococcus aureus subsp. aureus Mu50
MTEIQKPYDLKGRSLLKESDFTKAEFEGLIDFAITLKEYKKNGIKHHYLSGKNIALLFEKNSTRTRAAFTVASIDLGAHPEFLGKNDIQLGKKESVEDTAKVLGRMFDGIEFRGFSQQAVEDLAKFSGVPVWNGLTDDWHPTQMLADFMTIKENFGYLEGINLTYVGDGRNNIAHSLMVAGAMLGVNVRICTPKSLNPKEAYVDIAKEKASQYGGSIMITDNIAEAVENTDAIYTDVWVSMGEESEFEQRINLLKDYQVNQQMFDLTGKDSTIFLHCLPAFHDTNTLYGQEIYEKYGLAEMEVTDQIFRSEHSKVFDQAENRMHTIKAVMAATLGS

SEQ ID NO: 84171 - protein, 233 aa, Thujopsis dolabrata
APFMVNAYPYFAYRDNPKEVSLDYVLFGQSPGVKDPKGFTYNNMLDAQIDSVYSAMAALGHNDSIPVSVSETGWPSKGDPADIGVTPENARNYNTRVIKHVTSNAGTPMRPNRVIDTYIFALFNENQKPGPTTERNFGLLQPDGSKVYDIDLSCGYCGAAAPAPAPPPPAPLPMQWSRPANAGRQPGAIWCIAKPNADPSVLQESLDFSCGQGGADCAAIREGAPCYSPNTVH

SEQ ID NO: 84172 - protein, 401 aa, Vibrio parahaemolyticus RIMD 2210633
MTIEILVPDLPESVADATVATWHKQPGDTVERDEVLVDIETDKVVLEVPAPEAGVLEAILEVEGATVLSKQLLAKLKAGAVAGEPTADKTEATEASPDKRHKATLTEESNDALSPAVRRLLAEHGLEAHQVKGTGVGGRITREDIEAHLANAKAAPKADAPAVEAPATARSEKRVPMTRLRKTVANRLLEAKNSTAMLTTFNEVNMKPIMDLRKQYKDQFEERHGIRLGFMSFYVKAVTEALKRYPEVNASIDGDDIVYHNYFDISMAVSTPRGLVTPVLKDCDKLGFADVEKGIKELAIKGRDGKLTVDELMGGNFTITNGGVFGSLMSTPIINPPQSAILGMHKIQERPMAVNGKVEILPMMYLALSYDHRLIDGRESVGFLVTIKELLEDPARLLLDV

SEQ ID NO: 84173 - protein, 256 aa, Streptococcus mutans UA159
MKIGFIGVGKMASAIITGLKKTDFELIISDSSLKAGQDKAEALGVAVAQSHQELVDEVDLLVLGVKPQVLASVLNPLILTKPILSMAAGTSLEYLDKLSQADLPIIRIMPNLNAKILQSSTAICRNDKVSDQLFAIAKQITDSFGTTFEIAEKDFDTFTALAGSSPAYIALFIEAMSKAGLKHGFPKDLAFKIVSQTVLATTSNLIQGQEKPNDLIDKVSSPGGTTIAGLLDLEKTGFTASTISAIDATIDKSKNM

SEQ ID NO: 84174 - protein, 388 aa, Vibrio parahaemolyticus RIMD 2210633
MNLHEYQAKQLFAEFGLPVPEGYACDTPQEAFEAAGRISTAKKVVKCQVHAGGRGKAGGVELHDTKEGVKEFAQKWLGKNLVTYQTDANGQPVTKILVEEASNIANELYLGAVVDRASRKIVFMASTEGGVEIEKVAEETPELIHKAAIDPLVGPQAYQGRELAFKLGLEGDQIKQFVKIFMGLGTMFSQYDLALLEINPLVITAEGNLLCLDGKINIDSNALYRQPKLREMHDPSQEDEREAHAAQWELNYVALDGNVGCMVNGAGLAMGTMDIVNLHGGKPANFLDVGGGATKERVAEAFKIILSDDNVKAVLVNIFGGIVRCDMIAEGIIGAVKEVGVSVPVVVRLEGTNADLGREVLANSDVDIIAAESLTDAAQKVVAAAEAK

SEQ ID NO: 84175 - protein, 646 aa, Bartonella henselae str. Houston-1
MKNMPVETTYRVLARKYRPQNFSDLIGQEAMVRTLTNAFETGRIAQAWMLTGIRGVGKTTTARILARALNYKTKDIDQPTTVLNTLGEHCTQIIEGRHIDVIEMDAASHTGIDDIREIIEQIRYRPVSARYKVYIIDEVHMLSTQAFNGLLKTLEEPPPHVKFIFATTEIRKVPITILSRCQRFDLRRIESAVLSAHLRQIAQHENVEVEDQALSMIARAAEGSARDALSIFDQAIAHSNGKISAVTVRAMLGLADQARIIDLFEFLMKGNVVNALHELRSQYDAGADPLTILTELADFNHLVTRLRFTPEILEDLSLTEDERLRSLDFSKKLSVPVLSRNWQMLLKGLQEVNQTARPLQAAEMLLIRLAHVTDLPTLDEALKKLMQETTPLTIVSNSSHQESTSTNNTTKIEAANAYSSLQVANPSSHQPDCKTSVTNHLNDCLQSENLLKFQNLESSHSPEVTEILETSQSVTNPQNITNLPHPSTHTTKQATQPKAIVIDSLHDIVKLAEQHDEITFKLLITEFVHPVSFEPGHIILRIAENAPHSLKNDIKKMLSQWTEKRLTITFVNEGGGPTLQEESMAIQKTLFSNAEADPDIAKILYHFPEAKIVDIRLNKQENNLDLLPNTFKNADTFKNENDIDDE

SEQ ID NO: 84176 - protein, 331 aa, Camellia sinensis
MEVERVQALSHVTLHELPAKFIRPVHEQPENSKAIEGVTVPVISLSQPHDVVVDALSKACSEWGFFLITDHGVEPSLIGRLKEVGEEFFNLPQKEKESYANDPSSGSFEGYGTKMTKNFDEKVEWIDYYFHVMHPPKKLNLDMWPKNPSSYRGVTEEYNVEIMRTTNKLFELLSEGLGLDGKVLSSSLGGDEIEFEMKINMYPPCPQPQLALGVEPHTDMSALTLLVPNDVPGLQVWKDGNWVAVNYLPNALFVHVGDQLEVLSNGKYKSVLHRSLVNKERTRMSWAVFVVPPHEAVIGPLPELIDEKNPAKYSTKTYAEYRHRKFNKIPQ

SEQ ID NO: 84177 - protein, 319 aa, Rubrobacter xylanophilus DSM 9941
MGMLVDGKWVAEDRLSDERGRFVRRESRFRRWVTSDGSGGFAPEPGRYHLYISWACPWAHRTAIVRRLKGLEGAISLSSVLPRMGEDGWEFAPSGEFSDPLYGARYLREIYLKADPRYTGRVTTPVLWDRREATIVNNESREIMRMLDTEFERLATTGASFYPEELREEVDRALDELYEPVNNGVYRAGFAATQEAYDEAVTGLFDALDRYEELLGRRRYLLGGRVTEADWAFFTTLVRFDPVYHYHFKCNLRRISDYPNLWGYLRDLYQRPGVAETVRLDHIKEHYYTSHASINPSRIVPKGPVLDLSAPHGRERLGG

SEQ ID NO: 84178 - protein, 287 aa, Bartonella henselae str. Houston-1
MKILKKTNKISFQGEYGANSHIACTNMFPNMDALPSTTFEDALNLVENGQADLAMIPIENTLAGRVADIHHLLPQSSLYIIDEYFLPIHFQLMVLPGVTHKEIETVHSHAHALAQCRKIIRNNGWQPVTSADTAGAAKFIKKNGKRSQAALAPLIAAELYGLDILEKNVEDSPHNITRFVILSRSQRHVPKPQNGEKIITSLLFRVRNVPAALYKAMGGFATNGINMTKLESYQIGGNFNATQFFVDIEGHPEDPMMQLALDELSFFSAELRIIGIYPAKNGRRSHI

SEQ ID NO: 84179 - protein, 451 aa, Pasteurella multocida subsp. multocida str. Pm70
MTKHYDYLAIGGGSGGIASINRAASYGKKCAIIEAKALGGTCVNVGCVPKKVMWYGAQIAEAIHQYAPDYGFDLQVNKFDFAKLVESRQAYISRIHTSYHNVLAKNNVDVIQGFAKFVNANTVEVNGEHITADHILIATGGRPSHPAIPGAEYGIDSDGVFALSELPKRVAVVGAGYIAVELAGVMNSFGVKTHLFVRQHAPLRHFDPLIVDTLLEVIQQDGIQLHTQAIPQEVVKNADGSLTIKLEDGRSQEVDCLIWAIGRHPATDTINLEASGVETNARGFVKVDKYQNTNVEGIYAVGDIIEGGIELTPVAVAAGRRLSERLFNNKPNEHLDYNLVPTVVFSHPPIGTIGLTEPKAIEQYGEENVKVYKSSFTPMYSAVTQHRQPCRMKLVCVGKEEKIVGLHGIGFGVDEMIQGFAVAIKMGATKADFDNTVAIHPTGSEEFVTMR

SEQ ID NO: 84180 - protein, 502 aa, Kineococcus radiotolerans SRS30216
MSTLTASGVAGPRASRDRERVSSPTPPDVPTSPSPARGDAVDSYDVVVVGGGPAGVSAAVRAAELGARTALLEGSRTGGTCVNTGCVPTRVLAKTARLVREVRTAAEYGIAVPQQSVDWPATVARVRATVERVQAAKADPQRLADLGVDLVLEGRARFVDPHVLELAATGRRVRGESVVLCVGGRSRRLPLPGAELATYPETVLELPSLPRRLAVVGAGNTGSQLVTVFRALGSEVQLLDLAPRVLPTADADVSHAVRRAFEEQGVRVATGIDAVHSLRRRADGAIDLAWSQGGTRSEEAFDAVVMSVGWPAALDGLGLEAAGIEVTRSAVAVDEHLRTSVPHVFAAGDANGQAMLVQAAHAEAEAAATNAVLGATRRTPHLLLPSGGFTDPDYAGVGLTEDEARARDPHCLVVTVPFTAMERAIIDDRTRGFLKLIADRRRDVLLGAHAVGEEAVEIVQAVTTAMAAGVDVATLARVEFAYPTYSAVIGEAARRLMRAAVA

SEQ ID NO: 84181 - protein, 212 aa, Oryza sativa
  misc_feature (81)..(81): Xaa can be any naturally occurring amino acid
MFGCANDYPRDDVKKGHLCCADFSDICPKEVSCYNCAQPGHTGLGCAKQRREASTAATPTLCYKCGEEGHFARGCTKNTKXRKKGKGKKDFGTRSAPHDARKTSKRKSPLFEERRNSSHFKSKARGGWIADDADDQPYKKCKPNVWASPSTPKKQYNNHQFSSGGDYSTPQSSRWQKHGFASPSATYSPNTRKHSFSSSRFASNTHVRFGRS

SEQ ID NO: 84182 - protein, 239 aa, Arabidopsis thaliana
MAATASSLTIASSFSEPRTQIHSSRRLNLPLQYSIPYKVLRSRSRRLGLVVSSVSAPNVELRTGPDDLISTLLSKVANSDGGVTLSPEQHKEVAQVAGELQKYCVKEPVKNPLIFGDWEVVYCSRPTSPGGGYRSVIGRLFFKTKEMIQAIDAPDIVRNKVSINAFGFLDGDVSLTGKLKALDSEWVQVIFEPPEIKVGSLEFKYGFESEVKLRITYVDEKLRLGLGSKGSLFVFRRRQ

SEQ ID NO: 84183 - protein, 199 aa, Triticum aestivum
  misc_feature (109)..(109): Xaa can be any naturally occurring amino acid
MKHRTQEVHVAGRTTLATVTSNPGVVRRWVYTTRWRSRRRLCSGAGLTVGMGVQWTPSFRRLPDGAEPRPATLQLCSGRRCLVFQIGRAGAGRVPLVLRRFLEDARVDXVAYDVLSDCRKLSAHYGLRVACPRELRKVTGMGNASMESMAEQVLGWRGVKKAQRVGAGNWDVSTLSKKQVRYAATDAFVSYCLGVKCLK

SEQ ID NO: 84184 - protein, 159 aa, Candidatus Blochmannia floridanus
MDVIEGNTVVSNITKIVVVVARFNKAINNHLLEGTIDTLKRVGQVQDENITIVWVPGAYELPLVSQALSISNKYDAIIVLGTIIRGITEHFEFIYKSCNFGLSNISISNLVPIGLGLLVTNDIGQAVERIGIKGNNKGSEAALAALEMINILKTIKNNN

SEQ ID NO: 84185 - protein, 617 aa, Candidatus Blochmannia floridanus
MSLKLNKYSILELIDTPTELRQLTENKLQTLCSELRLFLLNSVSKSSGHFASGLGTIELTVALHYVYNTPFDHLIWDVGHQAYPHKILTGRKNRIYSIRQRHGLHSFPCRNESKYDVLSVGHSSTSISAGLGLAIASEREKLNRRTVCIIGDGALTAGMAFEAINHAGTIKSNLLIILNDNNMSISENVGALHTQCPQQKKYTNITSDIKKIINSNIYNKNKNTSTAIALFSNLGFNCTGPIDGHNILTLIHNLKNIRNTKTGPQFLHVITKKGYGYKPAEKDPIKWHAVPKFNLKSGILSTNKNIKYTTYSKIFGDWLCQTAMHDNKIIGITPAMREGSGMNKFAQKYPKQYFDVAIAEQHAVTFSAGLAIAGYKPVVAIYSTFLQRAYDQIIHDIAIQKLPVLFAVDRGGIVGSDGETHQGAFDLSYLRCIPNLIIMTPSNAYECKLMLHTGYHYQYGPSVVRYPKGCATNNILYPYNNTTSLYSIPLSKGIIHHQGQHIAILNFGTLLKPAYNVALQLNATLVDMRFVKPLDEMLIKKLTENHQAFITLEENSIIGGAGSGVNEFLVQNKLLIPTLNIGLPDFFIPQGAQREMLSELGLDSQGIYKKIVRWIKI

SEQ ID NO: 84186 - protein, 159 aa, Lactobacillus acidophilus NCFM
MNIKIVCVGKLKEKYFKDAIAEYQKRLSRFAKVTIVQVPDEKAPEKFSEAEDEKVKEIEGQRILSKIKDKEYVYVTAIKGKQRSSEEFAKEIQDLGTYGHSDITFVIGGSLGTSDAVNKRADDLISFGKLTMPHQLMRVVLIEQIYRAFMINSGSPYHK

SEQ ID NO: 84187 - protein, 754 aa, Alkalilimnicola ehrlichei MLHE-1
MLEVLHRISREVNAAPGLRQALSIIVKRVADAMKVDVCSVYLMDPETERLVLMDTRGLNPDAVGRVRLRLSEGLVGMVAERGEPINLDNAYDHPRFRYFPETGEELFHSFLGVPIVHYRKLLGVLVVQQMAERRFDEDDVAFLVTLGAQLAGAIAHAEASGGLDGLRDGDVAQGRMLQGLPAAPGVAMGTAVVHSAQVDLESVPDRDPEDIEEEKRQFMVAVRAVREELGRLSKELEGTLSSDEHMLFDVYLRMLDDDSLVGETLRAIEAGNWAPGALREIIGGHVQVFQDMEDPYLRERASDIRDLGSRILARLREDTRRSRPLPERVILVGKEVSATQLAEVPQDHLAGVVSASGTRNSHVAILARALSVPAIMGASDLSTGRLDGKPVIVDGYSGRFYVQPSDAVREEYERLARDEAEFADSLESLKDEPAETPDGYRIKLLANTGLISDINLSLASGCDGIGLHRTEFPFIVRDRFPGEEEQAMLYRRVLEYFRPRPVVLRTLDIGGDKSLPYFPVHEENPFLGWRGIRLTLDHPEIFLTQLRAMVRANIGNGNLRVMFPMISRLHEVDEAKALLARAVEELREEGMEVEMPPVGVMVEVPAAVAMADKLAQRVAFLSVGTNDLTQYLLAVDRNNARVAALYDELHPAVLNAIAQVVDSGRQYRCPVSVCGGMAGDPAGAILLLALGVSSLSMSVASLLRIKWVVRSISRERATELLTLALDMESPDDVRAMLKRALDEQGLGGLIRAGK

SEQ ID NO: 84188 - protein, 486 aa, Citrus sinensis
MASSSLLCFGLCLLVLFNACFAQIEQVTDITREGKQQRQRQQRFQTQCNIQNLNALEPRQKVESEAGVTEFWDQNNEQLQCANVAVFRQRIQQRGLLVPAYTNTPEIFYVVQGRGIHGVVFPGCAETFQDSQASSRSRAVNPKNNTKRSDNYVRVMSLHCLLEQLTGFTTMAGTSLFWSPSLNVGNSQNQLDQYFRKFYLGGNPQPQLQGFSQSQGGRSQGSQGSDDGRGGNLFRGFDERLLAEAFNVNPDLIRRLQRPQIQRGIIIRVEEELRVLSPQRDREQEQEECEETPSYERDNGFEETICTMKLRHNIDKPSHADVYNPRAGRVTTVNRFNLPILRDLQLSAEKGNLYPNALLAPQWNLNAHSIVYVTRGNGRMQIVAENGENVFDGQIREGQLIVVPQGFAVVKRAGNRGLEWISFKTNDVAMTSQLAGRASVLRGLPLDVIQNSFQVSRDEAQRLKYNRQELTVFTPGPRSQWGLTVA

SEQ ID NO: 84189 - protein, 315 aa, Synechococcus sp. WH 7805
MFFMTATARSPEGLMPSGENQADFDFSAYLAKTRNLVEGALDAALGPERPESLRESMRYSLLAGGKRLRPILCLAACELVGGDASLAMPTAVALEMIHTMSLIHDDLPAMDNDDLRRGRPTNHKVYGDAMAILAGDALLSRAFEMVSLRSPGVPPERLLKVVAELALVSGAPGLVGGQVVDLESEGREVDLETLEYIHLHKTAALLRACVVTGALIGGADANQVEAMRTYANGIGLAFQIVDDILDVTASSEVLGKTAGKDLIADKTTYPKLLGLEPSRARALELVAQAKSALEPWTSKAQPLLALADYVASRDR

SEQ ID NO: 84190 - protein, 405 aa, Aspergillus oryzae
MSHTEAARTDSLGEQETRGDVESDKKAKNRRPANTAFRQQRLKAWQPILTPRSVLPLFFVVGVIFAPIGGLLLWASSEVQEIVIDYSECADKAQRTPVPIPDKVQSSFKSSNQQPNPTWMKYRDEQTNETICRLSFKIPESIEPPVFMYYRLTNFYQNHRRYVKSLDIDQLKGKPVDNKTIDGGSCDPLKLDDSGKAYYPCGLIANSMFNDTIKSPELLNDGNDDDPVVYVMTNKGIAWDSDKQLIKTTQYKPGQVVPPPNWQARYPHNYTTEIPDLHDNEEFMVWMRTAALPNFSKLSRRNDTTAMSPGTYQLDIADHFPVTEYGGTKSILISSRTVIGGQNPFMGIAYVVVGGLCVLLGALFTIAHLVRPRKLGDHTYLTWNNEQESSAIATGRDNRFGPNTH

SEQ ID NO: 84191 - protein, 512 aa, Zea mays
MGLCSSSTAARAASDPGAAAAGDAAAAKKGRGIVACGKRTDFGYDKDFEVRYSLGKLLGHGQFGYTFAAVDRASTERVAVKRIDKNKMVLPVAVEDVKREVKILKALQGHENVVHFYNAFEDDNYVYIVMELCEGGELLDRILAKKDSRYSEKDAAVVVRQMLKVAAECHLHGLVHRDMKPENFLFKSKKEDSPLKATDFGLSDFIKPGRQFRDIVGSAYYVAPEVLKRRSGPESDVWSIGVITYILLCGRRPFWDKTEDGIFKEVLKKKPDFRRKPWSNITSSAKDFVQKLLVKDPRARLTAAQALSHDWVREGGKASEIPLDISVLHNMRQFVKYSRFKQFALRALASTLNSEEMSDLRDQFNAIDVDKNGTISLEELKQALAKDVPWRLKGPRVLEIIEAIDSNTDGLVDFEEFVAATLHVHQLVEHDTEKWKSLSQAAFDKFDVDRDGYITPDELRMHTGMKGSIDPLLEEADIDKDGKISLDEFRRLLKTASMSARNVQTPRGVRKS

SEQ ID NO: 84192 - protein, 488 aa, Burkholderia sp. 383
MGKATGFLEFERRHEAYEAPLTRVKHYKEFVAALTDADAKVQGARCMDCGIPFCNNGCPVNNIIPDFNDLVYRQDWQQAIEVLHSTNNFPEFTGRICPAPCEAACTLGINNDPVGIKSIEHAIIDKAWAEGWVKPLPAEHKTGKKVAVVGSGPAGLAAAQQLARAGHDVTVFEKNDRVGGLLRYGIPDFKLEKWLIDRRMRQMEAEGVTFRTSVFIGKDPLPESIGSLAKETISPETLKEEFDAVVIAGGSETPRDLPVPGRELAGVHYAMDFLPQQNRVNAGDKLVDQLLAKGKHVIVIGGGDTGSDCVGTSNRHGAKQVTQFELLPQPPEEENKPLVWPYWPIKLRTSSSHDEGCERDWAVATKRLEGKNGKVEKLIAVRVEWKDGKMQEVPGSEFEMKADLVLLAMGFTQPAAPVLEAFGVAKDARGNARAATEGDRSYYTSVDKVFAAGDMRRGQSLVVWAIREGRQCARSVDAYLMGHSNLPR

SEQ ID NO: 84193 - protein, 369 aa, Oryza sativa Japonica Group
MEEKCDMSMGKWVREPKGPVYTNTTCPTLPDFKNCQKHGKDPGHLYWRWQPHGCDLPRFSPDRFLAAVRGKRLAFIGDSLARNQMDSLLCLLSQAETPTEVYRDAHDKFQTWRFAAHEFTLMVMWTEFYVHAEPVVGADGKPTPSFDIHLDRLSANWTRRLPELDYAVISGGNWFNRPNYLWEGGRRVGCVKCGGAANLTDVGVPYAVRRVVRAAVEGIARCTGCKAGLVAFLRTFSPDHFEHGAWFSGGYCNRTRPLEEDEVSPDSAAWELRRVQREEVMRVKETAAAAAAASGNARRFEVLDVTKAMMLRADGHPGAAIDKRWQKNIVSDCLHWCMPGPVDMWNEMLLQRLTEISTLDQDASIFEAP

SEQ ID NO: 84194 - protein, 634 aa, Burkholderia sp. 383
MYDLLKTIDDPADLRRLDRRQLQPLADELRAFVLDSVSKTGGHLSSNLGTVELTIALHYVFNTPNDRIVWDVGHQTYPHKILTGRRDQMHSLRQQDGISGFPRRSESEYDTFGTAHSSTSISAALGMAIGSQLNGDDRFSIAVIGDGAMTAGMAFEAMNNAGVSEDAKVLVILNDNDMSISPPVGALNRHLARLMSGRFYAAARAGVERVLSVAPPVLELARKLEEHAKGMVVPATLFEEFGFNYIGPIDGHDLDSLIPTLQNIRELRGPQFLHVVTKKGQGYKLAEADPVLYHGPGKFNPAEGIKPSTTPAKKTYTQVFGEWLCDEAERDTRVVGITPAMREGSGMVEFEKRFKDRYYDVGIAEQHAVTFAGGMATEGLKPVVAIYSTFLQRAYDQLIHDVALQNLPVVFAIDRAGLVGADGATHAGAYDLAFMRCIPNMTIMAASDENECRQMLHTALQQPNPTAVRYPRGAGTGVPTVKEFTEIPLGKGEVRRQTSQPEGKRVAILAFGTMVAPSLAAAEELDATVANMRFVKPVDAALVRELAETHDYLVTVEEGCVMGGAGSACVEALMESGVIRPVLQLGLPDLFIDHGDPAKLLSQCGLDGAGIAKSIRERFLNPAADVAGQAKRVA

SEQ ID NO: 84195 - protein, 164 aa, Xanthomonas axonopodis pv. citri str. 306
MSLIATFDTSRGPIVVELYPDKAPLTVANFVNLAKRGFYNGLSFHRVIADFMIQGGCPEGSGRGGPGYRFEDETNNGVGHERGVLSMANAGPNTNGSQFFITHTATPWLDGKHTVFGKVTQGLDVVDSVAQGDTINTLTIEGDTDAVLAAKADRVAEWNKILAA

SEQ ID NO: 84196 - protein, 463 aa, Bradyrhizobium japonicum USDA 110
MHSPNPDMSQLFADRQAQRSALHNRYLNEQFVRVLKTIGYDVGFQKGQGQYLYDRDGARYLDLLSGFGVFAIGRNHPVMRDALKSVLDADLPNLVQFDVSTLAGVLAERLLKYVPYLDKAFFANSGAECVEAAIKFARGATGRPGIVYCAHGYHGLTYGALSLTGDSNFRTGFEPLLPGCTPVPFNDLAALEKALASREVAAFVVEPIQGKGVNMPTDEFLPGAAALCKKYGTLFVADEIQTGMGRTGRFLAVEHWNVEPDMVLLSKSLSGGHVPVGAVLTRKGIFDKIFNQMDRAVVHGSTFSKNDLAMAAGIATLDVMESEKLIESAAKRGAELRLALTRMVPGYELMKEVRGKGLMIGVEFGPPKSLRLRASWNVLEAANKGLFCQLITVPLFKDHKILTQVAGHGSHTIKLLPPLTITEEDCGWIERAFDDVIAGSHKVPGAIWSLGKTLVDNAVRRSA

SEQ ID NO: 84197 - protein, 316 aa, Magnetospirillum magnetotacticum MS-1
MTTTLNGSGSHVRHFLDLKDFSAETLRGVLDASAAMKRARVKGRRAEERPLTGKMLAMVFDRPSTRTRVSFDVAMRELGGDTLMLTGKEMQLGRGESVADTARVLSRFVDAIVIRTLDHTLMVELAEHATVPVINALTKVSHPCQIMADVLTFEEHRGPIKGRTIAWSGDANNVLASWVHAAARFDFTLNVAAPNELAMPPALVAWAEREGARVNATTDAYAAVEGADAVVTDCWVSMGDDDEHFRHNLLSPYRVDAALMAHAAKDAIFLHCLPAHRGEEVTADVIDGPQSVVFDEAENRLHAQKGILAWCLGEAA

SEQ ID NO: 84198 - protein, 175 aa, Triticum aestivum
  misc_feature (165)..(165): Xaa can be any naturally occurring amino acid
MAPTVMASSHTSVAPFQVLKSTAGLPVSRRSSSAGLSSVSNGGRIRCMQVCPIEGIKKFETLSYLPPLSTEALLKQVDYLIRSKWVPCLEFTKVGFVFREHNSSPGYYDGRYRTMWKLPMFGCTDATQVLNEVEEVKKEYPDAYVRVIGFDNIRQVQCVTFIAFXPPGCEESAKA

SEQ ID NO: 84199 - protein, 330 aa, Wolinella succinogenes
MAKPQVTILATGGTIAGSGESSVKSSYSAGAVTVDKLLAAVPAINDLATIKGEQISSIGSQEMTGKVWLKLAKRVNELLAQKETEAVIITHGTDTMEETAFFLNLTVKSQKPVVLVGAMRPGSSMSADGPMNLYNAVNVAINKASTNKGVVIVMNDEIHAAREATKLNTTAVNAFASPNTGKIGTVYYGKVEYFTQSVRPHTLASEFDISKIEELPRVDILYAHPDDTDVLVNAALQAGAKGIIHAGMGNGNPFPLTQNALEKAAKSGVVVARSSRVGSGSTTQEAEVDDKKLGFVATESLNPQKARVLLMLALTKTSDREAIQKIFSTY

SEQ ID NO: 84200 - protein, 505 aa, Methanosarcina barkeri str. Fusaro
MATLRGHEKVFSIAVTPNGKYAVSGSHDGTLKVWDLEKWREIRSLRAHSKSITAFAITSDGKLVVLGSLDGNLEVWNLETGEEKAAFKEHSEPITEIVITPDGKRAVSGSSDNTLKVWDLEKMEELTTLISHSNSVSKIAITPSGKYAISGSSDNTLKVWDLKKLDEETISTGHSKSVNKIVITPDGKLAVSSSYDGTLKVWDLKTKEEKVTLKGHSGPVTDFVITPDGKRIISGSSDKTLRVWDLKKGNMTLKGHKREVTSVAITSDGKYAISGSFDRTIKVWDLENGKIKVTLEGHKNYISTISIIPNKNCIVSSSHDETLKVWDLDRGIDTITLIGHSGSVSSVAITPDGKSIVSASGDGTHKIWSLENREEIATLEGHKSAPSTIVITPDGKYAVSASYDRTIKILDLKKQIVKTSLRGHTDSATLVAVTSNSRYVVSASRDNTLRVWDLESSSEVSCFTGDVPFTAFDILKDENIIVVGDSLGKVYFFHLHIPCKNNFYF

SEQ ID NO: 84201 - protein, 127 aa, Oryza sativa
YYNLPRDDDGLLHPDEHYLKNRTDSNCSQSSCTNLSSILEHRPSLVSRMPNIKIFGGSSHPELTRLICARLGLEPGRVITRKFSNGEISVEINESVRGEDVFIVQSGCGEINDNIMELLIMINACKI

SEQ ID NO: 84202 - protein, 396 aa, Flavobacteria bacterium BBFL7
MPAISHKGAIMPSSPVRKLVPFAEAAKKRGIHIYPLNIGQPDIKTPNQAIQAVKDTDMEILAYSHSAGNESYRTKLATHYNKLDMGLTVDDIIVSTGGSEALLFTMGSICDYGDEVIIPEPFYANYNGFATASGVTVKPISTNIENNFSLPSISDFEKLITDKTKAILICNPGNPTGYLYTQDEMNQLAALVKKHDLFLVADEVYREFAYDGRKHLSVMNMTGLEQHAIMIDSVSKRYSMCGARIGCMVSKNKEVMATAMKFAQARLSPPTFAQIAAEAALDTPQAYFDEVIGEYIERRNILIEGLKNIPGVQVANPGGAFYCVAQLPVDDTDAFAQWMLESFELDNETIMVAPAAGFYSSPGVGKNQIRIAYVLEKESLIKAVQILAEALKVYQA

SEQ ID NO: 84203 - protein, 314 aa, Synechocystis sp. PCC 6803
METIRLGPNGPSIAPLGLGTWSWGDTLFWAYGKDFGPQEVEGAFHASLEAGVTLIDTAEIYGFGESERLIGRFCREKTQKVEIATKYFPLPWRWQRSDITKALTASLERLQMDTICLYQIHWPLEFWLKTPDFMAVLAAEVKKGRIQAVGVSNYSAQQMAIAHECLAAQGIPLASNQVPYSLLNREIESNGILTQARQLNVTILAYSPLAQGLLTGKYRPENSPSLQGARRLDPRFSTKGLRKLAPLLTLLDTLADKHDKTPAQIALNWLIAQGNVIPIPGAKNASQAQQNAGALGWQLNPEEIEQLRSAAQGI

SEQ ID NO: 84204 - protein, 344 aa, Pichia guilliermondii
MASKDIVHPQPERRHGSETHEFTMPLLSPTLTPSHIPSQTPQIPPEVPAEVRDRLPLPETLPVVKCMARARIPTTQGPEIFLHLYENNVDNKEHLAIVFGEDVRSKTLYQKRPNETQQDRMTRGAYVGRLFPGRTEADYDSESNLRVNFDVNGQLIRDPSTTCSGEPILSRIHSECYTGETPWSARCDCGEQFDEAGRLMGEAGHGCIVYLRQEGRGIGLGEKLKAYNLQDLGADTVQANLMLRHPADARSFSLATAILLDLGLNEIKLLTNNPDKIAAVEGRNREVKVVERVPMVPLAWRSENGIKSKEIEGYLTAKIERMGHLLVSHSRYDRRDEVKDLRNK

SEQ ID NO: 84205 - protein, 486 aa, Agrobacterium tumefaciens str. C58
MKFDNSYAHLPERFSAAVLPTPVKAPRLIAFNRTLAEELLLDVADLDDDRLAAIFSGNVVPQGAEPLAMAYAGHQFGGFVPQLGDGRAILLGEVIDVNGRRRDIQLKGSGPTPFSRRGDGRAALGPVLREYIVSEAMFALGIPATRALAAVLSGDRVQREVGLPGGVFTRVAASHIRVGTFQFFAAREDDEAIRSLADYVIDRHYPDAKNTENPYLALLRGIAERQCALIARWMMVGFIHGVMNTDNMAVSGETIDFGPCAFLDEYHPNKVFSSIDAQGRYAYNNQPGIAQWNIARLAECLLPLLDPEVEKAAELANAVLADFAAAFPQRWLTGMREKLGLTTEEEGDMDLIQSLLSLMQASEADFTLTFRRLSHAANGDAEPFRGMFIDIAGADAFLTRWRERAGREGISDSERSAAMLSINPAIIPRNHRIEELIEAAVEDGDFEPFHAMLTAIATPFEERPDNFVYMQPPMSHERVFRTFCGT

SEQ ID NO: 84206 - protein, 457 aa, uncultured marine bacterium 442
MSYSNHFVPPHPKPLPALPALARVLWHGDGNLLELMPGEAYRFDFGNLGYSRRSTVLFNQPELVREILRDDGSRFPKSDLMVNALEPLIGQSIFVTDGARWKRQRGMIDPAFSQLRVSHAFDAMQSAVLDHLDVLDGHADSGDSFSLDMAMSHLTADVICRTIFSTPLAAGVSSDVFEDFTEFEQSVAQVDIFRLIFQKAWAKMPQPPGVLAACQRIRGHLGDLVDPHLENPGAFNDIASDVIAAKDSDTGEAFTREELIDQLGVFFLAGHETSASALTWVFYLLAEQPTLVLRLRNELEHVVGSGPINFNHVKQLPLVRAVFRETLRLYPPITFIPRVALEDCEIGPRKLRRGALVMVSPWTIHRHQRYWSDPDAFIPDRFLVEGESSIQEGAYIPFGVGPHTCIGAGFAQAEAVLIIAELVRRFDFSRADRQSVRPAARLTTRPAQQIKLHCQRL

SEQ ID NO: 84207 - protein, 109 aa, Physcomitrella patens
HEPVSGLPALRMPKIVCSAEKKESQTEELSGFPQLAAAVTSAATLAYAHPVFALVDERLSTEGTGLGLGISNTKLTWILVGVTALIWALYFFVLLDVGQRVTMTSGLDL

SEQ ID NO: 84208 - protein, 331 aa, Flavobacteria bacterium BBFL7
MVKVKVAINGFGRIGRTFLRTVIEHENIEVVAINDLAPTHVMAHLLKYDSIHGTLSQDVSHTLDALIINGKIITFTHYHRLEDLNWTDVDVVLESTGKFKTLQQLQKHRDAGAKKVILSAPPVDDDIKTVVLGVNDHIINDDDIILSNASCTTNNAAPFIKVLDELCGVEQAYITTVHSYTSDQSLHDQPHNDLRRARAAGQSIVPTTTGAAKALTKIFPHLSDVIGGCGIRVPVPNGSLTDMTINVKRDTSIEEVNAAFLAFAKANPYTFSYTDVPLVSIDISGSPYSCIFDSQMTSVIGKLIKVIGWYDNESGYSNRLKDLILKISSPD

SEQ ID NO: 84209 - protein, 308 aa, Synechocystis sp. PCC 6803
MGIKALAGRDLLAIADLTIEEMKSLLQLAADLKSGVLKPHCRKILGLLFYKASTRTRVSFTAAMYQLGGQVLDLNPSVTQVGRGEPIQDTARVLDRYIDILAVRTFKQTDLQTFADHAKMPIINALSDLEHPCQILADLQTIKECFGKLEGLTVTYLGDGNNVAHSLILGGVMMGMTVRVATPKNYEPLAEIVQQAQQIAAPGGKVELTDDPKAAAQGSHILYTDVWASMGQEDLADSRIPIFQPYQINQELLALADPEAIVLHCLPAHRGEEITDAVMEGPQSRLWDQAENRMHAQKALMVALLGLV

SEQ ID NO: 84210 - protein, 69 aa, Physcomitrella patens
HEAATLAYAHPVFALVDERLSTEGTGLGLGISNTKLTWILVGVTALIWALYFSYSSTLPEGDDDSGLDL

SEQ ID NO: 84211 - protein, 209 aa, Candidatus Blochmannia floridanus
MSYLYDSYFQYIHYNVSMIPTVVKQTSRGDRAYDIFSLLLKERIIFVIGKIENFMANLIVAQIMFLESEDPVKDIHLYINSPGGEVTAGMSIYDIMQFVKPNISTYCIGQAASMGAFLLAAGTTGKRFCLPNSRVMIHQPLGSLHGQATDIAIHATEILKVKENINKLMAKHTGKSIDVIRQDMERDCFLSADESVKYGLVDSVLSKRI

SEQ ID NO: 84212 - protein, 237 aa, Zea mays
MSGSASRKLFQAARSIVLSASQRSSFSVLAAEGRTAALANFGRKILPSACSYHRQGSHAASGWGAIAAAVPAAVYMLQDQEAHAAEMERTFIAIKPDGVQRGLISEIVNRFERKGYKLVAIKLIVPSKGFAEKHYHDLKERPFFNGLCDFLSSGPVLAMVWEGEGVIKYGRKLIGATDPQKSEPGTIRGDLGVVVGRNIIHGSDGPETAKDEIALWFEPKELVSYTSNAEKWVYGVN

SEQ ID NO: 84213 - protein, 158 aa, Physcomitrella patens
GTRSPPTAMAAIASASCATAATRLATTSLASSSSGFAATLKPVAGLPALRMPKVVCAAERSESKAERVNGVAQLAAAVTSAATLAYSHPVLALVDERLSTEGTGLGLGISNTKLTWILVGVTALIWTLYLLTPRRCQRVTDDSVWTCRSRKQEFCVPF

SEQ ID NO: 84214 - protein, 561 aa, Chlamydomonas reinhardtii
MSALLARKAVVLGRPQPACTRPHLQLHHRRRVAVLGAQDGARSEVVIVDAPSSQNGVHHDPVPEPAPAAAAAAAAPAPEPAPTGPIGIKIVPAAVAIGIGLALRFVVPIPEGITAQAWSLLSIFVSTILGLVLDPLPVGAWAFMAVTVAVATKTLTFAEAFAATTNEIIWLIVVSFFFAKGFEKTGLGERIATLFVKALGKSTLGLSYGLNVAEALMAPAMPSTSARAGGIFVPIIKSLAHSVGSEPGCPPGDDSRKKMGSYLIQSQFQTGVHTTSFFLTASAQNLLCLKLAGELGAVVPNQFATWLAGAFVPAIVGTLLTPLILYKLSPPTITDTPDAPAAAAKRLEAMGPMSRDETIMSAVMGAALVMWMFGEQLGISPVLAAMMGLCGLLCTGVLTWRECLSYTPAWDTLCWFAVLIGMSGQLNSMGVINAFAGAMGNVLTSLNMGWMPLFGLLHVAFFVMHYMFASQTAHVGALYSAFCAMMLASGVPPVLAAMSLAYSINLFGSITHYASGQAAVFYGSGFMRLNEVFTMGAVSGFSALAIWGVFGMPIWKLLGWW

SEQ ID NO: 84215 - protein, 122 aa, Chlamydomonas reinhardtii
MEEETISIRFRHSAGDLGPFPFSEATSVQSLKDKVFAEWPKDGLWVKEPPAQSGDVRLILSGKFLDSAKQLKEYKRDMGEIKPDTIVTMLVHVRAQPAPAKPSAGATPPQKQEQKGCGCTIC

SEQ ID NO: 84216 - protein, 381 aa, Triticum aestivum
  misc_feature (345)..(345): Xaa can be any naturally occurring amino acid
MSAVAAALELVDPPGCRAYTYLRSQEVMGLCASTDGHLTEAEKRQLALDKAVNRQLDKAQQKDAQKDKVVKKLLLLGAGESGKSTLFKQMITIYGNGFSQEECKTYCSVIYTNIIACMRALCDAAPDYGDVECKEARQYVLDMQDDDTAQINSTNVAHFKALWKDPCILKAYENRSKFQLPDSAYYYFERLDVIAAPGYIPTEQDILRSRVKTSGIVVNDFLVEGNEFKMIDVGGQRNERKKWIACFEGVTAVLFIGVLSEYDLVLSEDDSQNRMVETLTLFEEICKSPFFVKTAMILMLNKRDLFIEKVRSVPLTECPLFANYTGPNTYDAGLNLIQSTFLSKXRAVIYTHVTCATDTRHEIVSSREDIVSGSLMTWVCC

SEQ ID NO: 84217 - protein, 93 aa, Synechococcus sp. WH 7805
MASFTITLEGGKSFSCADDQYILDAAEEQGVDLPYSCRAGACSTCAGKVLSGSVDQSDQSFLDDEQMGNGYALLCVSYPMADCTIKAEVEDEL

SEQ ID NO: 84218 - protein, 528 aa, Bordetella petrii
MSDQFSTTQIVRKTVIRTAGGLVASQHRKAAEAGAQVLAAGGDAVDAAVAVSFAAGVVEPWMSGPMGGGAMTLYRADEDRAKVVYFGMRSPAGLDPAHYPLAGGGAVSSDLFPWPAVQDDRNARGATAVAVPGTVAGMELAHATYGRLPWRELLQPAVALAREGLLIDWYTTLMIAGSARWLARDPDAAQMFLDDGAWPKASGWSAAAGLRIAMPRAADMLASLAEQGPRAFYDGDIGAELARDVQAKGGCLSHQDLRDYRALLQEPLSIPYRGGRIHATPEMTAGPSLARCLQRLQSRLQPGRAPGADAYTAYAEVLRDEYRWRLSNMGDNEDPRTPACTTHFSVVDRHGNQCAVTQTLLSAFGSHVVSPSTGMLLNNGIMWFDPEPGKANSLAPARRCLMNICPVVGEAGGRRFALGASGGRKILPAVMQLVSFLVDYGMSLEDAFHHARLDASTDVLLLDPKLPRDAYEALAAAHPHAAAPRTLYAYAYACPSGVLREDGHNEGCTEIMSPWGDVALSETYAAAG

SEQ ID NO: 84219 - protein, 400 aa, Candidatus Blochmannia floridanus
MVMIKMSDVDLFNKRILIRADLNVPIRNGIITSARRIHASLPTIQLALSRSNQVMVTSHLGRPVEGEYDSQFSLQPVVDYFQKNLSAKIGGVRLVKDYLDGINWISNELLILENVRFNKGEKTDDEVLAKKYASLCDVFVMDAFGSAHRIQSSTHNVSKFVKVACSGLLLEQEIAALHKALSNPVRPMVAIVGGSKVSSKLMVLESLSKVVDYLIVGGGIANTFLAAQGQNVGKSLYEAELISTAKSLLKDCNIPIPTDVRVSSEFSETAQSIMKNVTEIKDDEQILDLGDNSIINILNILNNAKTILWNGPVGVFEFPNFRKGTEMVSNAIANSNAFSIAGGGDTLMAIDLFGIANQISYVSTGGGAFLEFIEGKTLPSIEVLEEHKRMRNGNYSDINY

SEQ ID NO: 84220 - protein, 336 aa, Hyphomonas neptunium ATCC 15444
MTVRVAINGFGRIGRLVLRSIIEHGRTDIEVVAINDLGPVETNAHLLRFDSVHGRFPADVKVDGDKIVINGKPILVTAIRDPKDLPHRELDVDIAMECTGIFTSKDKAEAHLAAGAKRVLVSAPADGADLTVVYGVNHDKLKKEHMVVSNASCTTNCLAPVAFVLNKAVGIDKGMMTTIHSYTNDQPSLDQMHKDLYRARAASLSMIPTSTGAAKAVGLVLPELKGKLDGISVRVPTPNVSLVDLKFIAKKSTTAEEINAAIIAAADAGPLKGILGYTDVPNVSSDFIHDDRSSIFHLDQTKVMDGNFVSIMTWYDNEWGFSTRMADTAIAIAKLI

SEQ ID NO: 84221 - protein, 340 aa, Candidatus Protochlamydia amoebophila UWE25
MRIGVIGINHKLADLKLRDALAKACQKRFGANQSVHDQHHFILLSTCNRTEVYFSSHDLTATHSYLLSILRQDVKEDFDHKLYSFFGMDCFSHLTRVTSGLDSAIVAETEIQGQVKNAYNLATTFLCLPKELHFLFQKSMGIAKRIRSELHLGRGLPNLEHAILQTGKYFFRNTQQPKILFVGASEINRKILHFLKSKQYSDMTICNRSEIRSKELAILYGLHLLPWCQLDSWHQYDWIIFGTKSSEYLIKPEKNFIPADNDKLIMDLCVPRNVEPKLGQNAKITLLNIDQINRLLKIRHRGMTQALIEAENRVNLATYEHTNRYRQKEDSKITIFAASA

SEQ ID NO: 84222 - protein, 496 aa, Hyphomonas neptunium ATCC 15444
MSALSFQSFKETWFFNIRADLLAGLVVALALIPEAIAFSIIAGVDPRVGLYASFSIAVITAIVGGRPGMISAATAATAVLMVTLVRDYGLEYLLATTVLAGLLQIAAGFLKLGQYMRFVSRSVLTGFVNALAILIFMAQIPELIGVPMLTYPLVALGLAIIYLFPMVTRAIPSPLICILALSAIAIGFGLDIRTVGDMGELPSTLPMFLLPDIPLTFETLQIIFPYALAVAVVGLLESLMTATIVDELTDTPSDRNRECVGQGVANTVTGFFGGMAGCAMIGQSIINIKSGGRGRLSTLSAGLFLMLMILLVSDWVSRIPMAALVAIMIMVSIGTFSWSSLKNLRVHPRSSSLVMLATVAGVILSHNLAIGVLIGVLLSGVFFAGKISQIFKVTSTVSEDGRIRRYKVEGQVFFASVEAFNASFDLKEALDEVIIDVSEAHIWDISSVAALDMIVLKFRREGAKVEIIGLNEASETIVDKLAIHDKPGALDKLMSH

SEQ ID NO: 84223 - protein, 258 aa, Bacillus pumilus SAFR-032
MDKTIVFKCGGSVIRELSDTFYENVRSLQAAGFKLAIVHGGGPEITNMLQKLDVKTEFVDGQRKTTKPVLEVAEMVLSGTVNKYFVSELAKHDISSVGVSGKDGQMLVADFLDQDVYGYVGEIKEVHPEMAEALMEKQFIPVIAPLSMTEECQTLNVNADLAASAVAGAMKADKLMFVTDVEGILKNGELLDVVTEQEALTLIDEGIISGGMIPKVQSALSALSGDVDEVMIVNGKGSIFTGETFKGTRIVKEKEAVL

SEQ ID NO: 84224 - protein, 532 aa, Oryza sativa Indica Group
MASSASTLEIEARDVVKIVLQFCKENSLQQTFQTLQNECQVSLNTVDSIDTFIADINAGRWDAVLPQVAQLKLPRKKLEDLYEQIVLEMAELRELDTARAILRQTQVMGVMKQEQPERYLRLEHLLVRTYFDPNEAYQESTKEKRRAQISQAIASEVSVVPPSRLMALIGQALKWQQHQGLLPPGTQFDLFRGTAAMKQDEEETYPTTLSHQTKFGKKTHPECARFSPDGQYLVSCSVDGIIEVWDYISGKLKKDLQYQADESFMMHDDAVLSVDFSRDSEMLASGSQDGKIKVWRIRTGQCLRRLERAHAKGVTSVTFSRDGTQILSSSFDTTARVHGLKSGKMLKEFRGHNSYVNCAIFSTDGSRVITASSDCTVKVWDTKTTDCLQTFKPPPPLRALNHASYLMVVRHFQGGDATVNSVHLSPKNSDHIIVCNKTSSIYIMTLQGQVVKSFSSGKREGGDFLAASVSPKGEWIYCVGEDMNMYCFSYQSGKLEHLMKVHDKDVIGITHHPHRNLIATYAEDCTMKTWKP

SEQ ID NO: 84225 - protein, 356 aa, Gibberella zeae PH-1
MSFRTLRIGLIPGDGIGKEVIPAGRRILEALPSSLGLKFDFVNLKAGFETFEQTGAALPDKTVEVLKNECDGALFGAVSSPTQAVKGYSSPIVALRKRLDLYANVRPVKTVMTAAKPIDMVIVRENTEDLYVKQEKTYDTPEGKVAEAIKRISEKASFRIAAMAGDIALRRQKIRDAGASSIHKSPLVTITHKSNVLSQTDGLFRATSKRALADPKFSSVAVEEQIVDSMVYKLFRQPEDYDVIVAPNLYGDILSDGAAALVGSLGLVPSANVGEGFAIGEPCHGSAPDIQGQNIANPIATLRSTALMLEFLNEEEAAAKIYAAVDGNLEDGKLLSPDLGGKATTEEVVADILRRL

SEQ ID NO: 84226 - protein, 383 aa, Bacillus pumilus SAFR-032
MSHLFQTYGRWNVEIKEAAGSWAVDTNGKKYLDFIQGIAVTNLGHNHPKVNQAIKKQLDHVWHVSNLFENGLQEKAAEKLAANSSGDLVFFCNSGAEANEGAIKLARKATGKTNIVTFLHSFHGRTYAGMAATGQDKIKTGFGPMLEGFHYVPFNDPEAIAACEVGNVAAVMLEVVQGEGGVNPATTEFLEAVQAFCQKHEALLIVDEIQTGIGRTGTAFAYEQTGLDPDIISSAKGLGNGFPVGAVIGKKALGDAFSPGSHGTTFGGNMLAMAAVNATLDVIFKDEFLTEVKEKGAYLLEKLQDLKQLNIVKEVRGKGLMAGVECHQPVGDYITALREQGLLVLPAGPNVIRLLPPLNVEKAEIDQAIDALTQVLANETVTV

SEQ ID NO: 84227 - protein, 353 aa, Bacillus pumilus SAFR-032
MKGYLNLEDGASFEGDLTGEAGKTGEVVFFTGMTGYQEVLTDPSYKGQIIVFTYPLIGNYGINHEDFESKKPQVKAVVVYEAADHFSHHLAAVSLKDYLQKWNIPLLTHTDTRAVVQNIRANGTMNAVISLDENETPSAMKQDNVVAQVTEDEIYTQGSGEEHVALIDFGFKKSIADSLEARGCKVTVIPYKQLEKVFELKPDAVLLSNGPGDPKTMKPYLKTIHEIMMTFPTLGICLGHQLIALALGGDTYKLPFGHRGANHPVQDTESKRVFMTSQNHSYVVNEKSMNDKEVDVKFLHVNDGSVEGFIHKEKLIMSVQFHPEAHPGPAESEWVFDDFIEKVKQARREVAHA

SEQ ID NO: 84228 - protein, 281 aa, Rhododendron catawbiense
MSKDVEVAEQPAYSAKDYHDPPPARLIDMEELIKWSFYRAVIAEFIATLLFLYITVLTVIGYKSQTTTDPCGGVGILGIAWAFGGMIFVLVYCTAGISGGHINPAVTFGLFLARKVSLFRAVLYMVAQCLGAICGVGLVKAFQKSYFDRYGGGANEVASGYNKGTALGAEIIGTFVLVYTVFSATDPKRSARDSHVPVLAPLPIGFAVFMVHLATIPITGTGINPARSFGAAVIYNNSKAWDDQWIFWVGPFAGAAIAAFYHQFILRAAAIKALGSFRSNT

SEQ ID NO: 84229 - protein, 89 aa, Triticum aestivum
MKLLSVGDPRPVLFRREWGRTWPLISGFDVTGALITKKTAGFTEEDLKNSKIGQARKKEHHRPAQAAPETRIKTGLTKVEQTTERSVST

SEQ ID NO: 84230 - protein, 296 aa, Vibrio fischeri
VLRALYESDKRDKIEVVAVNELSQPEAMAHLFQYDSTHGRFQHKVTHDQEYLYIDLPNGSQDKVRILHQADLSLLPWQSLEVDLILDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 84231 - protein, 486 aa, Rhodopseudomonas palustris CGA009
MNVHQRYAMGDSLAAKHGLWSEEQIDAAARVRRIAEEQGLETIRFSFPDQHGILRGKTLVASEALNCLDNGATITTTMLAKDTSHKTVFPVFQAGGGFGMSEMQGGADVVMLPDPTTFRVLPWAPTTGWVLCDLYFADGRPVQFATRNIYRAALQKLAARGYDYKAGLEVEFHVFKVVDSKMRPEHAGQPGEPPEVSLLSHGYQYLTEQRYDQMEPVLELIRRDVVALGLPLRSIEVEFGPSQCEFTFQPTVGLLPADLMVLFRAAVKQICRRHGYHATFMCRPRIPNVVSSGWHLHQSVVARDGGRNAFMSDSDVLSDFGRHYLAGLMTHARAATVFTTPTINGYKRYRSYSLAPDRAIWGRDNRGVMLRVLGGAGDKATRIENRVGEPAANPYLYMASQILSGLDGVDRALDPGPSADTPYETKADLLPKSLREAIFALRDDPFFRTALGDEFVDYYTFIKNAEIERFQAEVTEWEQREYFEMF

SEQ ID NO: 84232 - protein, 402 aa, Magnetospirillum magnetotacticum MS-1
MTVLFSELGLAEPLLKALEAEGYTTPTPIQEQSIPHLLQGSDVLGLAQTGTGKTASFALPLLQRLDQFKKRAMPKSCRILVLTPTRELAVQVGQSFKTYGCHYRLRHALVFGGVGMVPQIKTMAGGVDVLVATPGRLLDLIDQGAIRLDSVEALVLDEADRMLDMGFIQPIRKIVAMVPKQRQTVLFSATMPDSIVGLANSVLHTPVRVEVTPVSSTVDKIDQKVLFVDREHKRTLLTDILGGADVVRALVFTRTKHGANRVVELLEKAGIDADAIHGNKSQGARQKALSDFRDGKIKALVATDIAARGIDVDGITHVINFELPNEPESYVHRIGRTARAGASGIALSLCDGDESLICATSKRHPSGIPGITSSLHGAISHRGRRGSRTSASPRGGGRRHPW

SEQ ID NO: 84233 - protein, 296 aa, Vibrio fischeri
VLRALYESDKRDKIEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAVDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 84234 - protein, 296 aa, Vibrio fischeri
VLRALYESDKRDKIEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGFDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 84235 - protein, 292 aa, uncultured marine bacterium 442
MGKESLDCEHTLSLAIREATGQGCPPLLAKALDYAVFPGGARVRPRLCLAVALANGNSEPRLASAAAAAIELLHCASLVHDDLPCFDDAIERRGKPSLHAAFGQRIAVLSGDALIVAAFQQLAELGSSVTHPVRMAQVTAIVAAGVGGPMGICAGQAWECEPRVELEHYHQAKTGALFVAATCAGAAAAGVPSEPWRELGNSIGEAYQVADDIQDAIADTATIGKPTGIDVALDRPSAVRELGLQGAVKRLERCIEKGLDSIPACKGRALLHDVVQQQSNRFFPQGIKHTAA

SEQ ID NO: 84236 - protein, 292 aa, Kineococcus radiotolerans SRS30216
MPTPPTGPVVVLTGATSGLGCLAALDLAARGAHLILPARDPDRAQATVDAVRARNPSARTEVVEVDLTRLHQVRAAGRRIAQQHEHVDVLVNNAGVHAFTPRTTVDGLPQMVAVNYLAPWVLTQALLPALRRSAAARVVTVASEASRRHGTLSLPDDLTDLSPFTARGSSPRYGKTKLLDIMFTLELAERLRGTSVVANCLDPGFNVTGLGRDLRLARPLELLLTRLRIGDPRRGAGLIVHLATHPSYGNVSGRYVTVRGPREITPAAPADDPAARRRLWNVTEELLHERVP

SEQ ID NO: 84237 - protein, 544 aa, Listeria innocua Clip11262
MAYSFKLPDIGEGIHEGEIVKWFVQPGDKIEEDESLFEVQNDKSVEEITSPVSGTIKEIKVAEGTVATVGQVLVTFDGVEGHEDDAEEESAAPKAESTESTPAPAQASGKGIFEFKLPDIGEGIHEGEIVKWFIQPGDKVEEDQSIFEVQNDKSVEEITSPVDGTVKDILVSEGTVATVGQVLVTFEGDFEGEASHESTPESPAEEAELTNNDATSAPATGGNGTPSSKKDPNGLVIAMPSVRKYAREKDVNIAEVAGSGKNNRVVKADIDAFLNGEQPAAATTTAQTEEKAAAPKAEKAAAKQPVASSDAYPETREKLTPTRRAIAKAMVNSKHTAPHVTLMDEIEVTALMAHRKRFKEVAAEKGIKLTFLPYMVKALVATLRDFPVLNTTLDDATEELVYKHYFNVGIAADTDHGLYVPVIKNADKKSVFQISDEINELAGKARDGKLTADEMRHGSATISNIGSAGGQWFTPVINYPEVAILGVGRIAQKPIVKDGEIVAAPVLALSLSFDHRVIDGATAQKAMNNIKRLLNDPELLLMEV

SEQ ID NO: 84238 - protein, 467 aa, Listeria innocua Clip11262
MVVGDFPEERDTIVIGAGPGGYVAAIRAAQLGQKVTIIEKEYYGGVCLNVGCIPSKALITIGHRFKEAGHSDNMGITADNVNLDFTKAQEWKGGVVNKLTSGVKGLLKKNKVEMLEGEAFFVDDHSLRVIHPDSAQTYTFNNVIIATGSRPIEIPGFKYGKRVLSSTGALALTEVPKKLVVIGGGYIGTELGGAFANLGTELTILEGGPEILPTYEKDMVSLVKRNLKSKNVEMVTKALAKSAEETENGVKVTYEANGETKTIEADYVLVTVGRRPNTDEIGLEQAGVKVTERGLVEVDKQGRSNVSNIFAIGDIVPGVPLAHKASYEAKIAAEAIAGEKAENDYTALPAVVFSDPELATVGLTEKEAKEKGFDVKAAKFPFGGNGRALSLDAPEGFVRLVTRKEDGLVIGAQVAGMNASDIISEIGLAIESGITAEDIALTIHAHPSLGELTMEAAELALGRPIHM

SEQ ID NO: 84239 - protein, 222 aa, Candidatus Blochmannia floridanus
MISKDKLKKLVGWEALKYIKSNTIIGVGTGSTVNYFIEALSSIKQQIEGVVSSSQHSSNQLKKLGIPLYNLNNLNDLEIYIDSADEIDLHMQMIKGGGGALTKEKIIAFAAKKFICIVDDSKQVNILGRKGPIPVEVIPMARSVVSKSLICLGGLPEYRNGVITDNGNSILDVYNMNITDASLLEQRINNIPGVVSVGLFAQRKADIALIGTQKGIKILNSN

SEQ ID NO: 84240 - protein, 496 aa, Zea mays
MNGSDSVEPMCGSAARCRGPRASPSSFRRGTRPLPRTSDIEKRRSDDPSFHPSSLSGSKARRAIPITKRLRAAEKPKRSPARARRGRVGRVGEPLASGMASPGVVAAALLVAVLAAFCGTDPLRMGSMAGFPGFEAHFVDLPDPAEMPPHADERERLRGAEVRFRGDVQGPESVAFDPQGRGPYTGVADGRVVFWDGERWVPFATASPRWTQELCGGPKASPVEYLPNEHICGRPLGLRFDKKTGDLYIADAYFGLLKVGPEGGLATPLATEAEGVRLNFTNDLDLDDEGNVYFTDSSIHYQRRNFMQLVFSGDPSGRLLKYNPQTKETTVLHRNLQFPNGVSMSKDGSFFVFCEGSRGRLSRYWLKGEKAGTVDLFAILPGFPDNVRTNEKGEFWVAIHCRRSLYARLMSRHVKLRKFLLSLPIPAKYHYLMQIGGRLHAVIIKYSPEGQVLDILEDTKGEVVRAVSEVEEKDGKLWIGSVLMPFIAVFDLAKAS

SEQ ID NO: 84241 - protein, 413 aa, Vibrio angustum S14
MVSTTISVKPEMATFSLKLKKKLLLLGPAFIAAIGYIDPGNFATNIEAGSSFGYQLLWVVLWSNLMAMLIQYLSAKLGIVTGKNLAEHLRDHLPKWAIGPYWIQAEIIAMATDLAEFIGAAVGFQLLFGISLMEGAIITAIVTMTILLLSNKSQKPLEAVIATLLLVVAVVYVIELFFAHPAKSEMIKGLAVPTLNSSHQIYLAAGILGATVMPHVIYLHSALFKNTYGETKAKRLKSTRLDVLIAMVIAGFVNIAIVAMAAAVFHYSGNQDIAGIETAYKTLTPLVGQAASTLFAISLIASGLSSTVVGTMAGDVVMQGFVKFKIPLLLRRLVTMIPSFIVIGLAINTTEILVMSQVVLSFGIALAIIPLLIFTNNEKLMGEFKNNKYVSYAGIVIIALVVAFNIYLMMTLS

SEQ ID NO: 84242 - protein, 455 aa, Coprinopsis cinerea okayama7#130
MHSQPTPIDLVGGPFAVIESDPGVFTSLVRKLGVRGVEVVEVYGIEPWALDHLRPYGLVFCFLWHKDNHRAADFEDPAAGSVWFANQLSDDACATHAILNVILNCPGIDVGPYLTQFKQETSQMSPVMRGLSVTNVPLFRRVHNSLARPADVRGAINTLATTTLDIEKEKQKEERRKKVAAGKPPPAKKRKGDDAAQDKSKGKSRQEEEEIEQSYHFIGYVPAHGKVWELDGFKSGPLEVGELPAPESPHQSGSDPRNTWMDVVRPALRLKMDKYGGSGDDGSNIQFSLLAIVDDGYQAAFDDLELLKREKVSIEKRMEHNWETKVDLALWEDTITGNDRQALFSFNELDRPALASKRMERDIEIMAMSQGELVTAWNSCVRNIRKAVIVLEDELSKGRRTNTEHINRTFDYEPFFKAFITALHNEGHLNPLLDLDENGKKRRSTTGMKGGQSKR

SEQ ID NO: 84243 - protein, 414 aa, Vibrio vulnificus YJ016
MNWSPNQVRAQFPALAQYHNQRPVTFFDGPGGSQVPQSVLDAMVGYLGHFNSNLGGHYFSSHKTVEVMKQARQSAQALLNAPSQDNIVFGANMTSLTFQLSRAISRDWQAGDEVIVTALDHYSNVSSWEQAAEDKGVTVHQVRVNPEDCTLDMEHFKQLLSARTKLVAVTFASNTTGTIVDIASVVKLARSVGALVYVDAVHYLPHHLVDVQALDCDFLACSAYKFFGPHVGIAYVASPWLETLRPYKVEPATNIGPGRFETGTQSFEGLAGVSAAIEYLAQFGEEGASLRQRLEQSYALYAQHEQTLSQHFLQRLSALDGITLYGINDASSDKRTPTFAITVEGYSPEFIAKTLGEHNICVWNGHFYALGLIRQLGLEFSGGVIRIGCMHYNTVEEVDLLFNVLESIVDQPSA

SEQ ID NO: 84244 - protein, 473 aa, Prochlorococcus marinus str. NATL2A
MSKTSQDVLRQIKDEGIELIDLKFTDLHGKWQHLTVASDLIEESSFTEGLAFDGSSIRGWKAINESDMAMVPDPSTSWIDPFYHHKTLSLICSIQEPRSGEPYARCPRALAQKALDYLGSTSVADAAFFGPEPEFFIFDDVRYNSGEGSSFYSVDTIEAPWNSGRVEEGGNLGYKIQLKEGYFPVSPNDTAQDMRSEMLLLMGELGIPIEKHHHEVAGAGQHELGMKFAPLINAADNVMIYKYIVRNVAKKYGKTATFMPKPVFNDNGTGMHVHQSLWKGGQPLFYGEGTYANLSQTAKWYIGGILKHAPSFLAFTNPTTNSYKRLVPGFEAPVNLVYSQGNRSAAVRIPLTGPSPKAKRLEFRSGDALANPYIAFSAMMMAGIDGIKNQIDPGDGVDVDLFELPSEELSKIDTVPSSLNDALEALKNDSQYLTEGGVFTEDFINNWIELKYEEVQQLRQRPHPHEFTVYYDA

SEQ ID NO: 84245 - protein, 412 aa, Prochlorococcus marinus str. NATL2A
MQSLKKTPRLCLSPFRLGRYINRSVFLATQILPSVDNQHRKDFGPTVSPERLLLGPGPSNADPAVLKALSQPPIGHLDPFYVDLMSEVQELLRYAWQTSNRLTLPMSGTGSAAMEATLANVVEPEDTVLVAIKGYFGHRLADMAGRYKANVETIHKEWGNAFSLQEIEDALKKHTPAVLAIVHAETSTGVCQPMDGIGDLCRKYNCLLLVDTVTSLGGVPLYLDEWKIDLAYSCSQKGLSCPPGLGPFSMNERAENKMSNRKDKVPNWYLDVSLLNKYWGSDRVYHHTAPVNMNFGIREALRLLAEEGLEVSWGRHRTNAKSLWNSLENIGLELHVKEELRLPTLTTVKIPEGLDGKAFTKHLLNNFGVEIGGGLGDLAGKVWRIGLMGYNSTSENVDKIINIFETELPKFR

SEQ ID NO: 84246 - protein, 316 aa, Bacillus pumilus SAFR-032
MSQVDLQPTLYGKDFLSLKDFSINDIAYLIEKAEEMKQNPYQDLFKGKTLAMIFEKSSTRTRVSFEAGMTQLGGHALFLSSNDLQIGRGETISDTAQVLSGYVDGIMIRTFEHEKVEELAQYASIPVINGLTDYSHPCQALADLLTIKEAKGTLKGIKVAYIGDGNNVAHSLMVGCAQLGCDIAVASPKGYEPLQEVTDTAHEFAKQSGAEVIVTTDPVAAVQNADVIYSDVFTSMGQEAETEKRLAEFKEYQINDELMRHAAKDYIFLHCLPAHRGEEVTADIIDGPHSKVFQQAENRLHVQKALIKELMYQPSK

SEQ ID NO: 84247 - protein, 129 aa, Brassica napus
MERKRSHASFTMFAMLVGVISQSLVIPVVSTTVEDQKNYYTPDPHAGSPPSGSHSSTPPSHGHGSSPPSHHHSSPSTPSTPSGGNCGSSPPQHHDPTTPSTPSTPSNPPSGGYYGGSPPTPVTVSPPTT

SEQ ID NO: 84248 - protein, 591 aa, Vibrio vulnificus YJ016
MMYIKRYLQPISEAVIIFSVSSKTLLRHPMNNDKRPLYIPFAGPALLSTPLLNKGSAFSAEERISFNLEGLLPETTETIQEQVERAYMQYKAFESDMDKHIYLRNIQDTNETLFYRLVQNHITEMMPIIYTPTVGAACENFSNIYRRGRGLFVSYANRDRIDDILNNASNHNVKVIVVTDGERILGLGDQGIGGMGIPIGKLSLYTACGGISPAYTLPIVLDVGTNNPQRLADPMYMGWRHPRITGADYDAFVEEFIQAVQRRWPDALIQFEDFAQKNAMPLLERYKNRICCFNDDIQGTAAVTVGSLMAACQAAGSKLSEQRITFLGAGSAGCGIAEAIIAQMVSEGISDKKARSQVFMVDRWGLLQEGMPNLLDFQQRLVQKHSVTAKWETEANGFSLLDVVKNAKPTVLIGVSGAPGLFTQEVIQEMHKHCPRPIVFPLSNPTSRVEAVPADIIRWTNGDALVATGSPFDPVIHEGKTYPIVQCNNSYIFPGIGLGVLAVNAKRVTDEMLMESSRALATCSPLAINGKGALLPPLEEIHTVSKRIAYAVAKKAIEQGVALEIADDALQVAIEQHFWQPVYRRYKRTAF

SEQ ID NO: 84249 - protein, 1259 aa, Oryza sativa Japonica Group
MRSFCIHSQFTSISFIEMTSDAFLLSMIHGISATVRWICTNLSSVETFYMEGPWAATATTGIFLAAAVTDWLDGYIARKMQLGTPFGAFLDPVADKLMVAATLVLLCTKPLEISLLRDGPWLLTVPAIAIIGREAVAVNNLGKWKTATQMTALTILLASRDKSLPAQDALVTSGIALLYVSAGLAIWSLVLCAESGHLAAARQIHARLVAASVTPSNFLASKLISLYSRADRLRDARRVFDSIPQPSLFAWNAILISLSLHSPDPSAAVRLFASSAVSPDEITLSTLLRSLAASGPALSPLVTGELHAVAFLRGFGSDLFVSNALITAYANAGDMRSARAVFDEMPRRDVVSWNSLISACARAGWYRECLDLFQEFVRVRCSDGDGVGPNGVTVTSVLHACAQLKVVDFGIGVHRFAAESGLDMDMAVWNSIIGFYAKCGRLQYARQLLDGMTRKDSISYSAMITGYMNNGHVEEGMQLFRQASARGISMWNSVIAGLVQNGRQSDVLRLLQEMIASKVLPNSATLSIVMPSVPSFSTLLGAKQAHGYAIRNDYDQSIRLVSALIDAYAKAGFLDTARKVFKLTEHRSTIVWTSIISAVAAHGEAVEALSLFNQMITAGAKPDTVTFTTVLSACAHSGKVAEARKVFNSMQAVFGISPVIEQYACMVSALSRAGMLKEAVKLVNKMPFEPNAKVWGALLNGAAVVGDVEFGRYAFDRLFVIEPKNTGNYIVMANLYSNAGKWEEAETIRSMLWGVGLEKEVPPQVKSQCLMKHQKSSIQKLKVAAISTCTDRPNEAGDSITSGNIDVNSNVQYTSPYRDEAPHLTPQPSDIRRTPSASSLHSYYLPPIQQPSAPQAQKQRRMQRQKQPQPSHIVRPSLTPNLGPLDTTTTTRNVDERREAKLGEMAATAMQCRGGERSEDGGGGGMRTVECLRGRLLAERVASKAAKEEADSLAKRVSSLSHIPYCYNLLDRKCVILFLSFFWWLVMIWSQLDELEKKLSDEVKIRNKAERRLRRAIKKLESLKILDVELSDSSIGSLSSNSCSGHRAPETEADVNNPGSSAGSCTQVNSSQEGSWCSVVSEQSPSVHCKEEEENGLDPEDAKNCGSGEEAGDHDSERTHGTLPCSRDDEPVHVPSDFGSSKSQDNQRDEDDDRLALVLVDPQPNAETGNEDDMRIDIQARKAQAEPREGDGEMEEANELAIVLVDPQPEPKAEPAATARPRNDVQSVLLALRQVKEQLRYTIERRSELVAHQELCGHC

SEQ ID NO: 84250 - protein, 223 aa, Zea mays
  misc_feature (109)..(109): Xaa can be any naturally occurring amino acid
MASIPPPSSSVAALTRQPAQFLKWCSVSKETKASVCSFLATNSNSTRVKSVGLRVALSFKNDGGYPADGFSGNGNTLLPKSTSVRGEDHPVADPVLPMDSMMTPEILSXNLALVMDKFSDDDTDTELDLDSPTEGFASIPDAIEDLVIVVDDESRENEGDLIMAASLVTPEAMAFIVRHGTGIVCVSMKEDDLERLSLPLMVTTKENEEKLCTAFTVTVKYVH

SEQ ID NO: 84251 - protein, 632 aa, Cytophaga hutchinsonii ATCC 33406
MLTLNNISYFIGGRALYRNITMQIKPKDKIGLIGANGTGKSTLLKVITGEYSADEGNIQKSKDCTIGFLNQDLLSFQSDESILAVAMEAFEEATKIQIQMDQLIHKMETDYTDDMIEKLSALQERFQALEGYTIQSKAEKILEGLGFSTNDLNKPLKNFSGGWRMRVMLAKMLLAKPALLMLDEPTNHLDLPSIQWLENYLRDYEGAVIVVSHDREFIDNCVKTIVEVAQQTLNIYAGNYSFYLEEKELRSEIQKASFENQQAKIKQTERFIERFKAKASKSTQVQSRVKALDRMDMIEDVVEDNQTVNFRFTFKTQPGRVINELKNISKSYGDLHILKNTDAKIERGDKIALIGANGKGKSTVLRILTGGESAEGEVALGHNVISSFYAQHQLESLNINNEILEELKQHGSNRTETELRNVLGCFLFSSDDAFKKIKVLSGGEKSRVALAKTLISDANYLLLDEPTNHLDMVSVNILIQALQQYEGTLIVISHDRHFVSKVANKIWYIEDQEIKVYPGTYDEYKYWIENIKTTGATAAPKEKKEPVAEKKKAPAPAADPEIKKIQQQISRLEEQITALEKKKTAAEEHLAKPEVYGNPDQLAKASMEFDKVDKELLQLQTEWEMCVEKLEQ

SEQ ID NO: 84252 - protein, 107 aa, Synechococcus sp. WH 7805
MSSAAAVTDASFEQDVLQSDVPVLVDFWAPWCGPCRMVAPIVDEISKEFEGKIKVFKLNTDENPNVASQFGIRSIPTLMVFKGGQKVDTVVGAVPKATLSGTIAKYL

SEQ ID NO: 84253 - protein, 400 aa, Gibberella zeae PH-1
MATDAPAKQCMGADCSNDAGSLQCPTCLKLGIKDSFFCSQECFKRNWGIHKTMHKSQSNILHHLKAPKAISPDPATGYYNPFPNFPYSGSLRPVYPLSPHRTLPQSIPHPVWWQDGNPRYSRSLTNRNKIEILDKAGQDAMRKSCRLAREVLDIAAAAAKPGVTTDYIDELVHKACIERNSYPSPLNYNNFPKSCCTSVNEVICHGIPDQRVLLDGDILNIDVSLYHEGYHADLNETYYIGDKAKADPDTVRVVETARQCLDESIKAVKPGTLIREFGNIIEKHAKQHNCSVIRTYCGHGVGKLFHCPPNVPHYAKNKTVGECKPGMTFTIEPMIALGKYRDITWPDNWTSTTIDGKMTAQFEHTLLVTEDGVEILTARQENSPGGALPMPGTENGDAKA

SEQ ID NO: 84254 - protein, 365 aa, Cytophaga hutchinsonii ATCC 33406
MSLQCGIVGLPNVGKSTLFNALSNAKAEAANYPFCTIEPNVGVVTVPDDRLGILEGIVKPEKVLPAIIEFVDIAGLVKGASKGEGLGNQFLANIREVDAIVHVIRCFQDDNIIHVNGKVDPISDKEIIETELQLKDLDSVEKKLSKVERSAKAGDAKAKKEVVTLTLYRNHLLEGKNARSLDLPQEDKAVLDDLHLLTIKPVIYAANVDEKSLPDGNEYVERLRKEVEKENAQIVIVCAAIEAQIQELTDPEEKAMFLQEYGLTDSGLNRLIRASYALLDLITYFTAGVKEVRAWTITKGWKAPKAASVIHNDFEKGFIKAEVIKLKDYQTYKSEAGCKEAGKISIEGKEYLVEDGDIMHFRFNV

SEQ ID NO: 84255 - protein, 1495 aa, Penicillium digitatum
MSPQAETISTEAWSTDSADERPWSGTTNQLDPVFEKEGDSTDISERDRAQIGILARQLTTASTKTGVQGAVSNPFKGSNDPRLDPFSKEFNPKKWVETVLHLNSQNPERYLPRKAGFSFRNLSVHGFGSPVSYQKDFLNIFLQVADMVTGLINSKDQKIQILRNHNGLLRNGEMLLVLGRPGSGVSTFLKTIAGQTKGLYLDEASEFNYQGIPRKKIRGEFRGDVIYQAETDTHFPNLTVGQTLLYAALAKTPQNRLSGVSRDEYARHIRDVTMAVFGLTHTMNTKVGNDFIRGVSGGERKRVSIAEVCLAQSPIQCWDNSTRGLDSATALKFVQTLRLSADITSMATVVALYQASQQSYETFDKVAVLYEGRQIYYGPVELAKNYFVNLGYHCPDRQTTPDFLTSLTNPVERVARSGFEAKVPRSPDDFAKAWEESSLHKELMQDIVEFEKEHPVGGPAVDSFKKSRQAEKASWMTPNSPYTISVPLQVLLCIRRGFRRIQGDMTFFSITIGGNLVISLLLGSVFYMLEDTSASFQSRCILLFFALLFNALNSSLEILSLYAQRSIVEKHATYAFYHPLSEAVASMICDIPSKILSTIAFNIPLYYMANLRTESGHVITYLLIVFSSTLVMSMIFRTIGQSTRTIAEALTPAALMVIAMVLYTGFILPIRNMQGWLRWLHYINPLAYSYEALVANEFHGRNFECAGFIPAGPMYQNITAADRTCSVVGASAGSSVVRRRPLYCYELWVLLLQHVWRNFGILIAFIICFMIGYLLSAEYISSDVGKGEILLFQRSHFSAIKKTQKADEEVGSSGLHEKYRQDETNGEASTGITAQKNIFHWRDLCYEVSIKGKTRRITDHVNGWVKPGKLTALMGASGAGKTTLLDVLANRVTMGVVTGGIYNNGLPRDASFQRRIGYVQQQDLHLETATIREALEFSAFLRQPAHVSKAEKLQSVEEILDLLEMRSYADAVVGVPGEGLNVEQRKRLTIGVELAAKPDLLFFLDEPTSGLDSQTAWSILLLLRKLTDHGQAILCTIHQPSSMLFQQFDRLLLLAAGGRTVYFGDIGENSKTMTGYFERHGADHCDENDNPAEWMLRVIGAAPGSATKIDWPATWLGSQEYADVKEELISLERKDGVETNSSADPSLQFASPFHVQLWACTKRVFEQYWRTPSYLYSKLTMCFVTALFIGLSFLQTKVTELGLQHQMFAVFMLLVIFPFLAYQQMPNYILQRDLYEVRERPSKTYSWITFILAQVIVEIPWNSLAALITFIPFYYLIGMNHNAAPTHQTTERGGLMFLLIWGFLMHCGTFTTMVVASAATAEIGAILALLLFVFCLIFCGVMATPASLPGFWIFMYRVSPLTYIISGMMSTGLANIDVHCSDIETTLVQPPSGETCGSYLGAYLQIAGGAIYNPNATSDCQFCTIADSNVFLESVSSSYTDRWRNFGLIWAYVAFNVAATLILYWYVRVRGSPGLSHVVSWVQKASKHLSWKKAQ

SEQ ID NO: 84256 - protein, 442 aa, Arabidopsis thaliana
MHRASSKHTNAKKEAISTSKIRDNNVRVTRSRAKALGVSNSPSKPAFKHETKRVARPSNKRMASDNITVCNQKRRAVLKDVTNTLAESIISTEGNVKACKRGGKETKQIEEDGLVDVDGEKSKLAEDLSKIRMVESLDASASKQLVDCAEEDRSDVTDCVQIVDIDSGVQDPQFCSLYAASIYDSINVAELEQRPSTSYMVQVQRDIDPTMRGILIDWLVEVSEEYKLVSDTLYLTVNLIDRFMSHNYIEKQKLQLLGITCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNQTLQHYTRYETSALKNTVLAMEELQLNTSGSTLIAIHTKYNQQKFKRVATLTSPERVNTLFSR

SEQ ID NO: 84257 - protein, 241 aa, Bartonella henselae str. Houston-1
MKYFGCELDVWIKEGNSPVSEADLAVDHFLKERLLVARPNYGWISEETKDNRSQRSYERSFVVDPIDGTRGFLSGSTYWCVSIAIIENGRPIIGVVQCPAQGNVYAAVTGEGATLNGIKLPLLPSQVNRKYKVSLDKSLAQKLPDDFCNQVSFYRHIPSLAYRIVLVAQGEIDIVLIRPNCHAWDIAAADLILQECGGYFLPLDAPFLSYGIEPYQYGFLVAGKNNCCQNMIDVVRQAKLV

SEQ ID NO: 84258 - protein, 296 aa, Vibrio fischeri
VLRALYESDKRDKIEVVAVNELSQPEAMAHLFQYDSTHGRFQHKVTHDQEYLYIDLPNGSQDKVRILHQADLSLLPWQSLEVDLILDCTGVYGSKSDGEKHITAGAKKVLFSHPGGSDLDNTIIYGVNHDTLLPEHRIVSNGSCTTNCIIPVIKAIDDVFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 84259 - protein, 751 aa, Methanosarcina mazei Go1
MTEEINLRVAEAYHKDVGRGIARIDTRLMQEMGLVSGDIIEISGRSKTYAIVWPNVERGQENRIRIDGNLRSNAKVGIDDRVTIQKVQAKHAQRVTLAPSQPVRLVGGAHYILRIIEGRPLNKGQQIRVETVNNPLTFVVASTRPAGPVVVTKDTEIIIKEKSIEEIKAPEGISYEDIGGLRREIQLVREMIELPMRHPELFQKLGVEPPKGVLLHGPPGTGKTMIAKAVASETDANFITISGPEIVSKYYGESEQKLREIFEEAEKDAPSIIFIDEIDSIAPKRGEVTGEMERRVVAQLLSLMDGLKSRGEVVVIAATNRPNSIDEALRRGGRFDREIEIGIPDRNGRKQILLIHTRGMPLEDEVSLSEIADVTHGFVGADLSSLCKEAAMHALRRITPEIDIEEEIPQEIIDNLVVTKENFREALKNIEPSAMREVYIEVPHVGWDDIGGLEKAKQELIESVEWPLKYPEMFKAVSIKPPRGVLLFGPPGTGKTLLAKAVANESEANFISIKGPELLSKYVGESERAIRETFRKAKQAAPTVIFFDEIDSIAPQRSSVSDTHVSERVVSQILTELDGIEELKDVIIVAATNRPDMVDPALLRPGRFDRLIYIKPPGKEGREKIFEIHAKEKPLAEDVKLSELAEMTEGYVGADIEGICREAAMLALREIVTPGADRKNIQEKAAEVRLSKRHFEKAIRRVKPTTSRETLSAYEKSAELFARYATEFEEESSEEKDQEIKVEEKDQETRV

SEQ ID NO: 84260 - protein, 214 aa, Xanthomonas axonopodis pv. citri str. 306
MRILLARHGETPWNAEGRYQGQIDIPLSPVGEGQARALGERLHSLQIDRAVASPLSRAQATAKAALGASRQALLQTDADLQEIAHGEWEGLLASEINDKDPARLRAWREEPDTVLMPGGESLRQVLDRSWRGLMRAADGLGAHDTLLVVAHDAVNRVILCKILGLPLSRLWSFRQAPTTLNLLEGDDVEHLEVVRLNDCAHHTPFFGEAKHRAL

SEQ ID NO: 84261 - protein, 178 aa, Rubrobacter xylanophilus DSM 9941
MRMAHPWHDIPAGEEPPGEIHALVEIPQGSRVKYELDKGTGLLKVDRVLHSPVVYPANYGLIPRTLGEDGDPLDALVLMREPVQPLSVLRARPIGMMLMTDEGERDEKIICTHLDDPEYRSYRHHGELPEHRLAELRRFSQDYKKLENKELRVGGFLGPEEAREAIAAAMRLYDRRFR

SEQ ID NO: 84262 - protein, 296 aa, Vibrio fischeri
VLRALYESDKRDKIEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTININVKVNDINQTIVNASRCTLHNIVDYTEAPLVSIDFNHDPHSAIVDGSQTRVSNG

SEQ ID NO: 84263 - protein, 521 aa, Glycine max
MEPLSSTKHNNNLSKPSSLHTEAPPPEASPLRKIMVVASIAAGVQFGWALQLSLLTPYVQLLGIPHTWAAFIWLCGPISGMLVQPIVGYHSDRCTSRFGRRRPFIAAGSLAVAIAVFLIGYAADLGHMFGDSLAKKTRPRAIAIFVVGFWILDVANNMLQGPCRALLADLCAGDHRKTRNANAFFSFFMAVGNVLGYAAGSYSGLHNVFPFTKTKACDVYCANLKSCFFLSIALLLTLSTIALTYVKEKTVSSEKTVRSSVEEDGSHGGMPCFGQLFGAFRELKRPMWILLLVTCLNWIAWFPFLLFDTDWMGREVYGGTVGEGKAYDRGVRAGALGLMLNSVVLGATSLGVEVLARGVGGVKRLWGIVNFLLAVCLAMTVLVTKMAQHSRQYTLLPNAHQEPLPPPAAVKAGALALFSLLGIPLAITYSIPFALASIFSSTSGAGQGLSLGVLNLAIVIPQMVVSVISGPWDALFGGGNLPAFVVGAVAAAASGILSIILLPSPPPDLAKAATAAGGGFH

SEQ ID NO: 84264 - protein, 296 aa, Vibrio fischeri
VLRALYESDKCDKVEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNG

SEQ ID NO: 84265 - protein, 479 aa, Brassica napus
  misc_feature (187)..(187): Xaa can be any naturally occurring amino acid
  misc_feature (201)..(201): Xaa can be any naturally occurring amino acid
MEKGSNGSAALEMQTSELDQPAALRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPRTRAIAIFALGFWILDVANNTLQGPCRAFLADLSAGNAKKTRTANAFFSFFMAVGNXLGYAAGSYKNLYKXVPFTMTKSCDLYCANLKTCFFLSITLLVLVTFVSLCYVKEKPWTPEPTADGKASNVPFFGEIFGAFKELKRPMWMLLIVTALNWIAWFPFLLFDTDWMGREVYGGNSDATASVASKKLYNDGVRAGALGLMLNAIVLGFMSLGVEWVGRKMGGAKRLWGAVNFILAICLAMTVVVTKQAENHRRDHGGAKTGPPGNVTAGALTLFAVLGIPQAITFSIPFALASIFSTNSGAGQGLSLGVLNLAIVVPQMVVSVGGAPFDELFHGGNIPAFVLGAIRA

SEQ ID NO: 84266 - protein, 219 aa, Arabidopsis thaliana
MGMSLDFDVDLEKGIIDCDNVYTKSPEKPMSPDNKPVITGEESVGSLENDTSPVQCGINKPGWGRSDRKEKRKKSASKPPRPPRGPSLDAADQKLIREIAELAMLKRARIERMRALKKSRAAKAASAASSLGNVLATLFTAIFFFVLVFQGLSPRAAGSSGKSHLVVAGKANGGFVSVQYAGNPSASEPDGGYTGPVLAQRPNLLKPVSGLENEKKSSQ

SEQ ID NO: 84267 - protein, 257 aa, Listeria innocua Clip11262
MDSEKIDYLARLWIMEAAAKIKQSFKETLDIDIKSGRNDLVTNMDKETEAFFVKQIKDHFPNHRLFGEEGMSDDVTDLNGIVWILDPIDGTLNFVEQQRDFAISLAIYQDGVGHLAYIYDVTRDELYFAEKGKGATVNGKQIPKIDKDMDLQDALLIANLSVTRKFPTMWEAVKVSRGLRLHGAASLEYMDVATGRAGAYLSANLAPWDIAAGKIIVEELGGIVTRIDGSKINMLEKGSSIVATPKIHQTLLDNYLP

SEQ ID NO: 84268 - protein, 356 aa, Synechocystis sp. PCC 6803
MQDSNQRLKLGVLFFVVTLVLATLGYICFGWTTTEAVYMVVITVFGVGYGEVRPLTTTAERVFTMGVILAGTTSAVYIVGAFVQMVTEGEIHRALGNQQRQRQIANLTDHTIICGFGRMGQVLAKQLKQSGLPFSIIDNQPSQVAIAEELGYLAHCGDATREEQLQMLGVMRAKTLATVLPEDATNVFITLTARELNSRLTILARGEIPETERKLRLAGADQVILPLTVGAVQMADLITQSNRRDFLNRPDERGFLNDLLASVEVQMDELIVAPDSPAMGRTIMEMEVRSKGAFIVIALRRADGSTILHPHPSQILNENDTIIVIGHRSEIPRFAEQYQFKRKQLKARWQEAALTP

SEQ ID NO: 84269 - protein, 81 aa, Zea mays
  misc_feature (39)..(39): Xaa can be any naturally occurring amino acid
NAVTPMVVARKLELSQHAIRRLLTYQKSDFRGIYRAMHXLRLTIRLLEPHLHELLPEGQIEHILTELCTDTGAKQEGALAR

SEQ ID NO: 84270 - protein, 304 aa, Kineococcus radiotolerans SRS30216
MNANWTARHVPDQSGRVAVVTGANTGLGLETARTLAERGATVVLAVRDVDKGARAAAGLTGNAPGNVVVQRLDLSSLESIRAAASALRDAHPRIDLLVNNAGVMYTPRQTTRDGFERQFGTNHLGHFALTGLLLERMLPVPGSRVVTVSSTGHRIRAAIRFDDLQGERSYSRAAAYGQSKLANLMFTYELQRRLAAHGTTTVAVAAHPGVANTELVRNSPAAVRAAVDRLAPLLTQPAAMGALPTLRAATDPSVLGGQYYGPGGRGEVRGYPRLVTSSPQSYDLADQRRLWAVSQELTGVEFPL

SEQ ID NO: 84271 - protein, 433 aa, Prochlorococcus marinus str. AS9601
MKSLDSKTPNQDWHPNIWPPFTQINNSKPQIEVTHGKDALLFTKDPKKELIDAISSWWVTLHGHSNEYIADAIFDQSKKLEQVIFADFLHPQAKKLAERLSELTKLERLFFSDNGSTAVEVALKIAFQSWQNRGETRTQIVAFDGAYHGDTFGAMALGERNIFNENFDNLMFPVRRVPWPSTWMNDEEVEKKENKAIQKLETLLKTPTVAVILEPLVQGAGGMNMVRPQFIKKVSEIIKKSNSLLIADEVLTGFGRCGTLFAFQKAKIVPDLISISKGLTGGFLPMGITLCKEKIFQSFIDDSPRKTFWHGHSFTANPLGCAAANASLDLLEKEPQKYLSFEEKHLSHLIKFKNLPYIKKVRVSGTIAAFDLDIGNKKGYFNNIGKEIKSLAMEQGLFIRPLGNVIYLLPPLCITDDQLGKSYWIIRQILENL

SEQ ID NO: 84272 - protein, 476 aa, Agrobacterium tumefaciens str. C58
MFGGRGGVSAVAFMGVRSVMNEVSKPMSNLAAIDAAHHLHPFSDMGKLNAAGTRIIERAEGVFIYDSTGKKYLDAFAGLWCVNIGYGRREIADVVQRQMNELPYYNAFFGTTTPPATLLAQKIASRAGPKMNHVFFTNSGSEATDTWFRMARVYWKALGHPTKTRVIARRNGYHGSTVAGASLGGMKWMHEQGNLPIEGIAHIGQPYWYAEGGDLSPAEFGLKVARELDAKIDELGEENVAAFVAEPIQGAGGVIVPPETYWPEIARICKARNILLVSDEVICGFGRLGSWFGYQHFGVEPDLAPVAKGLSSGYLPIGGVIVSDRVAEVMLSEVGDFNHGFTYSGHPVCAAAALENLRIIEDEGLVERVRDDIGPYFSEGWKSLADHELVGEAVNVGLMGGLQLTADKATRRRFAKPDDIGTAVRNHCLANGLVMRATGDRMLASPALTVSRSEVDEIIETLRQGLNHLRDTREHF

SEQ ID NO: 84273 - protein, 188 aa, Triticum aestivum
RPPGQVTNAASSQGYAWIAAIPAAVYMLQDQEVHAAEMERTFIAIKPDGVQRGLISEIVSRFERKGYKLVAIKLVVPSKQFAEKHYHDLKERPFFNGLCDFLSSGPVLAMVWEGEGVIKYGRKLIGATDPSKSEPGTIRGDLAVVVGRNIIHGSDGPETAKDEIALWFQPKELVSYTSNEEKWIYGVN

SEQ ID NO: 84274 - protein, 211 aa, Pseudomonas syringae pv. tomato str. DC3000
MQLKNPILGLCQQATFMLSAAKVDQCPDDEGFEVAFAGRSNAGKSSALNTLTHASLARTSKTPGRTQLLNFFGLDEDRRLVDLPGYGYAKVPIPLKLHWQRHLEAYLGSRESLKGLILMMDIRHPMTDFDLLMLDWAIASHMPMHILLTKADKLTYGAAKNTLLKVQAEIRKGWGDAVSIQLFSAPKRMGLEEAYTVLAGWMELEDKAPAE

SEQ ID NO: 84275 - protein, 264 aa, Candidatus Blochmannia floridanus
MNITIKTLEDIEKMRVSGRLAAEVLEIIEPYIYPGINTEQINKICHHHITQIQHAIAAPLGYNGFPKSICTSINEVVCHGIPNPKHILKDGDIINIDVTILKNGFHADTSKMFIVGKPTKLANLLCQITQDSLYQAIHVIRPGIRLKKIGQSIQNFIHEKKFTIVREYCGHGIGKWFHEAPHVLNYDADDGGVILKSGMTLTIEPMINAGSRYVYTEKDGWTVKTKDHQLSAQYEHTILVTDIGYEILTKRTNETLPYYLNYKN

SEQ ID NO: 84276 - protein, 211 aa, Caulobacter crescentus CB15
SSEWAKNIICGFARMDGETVGIVANQPQVLAGVLDIDSSRKAARFVRFCDAFNIPIVTFVDVPGFMPGTKQEYGGLIKHGAKLLFAYTEATVPKITVITRKAYGGAYDVMSSKHLRGDLNYAWPTAEIAVMGAKGAVEIIFRQEAKDPEALAAREAEYKDRFANPFVAAQRGYIDDVIMPHGTRRRIVRGLKSLKGKELSNPWKKHDNIPL

SEQ ID NO: 84277 - protein, 522 aa, Streptococcus sobrinus
MKFTELHLAEDILQAVEKAGFVEPSPIQELTIPLALEGKDVIGQAQTGTGKTAAFGLPTLNKIDIDNNVIQALVIAPTRELAVQSQEELFRFGREKGVKVRSVYGGSSIDKQIKALRSGAHIVVGTPGRLLDLIKRKALKLNHIETLILDEADEMLNMGFLEDIEAIISHVPDERQTLLFSATMPDAIKRIGVKFMKEPEHVKIAAKELTSDNVEQFYIRVKEREKFDTMTRLIDVEQPELSIVFGRTKRRVDELTRGLKLRGYRAEGIHGDLDQNKRLRVIRDFKNDNLDILVATDVAARGLDISGVTHVYNYDIPQDPESYVHRIGRTGRAGKSGKSVTFVSPNEMGYLSIIENLTKKRMKGLKPASAQDAFQAKKAVALKKIERDFSDESIRSNFDKFKGDALKLAEEFSPEELALYILSLTVQDPETMPEVEISRERPLPFKPSGANRGDGKGGRNNNRGRGGRDRYRRDNRDGNGRRDFKRKSNKNFRDFDKKDNKRPHRTSSEKKNGFVIRNKGDR

SEQ ID NO: 84278 - protein, 402 aa, Zymomonas mobilis subsp. mobilis ZM4
MIGRITMAITPLMPVYPRCAVRPVRGEGCYLFGEQGERYLDFASGIAVNILGHGHPHLVKAIQEQAATLMHVSNMYGSPQGEAFAKRLLSHCFADTVFFTNSGAEAIECAIKTARRFHYANGNPERFKLITFSNAFHGRTMGTISATNQPKMVDGFKPLLPGFQVVEFNDLAAAEAAVDDQTAGFLVEPIQGEGGIRPATDEFMKGLRRICDEKGLMLVLDEVQCGYGRSGTFFAHEQYGIKPDIMAVAKGIGGGFPLGACLATEHAAKGMVFGTHGSTYGGNPLAMAAGQSILDIILEDGFFDHVQKMGNILAEKLETIVKKYPELCLEARGRGLIRGLKLSVPSRDVVAHLRDNHGLLTVAAADNVIRILPPLVIEEKHIDEFMEKLEAGLKSYVPAQAA

SEQ ID NO: 84279 - protein, 160 aa, Zea mays
NSILQHLLFAKGKEKGVSLMLPTDVVIADKFAPDANSQIVPASAIPDGWMGLDIGPDSIAAFNAALETTQTVIWNGPMGVFEYDKFAIGTEAVAKKLAELSRKGVTTIIGGGDSVAAVEKVGVADVMSHISTGGGASLELLEGKELPGVTALDEAATVTV

SEQ ID NO: 84280 - protein, 316 aa, Zymomonas mobilis subsp. mobilis ZM4
MVTVPHSIKRRHFLNFADAGADAVKAMLADALARKQARKGWPKGRVDADAPLKDSILGMIFEKNSTRTRVSFDVGMRQLGGSTIVMESGSTQIGRGETIADTARVLSRFIDAIMIRTDDHAKIEELARYASVPVINGLTDLSHPCQIMADMLTVIEHKGKVEGTRWAWLGDGNNVLYSIIEASGLMGFSVIAACPHGYEPDPKFIEAARKAGCDVVITDDPDEAVKGADVVVTDTWISMGQAHAEAKMAAMQPYQVNEALMAKAGDQALFLHCLPAHRGEEVVDAVIDGSRSVVWDEAENRLHAQKSVLLWSLGLL

SEQ ID NO: 84281 - protein, 395 aa, Cytophaga hutchinsonii ATCC 33406
MKTVDSFNFSGKKALIRVDFNVPLNKSFEITDDTRLKAVLPTVSKVLKDGGSAILMSHLGRPKGGPEEKYSLKHILPYLNKMFGQEVLFAADCIGEDAKAKAAALKPGQVLLLENLRFYPEEEKGDVEFAKKLSVLGDVWVNDAFGTAHRAHASTAVIGQFFKDKVCGYVMQAELDNANKLLKQGEKPITAVMGGSKISDKIMVIENLLDTVDNLIIGGGMSYTFTKALGGKIGKSINEPDKLELALSLIEKAKAKNVKLYLPLDNVVADDFSNDANKQTVKTGEIPDGWEGLDIGPETVKLFSEVVANSKTVLWNGPMGVFEFANFATGTIAIAKAVKEATQKGAFSLIGGGDSAAAINNLGFGNDVSYVSTGGGALLEYFEGKTLPGVAALEK

SEQ ID NO: 84282 - protein, 167 aa, Bordetella bronchiseptica RB50
MTIKVGDRVPDGTLTEFIETETAGCTLGPNAFQVADLVKGKKIALFAVPGAFTPTCSAKHLPGYVEQAAALRAKGIDEIWCVAVNDAFVMGAWGREQQAGGKVRMLADGSALWTTALGLELDLVQRGMGVRSQRYSALIDDGVVKQLNIEAPGKFEVSDAATMLAQA

SEQ ID NO: 84283 - protein, 681 aa, Staphylococcus aureus subsp. aureus Mu50
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKNSSLNNKNIQRDTTKNNNANPSDVNQGLEQAINDGKQSKVASQQQSKEVDNSQDSNANNNLPSQSLTKEAPSLNKSDQTSQREIVNETEIEKVQPQQNNQANDKITNHNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 84284 - protein, 754 aa, Bacteroides fragilis NCTC 9343
MSHLPTLIADLALILMSASIITLLFKWLKQPLVLGYIVAGLLAGPYVRIFPTVGDMENINTWAEIGVVFLLFALGLEFSFKKLMNVGSAAFITATTEVISMLLIGFMVGHLLGWSTMNSVFLGGMLSMSSTTIIIKAFDDLGLRSQRFTGIVFGTLVVEDLIAILMMVILSTMAVSKEFVGEELLMSVLKVAFFLILWFLVGIFILPFFLKKAKRLMNNETLLIVSLGLCLAMVVLATRTGFSAALGAFIMGSILAETVEAEHIEHIIQPVKDLFGAIFFVSVGMLVNPSVLLQYAWPVVIITLVTLVGKSIFSSLGVLLSGEPLKVSVKSGFSLAQIGEFAFIIAGLGASLKVLDPFVPPIIVAVSVITTFTTPYFIRLANPFSEWLYKVLSPRTREFLDRYASGKKTVNHDSDWKRLLKTIVGRVIIYSVLLTAIWLLSVQTVYPTINGMFDSPGRWLSVVMCLLTLLLMIPFLWALVSDKYNSPDVFLKLWNDDNYNHGRLVALILFRVSVAVFFIAGVVISYFSLNYGIGIVIAVAVLGLILLLRENLTQYSHLENHFLTNLNGREEAARNRYPLKSRFNSEFSDKDIELTSVWVSPYSSYIGKSLEELPFRREFGVNVVGIVRGERRIYIPQSDECIYPQDKLIVVGTDGQLQKFRSELDIRQDFPDEKNVRQEVTLHSFTVDEESPLLNKSIAQSRLGKQYDSLIVAIEREDELISMNQSTVFRLGDLVWIVGDREKIRQLLMRKKHV

SEQ ID NO: 84285 - protein, 511 aa, Bacteroides fragilis NCTC 9343
MEDINKAYATFAERDRIASLGGGAAKIDIQHESGKMTARERIDMLLDKGTFVELDKLMVHRCTNYGMDRNKIPGDGVVSGYGKIDGRQVFVYAYDFTVYGGSLSASNAKKIVKVQQLALKNGAPIIALNDSGGARIQEGIESLSGYADIFYQNTMASGVIPQISAILGPCAGGACYSPALTDFIFMVKEKSHMFVTGPDVVKTVIHEEVSKEELGGAMTHSSKSGVTHFMANTEEELLMSIRELLSFLPQNNMDEARKQNCTDDVNREDASLNSIVPADPNVPYDMKEIIERVVDGGYFFEVMQNFAKNIIIGFARMGGRSVGIVANQPAYLAGVLDIDASDKASRFIRFCDCFNIPLITFEDVPGFLPGYTQENNGIIRHGAKIVYAFAEATVPKLTVITRKAYGGAYIVMNSKQTGADVNFAYPSAEIAVMGAEGAVNILFRKADAETKAQELNAYKEKFATPYQAAELGFIDEIILPKQTRKRLIQALEMTENKMQTNPPKKHGNMPL

SEQ ID NO: 84286 - protein, 475 aa, Bartonella henselae str. Houston-1
MLNDANNELKRNLQNRHIQMIALGGVIGTGLFYGSKEAIQLAGPSAILAYLIGGLIIYFIMRMLGEMSVEEPSSGAFSFFAYKYWGRLAGFITGWNYWFLYILVSMTELTVIGFYLDHWILIDHWKSSFIVLLLITLVNLFNVRFYGEFEFACALIKVAAVISMIIFGIFLIVTGVGGNQASIHYLWCHGGFFSYGAIGVVLATSVVMFSFGGTELIGIAAGETSNPQKTIPVAIRQVMWRIIIFYIGSISVIMIISPWNMIEKNSSPFVTIFETLGIPAAGHILNFVVIMAAISVYNSGIYSNGRMLYSLAIQKNAPYIFSKLSTARVPYIAILFSSFCTAIIVVINALVPDNSFMRIMALATAAAVITWAIIIIVHLKFRKAHKNKKEDFMYAFGLYPYANYLCLCFLALLFCIMFVSGFGKNGLMTRLFDMIGIKMSFLETYIPMQMPDMSLAVVIIPLWCLFLFLGYKLKR

SEQ ID NO: 84287 - protein, 542 aa, Arabidopsis thaliana
MERIMINPLLSIQNSPTKFLKPPLSSIHRQQQQQERQSNNNTLFMGEARPRRATTFACLSIRRRRNNNGVSEFEETARFEQVGGKGISVLCGLGYWVQGSRCFPWLALNFHMVHSLALQPSTLQLVQYSCSLPMVAKPLYGVLSDVLYIGSGRRVPYIAIGVFLQVLAWGSMGIFQGAREVLPSLVACVLLSNLGASITEVAKDALVAEYGLRYRINGLQSYALMASAAGGVLGSLLGGYLLLTTPPKISFLVFSALLSLQLVVSLSSKEESFGLPRIAETSSVLESVKKQISNLKEAIQADEISQPLIWAVVSIAMVPLLSGSVFCYQTQVLNLDPSVIGMSKVIGQLMLLCLTVVYDRYLKTLPMRPLIHIIQLLYGLSILLDYILVKQINLGFGISNEVYVLCFSSLAEILAQFKILPFAVRLASMCPQGCEGSVTSFLASTLCLSQIVSAFLGVGLANLIGITSSNYSNLSSGILIQSLAALAPLCFMHLVPMSEPVIEKEGKRGISKRSRRNRRVGRVVDKESVTYRRERESEEAQR

SEQ ID NO: 84288 - protein, 525 aa, Arabidopsis thaliana
LSSCLFNASVSSLNPKQDPIRRHRSTSLLRHRPVVISCTADGNNIKAPIETAVKPPHRTEDNIRDEARRNRSNAVNPFSAKYVPFNAAPGSTESYSLDEIVYRSRSGGLLDVEHDMEALKRFDGAYWRDLFDSRVGKSTWPYGSGVWSKKEWVLPEIDDDDIVSAFEGNSNLFWAERFGKQFLGMNDLWVKHCGISHTGSFKDLGMTVLVSQVNRLRKMKRPVVGVGCASTGDTSAALSAYCASAGIPSIVFLPANKISMAQLVQPIANGAFVLSIDTDFDGCMKLIREITAELPIYLANSLNSLRLEGQKTAAIEILQQFDWQVPDWVIVPGGNLGNIYAFYKGFKMCQELGLVDRIPRMVCAQAANANPLYLHYKSGWKDFKPMTASTTFASAIQIGDPVSIDRAVYALKKCNGIVEEATEEELMDAMAQADSTGMFICPHTGVALTALFKLRNQGVIAPTDRTVVVSTAHGLKFTQSKIDYHSNAIPDMACRFSNPPVDVKADFGAVMDVLKSYLGSNTLTS

SEQ ID NO: 84289 - protein, 577 aa, Gibberella zeae PH-1
MPRKKAVEESDSQQLPTRSLRKRNHQELEAIPESDQEETSPVKRQRSVSHESPSTNGETNGNINGFMSNGAEDVAASESESLSKVDPEETPKPAPKRRGRPPKKAVNAGSPTPKASRTALFETPTKARFGLNPDTPGGADRSAKRKSTRALIEHVVGDDLTDEEEYDGLAHKIYESSEDEDALEGDNAISAEASGLDEAATPSKSTPRRKAQRKKPARSPTPPRDLPPHELYFAHNKPGRAKTSNNTLGSLALLTHDEYFTIVRETSDHHEGDIEFLESLHAESFPQWAFELSQGFNLCLYGYGSKRRLLHKFAGHLHSRSRKEKGDKIVIINGYAPNTTMREILSTIGSAVDPAHRIPLTQPAVMVPAILSHLNTTSSTITLIVNSIDAAPLRKPGSQTALAQLAAHPHIRLVCSADTPDFALLWDIGVRSAFNMGFHDCTTFAPYTAELDVVDEVHELLGRNAHRVNGREGVAFVLRSLPENAKNLFRLLVGEVLIAIEEEGDGGDEPTGIEYKMVYNKAVEEFICSSEMAFRTLLKEFHDHQIITSMKDALGTELLSLPFRKDELEAILEDLTS

SEQ ID NO: 84290 - protein, 229 aa, Pasteurella multocida subsp. multocida str. Pm70
MDKKQLIQQLKTQPISVGILASDWLKFADTLTTLSRHHLRLLHFDIGDGQFSPFFTVGALAVKQFPSPWLKDVHLMVNDPFHVAKACADAGADIITLQVEQTDCLAETISYLREHYPDLLIGLTLCPDTEIDLLTPYLAQVDLIQILTLDPRTGVKAETDAVIKRITRISNMLGEHRDQKLISVDGSMNLALASQLFPLGIDWVVSGSALFSQADVDATLSEWKTHLCR

SEQ ID NO: 84291 - protein, 421 aa, Aspergillus nidulans FGSC A4
MSLTSKLSITDVDLKDKRVLIRVDFNVPLDKNDNTTITNPQRIVGALPTIKYAIDNGAKAVILMSHLGRPDGKKNPKYSLKPVVPKLKELLGRDVIFTEDCVGPEVEETVNKASGGQVILLENLRFHAEEEGSSKDADGNKVKADKDAVAQFRKGLTALGDIYINDAFGTAHRAHSSMVGVDLPQKASGFLVKKELEYFAKALEEPQRPFLAILGGSKVSDKIQLIDNLLPKVNSLIITGGMAFTFKKTLENVKIGSSLFDEAGSKIVGNIIEKAKKHNVKVVLPVDYVTADKFAADAKTGYATDEQGIPDGYMGLDVGEKSVESYKQTIAESKTILWNGPPGVFEMEPFAKATKATLDAAVAAVQNGATVIIGGGDTATVAAKYGAEDKISHVSTGGGASLELLEGKELPGVAALSEKSK

SEQ ID NO: 84292 - protein, 266 aa, Triticum aestivum
MAMAAYSNQAQAMMRDYLLADPLVPYTSVLIGVFLCKMAYDLTRILSSFYFKGYSSLTKIQRVEWNNRGMSSAHAIFIAAVSVYLVASTDLFSDRLNGPITFRSSIISTSALGVSVGYFITDLAMIFWLFPSLGGMEYVLHHTLSLVAIAYTMLSGEGQFYTYMILISETTTPEINMRWFLDTAGLKKSSAYLINGILIFVVWLVARIFLFLYVFYHIYLHYSQIMKMHAFGYYLTLTVPSVLFVMNAMWFTKILKGVMKTLSKWS

SEQ ID NO: 84293 - protein, 218 aa, Synechocystis sp. PCC 6803
MFSPSVYSEIIATLPPSVRLVAVTKTKAIADIEAAYGAGIRDFAESRIQEALPKIEALANYQDINWHFIGRLQSNKARKVVENFTYIHSVDNLAIAVKLDRIAEELNKFPQGLLQIKLLPDENKSGWTREELKLDLPQLELLKNLKICGLMTILPLGLSPGDRQLTFGELKNLATAINQQSSLSLTELSMGMSGDYPEAIAAGATMIRLGTILFGDRL

SEQ ID NO: 84294 - protein, 180 aa, Amaranthus hypochondriacus
MASSLMSNAITAVVGASGAQANMVAPFNGLKSIASFPVTRKSNDITSIASNGGRVQCMQVWPPVGKKKFETLSYLPPLSDAQLLAQVQYLLNNGWIPCIEFELEHPFVYRENHRSPGYQDGRYWTMWKLPMYGCTDPAQVLNEVEEAKKAYPSAFIRIIGFDNKRQVQCVSFIAFKPPGY

SEQ ID NO: 84295 - protein, 184 aa, Amaranthus hypochondriacus
MASSMMSNAATAVAVAATSGGAQANMVAPFNGLKSIASFPVTRKSNDITSIASNGGRVQCMQVWPPVGKKKFETLSYLPPLSDAQLLAQVQYLLNKGWIPCIEFELEHPFVYRENHRSPGYQDGRYWTMWKLPMYGCTDPAQVLNEVEEAKKAYPTAFIRIIGFDNKRQVQCVSFIAYKPADSY

SEQ ID NO: 84296 - protein, 222 aa, Spinacia oleracea
MASFAASQTCFLTTNPTCLKPNSPQKSSTFLPFSAPLSSSSSFPGCGLVHVASNKKNRASFVVTNAVRELEGYVTKAQSFRFAIVVARFNEFVTRRLMEGALDTFKKYSVNEDIDVVWVPGAYELGVTAQALGKSGKYHAIVCLGAVVKGDTSHYDAVVNSASSGVLSAGLNSGVPCVFGVLTCDNMDQAINRAGGKAGNKGAESALTAIEMASLFEHHLKA

SEQ ID NO: 84297 - protein, 295 aa, Listeria innocua Clip11262
MRVKKAVIPAAGLGTRFLPATKAMPKEILPIVDKPTIQYIVEEAVASGIEDILIVTGKGKRAIEDHFDSVPELENNLREKNKLELLHLVEQTTNINLHFIRQAKPKGLGDAILQAKGFVGNEPFIVMLGDDIVESKIPCSKQLMNQYEKTHSSVIGVQTVPHEETYRYGIIDPINEYDKNLYNVKGFVEKPDPAKAPSDLAILGRYLLTPQIFDFLETQKPGAGGEIQLTDAINSLNEVQRVFAYDFEGERFDVGDKFGFIQTTMQFALKHPEIKEDVKALIDDLYQQVHKNDKK

SEQ ID NO: 84298 - protein, 199 aa, Hyacinthus orientalis
SSLRSTHSLSLKPLSHVEMGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKG

SEQ ID NO: 84299 - protein, 328 aa, Lactobacillus acidophilus NCFM
MNKEELHQLLHPMKVIGLGGNPALNEKIASILHQPLIETAVHHFSDGEIQVNIGETVRGCDVFVIQSIQDPVNENFMELEIVLDALHRASAHRINVVVPYLAYSRSDTKTRSREPITAKLIANLLQLTGMDRLITVDLHASQIQGFYNTPVDHLHAIPLLAQYFLDNGIATKEDDDIVVVSPDHSGAKLARNFGQYFNAPIAIVDQRGARYDTEVHDIIGDVKDKKCIIVDDLIDTGSRISSSTKSVLASGAKKVYVAATHALLSKNATEVINELPIEQIVVTDTIKHNRYPDRMVRISVDQLLARGIDYVYNDRSIHQIFDEQNRLK

SEQ ID NO: 84300 - protein, 332 aa, Phytophthora infestans
MNVAINGFGRIGRLVLRASAKNPLINIVAINDPFVSTTYMEYMLEYDTVHGKFDGSLSHDETHIFVNGKPIRVFNEMNPENIKWGEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALTDDFVKLVSWYDNEWGYSSRVLDLIEHMVKNE

SEQ ID NO: 84301 - protein, 368 aa, Hyphomonas neptunium ATCC 15444
MKTRAAVAFEAKKPLEIVELDLEGPKAGEVLVEIMATGICHTDAYTLDGLDSEGIFPSVLGHEGAGIVREVGAGVTSVKPGDHVIPLYTPECRQCKSCLSGKTNLCTAIRATQGKGLMPDGTSRFSYKGQTVFHYMGCSTFSNFTVLPEIAVAKIREDAPFDKACYVGCGVTTGVGAVVNTAKVQVGENVVVFGLGGIGLNVIQGARMAGADMIVGVDINPDKEEWGRKFGMTHFVNPKNVSDVVAHIVELTGGGADYSFDCTGNTTVMRQALECCHRGWGTSVVIGVAESGKEISTRPFQLVTGRNWRGTAFGGAKGRTDVPKIVDWYMNGKIEIDPMITHVMTLDKINDAFDLMHEGKSIRSVVVY

SEQ ID NO: 84302 - protein, 403 aa, Cytophaga hutchinsonii ATCC 33406
MNIHEYQAKEILKKYNVKIGEGIYADSPESAVEAAKKLKEQTGTDIFVVKAQIHAGGRGKGKFVGTEHRGVMIAKSYDEVKEKAAQMLGNTLVTIQTGPSGKVVSRLLVAADVYQKGASEPKELYLSMLLDRGTGQDVIIASTEGGMDIEEVAHSTPHLITKEFVDPAVGLQGFQARKIAFGLGLSGTAFKEMVTFVTRLYTAYKATNAEMIEINPVLKTSKDEILAVDAKVSIDDNALFRHPDLAAYRDVTEEDPLEVEAAESHLNYVKLDGNVGCMVNGAGLAMATMDVIKLAGGEPANFLDVGGGANAKTVEAGFRIILKDPNVKAILINVFGGIVRCDRVANGVVEAYKNIGTINIPIIVRLQGTNAEEGAKIINESGLKVRSAVILKDAAKLVTEALA

SEQ ID NO: 84303 - protein, 363 aa, Synechococcus sp. WH 7805
MLKAGIVGLPNVGKSTLFNALVANAQAQAANFPFCTIEPNVGTVAVPDSRLQLLSDLSSSAEIIPTRMEFVDIAGLVKGASQGEGLGNKFLANIREVDAIVHVIRCFEDDDVIHVSGAVGPARDAEVINLELGLADLSQIEKRRERLKKQVRTSKEAQVEDAALERIQVVLEQGGAARSVELSDEEALMVKPLGLLTAKPIIYATNVSEDDLAAGNAFCEEIVALAAKEGAETVRISAQVEAELVELGDEERQDYLDGLGVTEGGLQSLIRATYRLLGLRTYFTTGEKETRAWTFKAGMTAPQAAGVIHTDFERGFIRAQTISTDKLLEAGSLVEARNKGWLRSEGKEYVVDEGDVMEFLFNV

SEQ ID NO: 84304 - protein, 408 aa, Mycoplasma penetrans HF-2
MLKNLRNEIEWFKNNPDYVYLDSGATSLKPKSVVDNMVYYCNNVCTNPHNDDSTFAHQAHIVMDDTKNKLSKVLGTKKENLVFTPNATYGLNSVAHFLKPFFNKGDEIVLTNAEHASNILPWYDIYEQYKAIHQEIKIQYVEVDYQSDNIENFLKKINKNTKLVCFANETNLIGNSIDAIKLASEIKKINPNIFICVDATQYMAHNRMNLENSNIDFVVGSAHKMLGPTGIGFLYISSDLIEKMKPNIVGGGMNFEIKRNYYSLLSGTAKFEAGTANIMAIYGWNKALDYYLDDDLENAKNKIFELKKYLDFELGKIEGIKVLNKGINAFNSIFIKENIFSQDFSSYLGNKKIIVRSGLSCAKLANEILNLDHVVRVSYHFYTNKSDIDKLIKAVKEFKKGDILNGLL

SEQ ID NO: 84305 - protein, 189 aa, Methanosarcina mazei Go1
MRELKILVVNNYGQFCHLIHRTVRDLDMDTKIIPNVTPIEEILAEEPDGLILSGGPEMERAGLCFDYVREIDVPILGICLGHQAIALAYGGHVHAGKKGGYAEIEVEVLEEDDILRGLGPKTTVWASHADEVAILPDGFIHLARSDVCEIEAMRHPTKPIYGVQWHPEVSHTKKGEELLMNFFEVCDLY

SEQ ID NO: 84306 - protein, 153 aa, Glycine max
  misc_feature (42)..(42): Xaa can be any naturally occurring amino acid
  misc_feature (84)..(85): Xaa can be any naturally occurring amino acid
  misc_feature (87)..(94): Xaa can be any naturally occurring amino acid
VIFLMTKAGVSEKDIAKVVALGPELLGCNIAHKLDVNVKYFXLGIRLRQLGEMIADFPMLLRYNPDVLRPKYIYLWKTMVWPLXXPXXXXXXXXYSLEGRIIPRHKVLVENQINIKLRYIMLTSTDEEFNKMVKGIIRKRLRFESAVTNEDTT

SEQ ID NO: 84307 - protein, 146 aa, Brassica napus
ISFVAVMSSHDSMGLIFKCLSKGAVDFLVKPIRKNELKILWQHVWRRCQSSSGSGSESGTHQTQKSVKSKNIIKSDNDSGHSGENENGSIGLNASDGSSDGSGAQSSWTKKAVEVDDSPRAVSLWDRVDSTCAQVVHSNPEFPNNH

SEQ ID NO: 84308 - protein, 755 aa, Bradyrhizobium sp. ORS278
MRSTSGGPRVLLRRLRETMAEQVSAQERLDKIVVLIAANMVAEVCSVYVLRVDNTLELYATEGLNRDAVHMTVLSAHEGLVGLVASEATPLNLSDAQNHPAFSYRPETGEEIYHSFLGVPILRAGNTLGVLVVQNRAKRTYVEEEVEALQTTAMVLAEMIASGELAALAQPGAEPAVRHSVHKTGAVLSDGIALGHVVLHEPRVVVNNYIAEDLPKEIKRLDAALVKLRADLDRMLERGDVADGGEHREVLEAYRMFANDQGWSHKLHEAVATGLTAEAAVERVQSDTRARMLRSTDPYLRERLHDLEDLGYRLLRQLVGQDHAPSRDHLPDNAILIARAMGPAALLDYDRKRLRGLVLEEGTANSHVAIVARALGIPAVGEVPNAPGIADPGDAIIVDGTSGSIYVRPSAEIESAYAERVRFRARRQAQYSELRNKPCKTKDGQPVELMINAGLVIDLPHIEDTGSAGIGLFRTELQFMVSASLPRSSDQLALYRTVLDAAGSKPVTFRTLDIGGDKALPYMETVIEENPALGWRAIRLGLDRPGLLRGQIRALLRAGGGRSLRIMFPMISEVAEFDTAKAIVERELTYLRQHGHTLPERVDIGTMLEVPALLYQMDELLAKVDFISVGSNDLFQFLFAVDRGNAKVSERFDTLSTPILRALQEIVRKAKAAKRSVSLCGEMASKPIGALALIALGYRSLSLSATAHGPVKAMILELDAAKAEAKMAEWLATPAGSISMRQKLTEFAESEGLAL

SEQ ID NO: 84309 - protein, 418 aa, Bradyrhizobium sp. ORS278
MGRLVLKFGGTSVANIDRIRNVARHVKREVDAGHEVAVVVSAMSGKTNELVAWCTEASPMHDAREYDAVVASGEQVTSGLLAIVLQSMGIQARSWQGWQIPIKTSDAHASARIVGIDGSELIQRFQERKEVAVIAGFQGINAETGRITTLGRGGSDTSAVAIAAAIKADRCDIYTDVDGVYTTDPRVVPKAKRLDKIAFEDMLELASQGAKVLQVRSVELGMVHNMPIFVRSSFDKPEDIDPHANQPPGTLICSEEQIMENHVVTGIAFSKDEAQISVRQIEDKPGIAASIFGPLADANINVDMIVQNVSEDGKTTDLTFTVPATDYNRARETITAAKDKIGYQRMDAATDVAKVSVIGSGMRSHAGVAAKGFAALAARNINIRAITTSEIKFSVLIDAAYTELAVRTLHTLYGLDQA

SEQ ID NO: 84310 - protein, 581 aa, Oryza sativa Indica Group
MRLSSLLFLVCFFTVAMSQCAAAAKARHFRWEVSNMFWSPDCEEKVVIGINGQFPGPTIRAKAGDTIVVHLKNGLHTEGVVIHWHGIRQIGTPWADGTASISQCAINPEETFTYRFVVDKPGTYFYHGHYGMQRAAGLYGSLIVDVADGDEEPFKYDGEINLLLSDWYHESIYTQMVGLSSNPFRWIGEPQSLLINGRGQFNCSLAAAHTPGAKQCAAAGNRHCAPVILPVLPNKTYRLRVASTTSLASLNLAVGNHKLTVVEADGNYVEPFAVDDIDIYSGDSYSVLLTTDQDTSANYWVSVGVRGRQPRTAPALAVLNYRPNRASRLPAAAPPATPAWDDFARSKAFTYRILGRAGVTPPPPATSDRRIELLNTQNRMGGGHVKWSINNVSMVLPATPYLGSLKMGLRSALPSAARPSDTFGRGYDVMRRRRTRTPRWATTCTCSRTTRRWTWCSRTRTRWRGTSARCTRGTLHGHDFWVLGYGDGAFRGDAGDAAALNLRNPPLRNTAVIFPYGWTAIRFVADNPGVWAFHCHIEPHLHMGMGVIFAEAVDRVSELPKAAVSCGATATALMAGAGGHV

SEQ ID NO: 84311 - protein, 613 aa, Gibberella zeae PH-1
MAPSYGQPGNTRDSLELASLASSSQLNDEGATEISSRQSISSSRRLSLELDDPLNSANPANPAGRMHRSYSTTSAFEYSGNMFPLSSTAGAEGYAPIGASNSRVRPTGGLGGGSLEKSKNLTYLNGLSLIVGLIIGSGIFSSPGAVSSKVGSPGAAVLVWIIAGILAWTGAASYAELGGAMPLNGGAQVYLAKTFHEVFGFLFTWVAMLVLKPGSAAIISIIMGEYFVRAFIGADAEYVNPWINKAVALVGLLIVTFLNCVSTKLGTRVNDALMFMKFIALIGITITGIVVMITGKTLKGESEVDWKPSAMFDNTSTDMSAWALALYAGLWAYDGWDNTNYVVAEFQNPARDLPRVIHTAMPLVILSYVLANIAYFLVLPLKSMDGANTVGVMFGSHVFGSVGSLVLALIVSASCFGALNSSTFTSSRLAYAAGKEGYIPSIFGTIGVGASAHEHELSTLRTRSWFTRKMRQMFGDEDAGLFYTPVYALILNAVLTTGYIIVGEFSTLVTFYGVAGYAFYFLTVLGVIVLRVKEPELPRPYKTWITTPIIFCCVSIFLLTRAVFAQPFQTLSVVFFVVAGVPVYFWRIRGRDEQVLRRRGHSDEDKKWYQFWK

SEQ ID NO: 84312 - protein, 522 aa, Oryza sativa Indica Group
MNNKMHTEGVVIHWHGIRQCHRLELATGFLATPKTGKHEEDFIFEQEKLKFGTPWADGTASISQCAVNPGETFVYKFVADKPGTYFYHGHFGMQRAAGLYGSLIVLDSPEQPEPFRHQYDDGGELPMMLLSDWWHQNVYAQAAGLDGKDRHFEWIGEPQTILINGRGQFECTLGPARKSFEKLLNENVETCVDDQKMCSDQEKCLRRSECGPYCPRSQCAPVVFNVEQGKTYRLRIASTTSLSLLNVKIQGHKMTVVEADGNHVEPFVVDDIDIYSGESYSVLLKADQKPASYWISVGVRGRHPKTVPALAILSYGNGNAAPPPLQLPAGEPPVTPAWNDTQRSKAFTYSIRARKDTNRPPPAAADRQIVLLNTQNLMDGRYRWSINNNANMLREEVSETHPWHLHGHDFWVLGYGDGRYDPAAHAAGLNAADPPLRNTAVVFPHGWTALRFVANNTGAWAFHCHIEPHLHMGMGVVFVEGEDRMHELDVPKDAMACGLVARTAATPLTPATPLPPSPAPAP

SEQ ID NO: 84313 - protein, 243 aa, Oryza sativa
SSSPRLSPHIIPSVLLPPHPPQPLHPGRRPPPPPPPRRMQRAIQAIGSHGSLLKSAVLRHISAPKPSILPAVYSRSMSVSSAQIEESGFETATVADILKSKGKSADGSWLWCTTDDSVYDAVKSMTQHNVGALVVVKPGQDKSIAGIVTERDYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 84314 - protein, 295 aa, Pasteurella multocida subsp. multocida str. Pm70
MKAIIPVAGLGTRMLPATKAIPKEMLTLVDKPLIQYVVNECVAAGMKEIVLVTHSSKNAIENHFDTSFELETMLEKRVKRQLLDEVRSICPKNVTIMHVRQGNAKGLGHAVLCGRPLVGNEPFAVILPDVLLADFSADQKRENLAAMVKRFEETQTSQIMVAPVAEKEVSSYGIVDCGGADLKGGESTKIHSIVEKPSLDKAPSNLAVVGRYVFSAAIWDLLEKTPIGVGDEIQLTDAIDMLIEKEVVEAFHMTGKSFDCGDKIGYMQAFVEYGLQHDKLGQQFKTYLQQLVKSF

SEQ ID NO: 84315 - protein, 116 aa, Bradyrhizobium japonicum USDA 110
MTGLSIHARHGVMDHETEVGQRFVIDLELYTDLSEPSRTDRLADTVSYAEVVATTTAAFKNTNYKLLERAAGAVADAILSHFPRIRAVKITVHKPHAPIAAIFDDVGIMLTRSRHP

SEQ ID NO: 84316 - protein, 80 aa, Glycine max
LPNGTCKTCLKSANIGVFICLKCCGVHRSLGTHISKVLSVTLDDWSEDEIDAMMEVGGNASANSIYEAYIPEGYTKPGPD

SEQ ID NO: 84317 - protein, 334 aa, Thermus thermophilus HB27
MAYRICLIEGDGIGHEVIPAARRVLEATGLPLEFVEAEAGWETFERRGTSVPEETVEKILSCHATLFGAATSPTRKVPGFFGAIRYLRRRLDLYANVRPAKSRPVPGSRPGVDLVIVRENTEGLYVEQERRYLDVAIADAVISKKASERIGRAALRIAEGRPRKTLHIAHKANVLPLTQGLFLDTVKEVAKDFPLVNVQDIIVDNCAMQLVMRPERFDVIVTTNLLGDILSDLAAGLVGGLGLAPSGNIGDTTAVFEPVHGSAPDIAGKGIANPTAAILSAAMMLDYLGEKEAAKRVEKAVDLVLERGPRTPDLGGDATTEAFTEAVVEALKSL

SEQ ID NO: 84318 - protein, 638 aa, Coprinopsis cinerea okayama7#130
MSAGQQGNTQQSSQTWTEPPWSGWIETTGDALLILEAARRGLIPRVTRRLVDSERKMITSGSVFVFDEEESGIKRWTDGFFWSPSRILGNFLLYRETDKRGNRNARNADPDSDSPDGSRSEGALSRPKNETTSLGIDKHRERSLYGSLTNSYKFKSDGLMKKTFSLTIGGVAQHLISYYKIEDVEQGRLRTPSSLPELASLEISPEYLDKTHFRNAPKVEVGADGILRYRGEGEEVESPSPSSSSSVVPHPIESNLPLLTDGHVAEGPSSSGKRSTKRYLPYGTTPHVRARRRSRSQADAPPPMGPASPLSPAEGSSVVLAPPPQTAAPLPHVPPATPAYATDTSAPMHTPSAYPPYPYLSPPPATMNYQPPAHVGSTMYPPQHAYPPPPPTTQPQAPLPQQVPQHPYPAYATPANPTSDPSSSSSTATPQQSTQNPTTSPHQQHQHPHPQPHQQQPVHHHHPPPHPPPPQTYPYSYYPPPHPPPVHVPPPPHPHAHMHTMQYAPYPHPGTAAPPPPPPHVWPSYPGYPPQPQPPQPHHQQPQPQQQQHQQHQAQIPAAPAAPVPTTLHAAVTQAQAAQQNHTAHPPHNTHSPHITHSPHPQPSTPQMPDGQVHGGVGVGLGVGVPTSADRTEVQTGQ

SEQ ID NO: 84319 - protein, 231 aa, Prochlorococcus marinus str. AS9601
MKQVVADAAIREVKSDMILGLGSGSTAALMIKSLADEMRSGKLQNIRGVATSFQSEVLALELNIPLIDLASVSQIDLAIDGADEVDPGFQLIKGGGACHVREKLVASKSDQLLIVVDETKLVQNLNLSFPLPVEVLPNAWKQVQEVISEMNGSSSLRMANKKAGPVVTDQGNLVLDVLFNDGIKNPKDIEKTINNIPGVLENGLFVDLTDKVLVGKIENNTPVVYSPSRVS

SEQ ID NO: 84320 - protein, 500 aa, Mycobacterium smegmatis str. MC2 155
MSEHYSMYIDGKWIDTDEVYEIRSPATEELVATVAKGNTASVDAAVEAAKGAFAEGTWRRTPPAQRAAIINNVAERLGARADELAALQTRENGATIRITGALHVGLSVAQLQYLAAIAENYEWETPGPAIEPVAADGVVVREPLGVVAAIVPWNIPLLTTVWKIGPALVAGNSVVLKPDEHAPLLALELAREFDAAGLPPGVLNVVTGDGEPVGAHLSGHPDVRKVAFTGSTAVGKSILRQSADTVRRVTLELGGKGANIILDDADIDMAVDGALFACMANNGEACEAGTRLLIPASRRDEIVDKLLARASTLRVGDPLDPATHIGPVISQTQRDRILNYFRIAAEEGAIAALGGKARSGPEFDKGYWIEPTIYLDVTNDMRVAREEVFGPVLVVMTYDTDEDALAVANDTNYGLSAGVWGSEERATALARRLEAGMVWVNNWHIIHPAYPFGGYKESGLGREGGPNAIDEYVEEKFIAVDRSGGIENKAFAIVIDPAGD

SEQ ID NO: 84321 - protein, 514 aa, Triticum aestivum
MDVTAWAWASFLAVVLVVLTILRRGRGSQPQGNRLPPGPKPWPVIGNLNLIGALPHRSIHELSKQYGPLMQLRFGSFPVVVGSSAEMARFFLKTHDTVFADRPRTAAGKHTTYNYSDVLWAPYNAHFRRARRLFATELFSAARLESYKHIRHEEVSALLRDLAAAAHGASGRAVPLRGHLFAATNGIISRVVLGKKYAEKEAGGSAAMALEDLSGLIEEFFLLNGVINVGDFIPWFDWLDLQGYVRRMKKYSKKMDRFLEHVLEEHEERRRVKGEQFVARDMVDVLLQLADNPNRLDRDTVKALTQELIVGGSDTSSVTMEWAMSEVLRNPEVLGKATKELDRVVGRDRMVMEKDIPDLPYIEAIVKEAMRMHPVSPMLAPHLAREDASVDGHDIPAGTLVLVNVWAIGRDPTYWDAPEEFRPERFMGSKIDVKGQDMELLPFGAGRRMCPGYSLGLKVVQLIVANLLHGFTWGLPDGTTMEQLNMEEIYGLTTARKFPLEAVVEPKLQEHVFS

SEQ ID NO: 84322 - protein, 216 aa, Brassica napus
  misc_feature (129)..(130): Xaa can be any naturally occurring amino acid
  misc_feature (133)..(133): Xaa can be any naturally occurring amino acid
  misc_feature (138)..(138): Xaa can be any naturally occurring amino acid
  misc_feature (144)..(144): Xaa can be any naturally occurring amino acid
  misc_feature (160)..(160): Xaa can be any naturally occurring amino acid
  misc_feature (166)..(166): Xaa can be any naturally occurring amino acid
  misc_feature (173)..(173): Xaa can be any naturally occurring amino acid
  misc_feature (175)..(175): Xaa can be any naturally occurring amino acid
  misc_feature (178)..(179): Xaa can be any naturally occurring amino acid
  misc_feature (187)..(187): Xaa can be any naturally occurring amino acid
  misc_feature (196)..(196): Xaa can be any naturally occurring amino acid
MDSSSWINHPSVISSRRCQSRSDLYIGGGYEDLEGEDESKSEFICPFCADVFDIVGLCCHIDEEHPVEAKNGVCPVCTKRVGLDIVGHITTQHANFFKVQRRRRLRKGGYGSAYLALKKELREANLQSXXGGXTRFTXSTNLDXDPLLSSFMFSSPSTKXVTPVVXGTSATKXSXKEXXKREIQEAXLSGEDQEKXKKSEFVRGLLLSTMLGVGDS

SEQ ID NO: 84323 - protein, 419 aa, Pseudomonas syringae pv. tomato str. DC3000
MLELAAGFICLTSLLTYVNYRFIGLPPTIGVMVTALMFSLLLQGLSFLGYPGLEDRVQQLIGQIDFGDLLMNWMLSFLLFAGALHVNLADLKSYRWPIGLLATFGVLIATTVIGALAYWIFALFGWHVSPLYCLLFGALISPTDPIAVLGVLRTANASKPLKTTIVGESLFNDGTAVVVFTVLLGIAQLGETPTVGETALLFVHEAVGGVLFGGLIGYAVYLMIKSIEQYQIEVMLTLALVIGGSAMASELHVSGPIAMVVAGLIIGNLGRNLAMNDMTRRYMDGFWELLDDMLNALLFALIGMELLLLPFSWQHLIAASLLAVAILLSRFVTVAPAILLLRRWRKVPHGTIRILTWGGLRGGVSVALALALPNGPERDLLLSITYIVVLLSILFQGLTIGKLVNAVTREPQAKDPAGH

SEQ ID NO: 84324 - protein, 294 aa, Serratia marcescens
IVFRAAQERSDIEIVAINDLLDAEYMAYMLKYDSTHGRFNGTVEVKDGHLVVNGKTIRVTAEKDPANLKWNEVGVDVVAEATGIFLTDETARKHITAGAKKVVLTGPSKDATPMFVRGANFDKYAGQDIVSNASCTTNCLAPLAKVINDNFGIVEGLMTTVHATTATQKTVDGPSHKDWRGGRGASQNIIPSSTGAAKAVGKVIPELKGKLTGMAFRVPTPNVSVVDLTVRLEKPATYEEIKKAMKDAAEGSMKGVLGYVEDDVVSTDFNGEVLTSVFDAKAGIALNDNFVKLV

SEQ ID NO: 84325 - protein, 294 aa, Serratia odorifera
IVFRAAQERSDIEIVAINDLLDAEYMAYMLKYDSTHGRFNGSVEVKDGHLVVNGQTIRVTAEKDPANLKWNEVGVDVVAEATGIFLTDETARKHIAAGAKKVVLTGPSKDDTPMFVMGVNLKSYAGQEIVSNASCTTNCLAPLAKVINDKFGIVEALMTTVHATTATQKTVDGPFHKDWRGGRGASQNIIPSSTGAAKAVGKVIPELNGKLTGMAFRVPTPNVSVVDLTARLEKPASYKEVCAAIKEAAEGELKGVLGYTEDDVVSTDFNGEKLTSVFDAKAGIALNDNFVKLV

SEQ ID NO: 84326 - protein, 180 aa, Xanthobacter autotrophicus Py2
MRIDAIPIGKNPPHDVNVVIEVPIGGEPIKYELDKAAGTLFVDRFLYTAMRYPGNYGFIPHTLSGDGDPCDVLVANTRAIMAGAVISVRPVGVLLMEDEAGVDEKIIAVPSSKLTKRYDRVTNHSDLPEITLKQIEHFFEHYKDLEPNKWVKILRWGDAAEAHKLILEGIERAKAEGKEG

SEQ ID NO: 84327 - protein, 361 aa, Zea mays
MSSELLSLLSTNLLALLAFLSPRVHPVPVPAATSNLSSSAAAAISAQVAAIAHELDATRLVPHCVSAGDGTGTTLPSELLLFLSPHALPLGRDARMGHTHMPTSVAHACFRSPSTLALLAAFATYAPHAACPRDATLAHRLVSKACEPLPRRRYLSQGPRAALSASNMGVDGRRWVRSRHDHEFLVDDVLRLAAGKIRTGLDVSGGAANFAARMRERGVTIFTTVLDNAGKPMNEFVAARGLFPLLLSPAHRFPFYDGVFDLVHVGATALAEGGSPALGQAGTEEALEFFMFDVDRVLRAGGLLWIDSHMCHADERRQTLARLIGRYGYKKLRWATGEKAGTGSTKAAMYLCAVLQKPARV

SEQ ID NO: 84328 - protein, 407 aa, Zymomonas mobilis subsp. mobilis ZM4
MSPSAGNNRVADFNHRADFPAIPENWSYLDSAATAQKPKAVIDAVYKAYAVDYATVHRGVYSRSADMTIAYEKARETVAHFIGAKTADEVVFVRGATEAINLVAQIWGAAHLKQGDRILISQLEHHSNIVPWQLLRDRMGFAIDVIPLDEEGRIDLDAAARMIRPEHKLLSLAHISNVLGSVLDVSKARKIADSVGAKLLIDGCQSAPHLPINVSELGCDFFVFSGHKLYAPTGIGVLWAKSDILDSMAPWQGGGAMIDQVTFEKTTYLDPPARFEAGTPHIVGTLGLAAAIEYLENIGMEEVARHEAALTKIARNRLKDIKGLRLFGADDSAAILSFSMDGIHPHDIGTILDEEGVAIRAGHHCAQPLMAHLNVPATARASFGLYNEEQDIERLAAGLSRVVSIFL

SEQ ID NO: 84329 - protein, 331 aa, Thermus aquaticus
MKVGINGFGRIGRQVFRILHSRGVEVALINDLTDNKTLAHLLKYDSIYHRFPGEVAYDDQYLYVDGKAIRATAVKDPKEIPWAEAGVGVVIESTGVFTDADKAKAHLEGGAKKVIITAPAKGEDITIVMGVNHEAYDPSRHHIISNASCTTNSLAPVMKVLEEAFGVEKALMTTVHSYTNDQRLLDLPHKDLRRARAAAINIIPTTTGAAKATALVLPSLKGRFDGMALRVPTATGSISDITALLKREVTAEEVNAALKAAAEGPLKGILAYTEDEIVLQDIVMDPHSSIVDAKLTKALGNMVKVFAWYDNEWGYANRVADLVELVLRKGV

SEQ ID NO: 84330 - protein, 336 aa, Hyphomonas neptunium ATCC 15444
MTQHFKTFGVIGAGAWGTAIAQMLAREGQTVHLWALEPEVAAAINTARENTAFLKGVPLKPEIRATNKLEDLGLADAIFAVAPAQHTRTTLRALRASLRPGTPVVLCSKGIELATGEFMTQVLKDELPEAIPAVMSGPSFAIDVAKGLPTAVTLAIEDTRLGTELIQAISTPTFRPYLGTDLLGAEVGGSVKNVLAIACGIALGKGLGRSAHAALIARGYAEMTRLALTLGAEAETLTGLSGLGDLVLTCSSETSRNMSLGLALGKGETLASILAARNAVTEGVATAPVLRRLARSQGIEMPICEAVAAVIEGEITVDDAITALLMRPVKAEAVKP

SEQ ID NO: 84331 - protein, 333 aa, Zygosaccharomyces rouxii
MVNVSVNGFGRIGRLVTRIAISRKDINLVAINDPFISTDYAAYMFKYDSTHGRFDGEVSHDKDHIILNGKKVAVFNEKDPAALPWGKLGVDVAIDSTGIFKEMDSANKHIEAGAKKVVITAPSGSAPMYVMGVNEETYTPDQKIVSNASCTTNCLAPLAKVIHNEFGIKEGLMTTVHSMTATQKTVDGPSHKDWRGGRTASGNIIPSSTGAAKAVGKVLPSLQGKLTGMAFRVPTVDVSVVDLTVNLAKETSYDEIKAALKKASEGSMKGILGYTEDDVVSSDFLGDAHSSIVDAAAGIQLTPTFVKLVSWYDNEFGYSTRVVDLVEHVAKSA

SEQ ID NO: 84332 - protein, 213 aa, Cytophaga hutchinsonii ATCC 33406
MPILVIVRHGQSEWNLKNLFTGWSDVELTPTGEHEAEYAGIVLRPYHFDIAFTSVLKRAIHTLSIILNQTGATIPIIENEALNERNYGDLQGLNKAEVGEKYGAQQLIAWRRSYTEVPPGGESLENTCQRVIPYYQEKIEPELKDGRNVLIVAHGNSLRALMMHLEKISPEDIAHVDLATGAPRLYEFSSKLDLNSVSYIKLPETPLDVSTLL

SEQ ID NO: 84333 - protein, 183 aa, Panax ginseng
MASSVISSATVAAVSRAVPAQASMVAPFTGLKSTAAFPVTRKVNDITSLPSNGGRVQCMKVWPPLGLKKFETLSYLPQLTQEQLSKEVDYLLRSGWVPCLEFELEHGFVYREHHHSPGYYDGRYWTMWKLPMFGCTDSSQVLKEVEECKKEYPNAYIRIIGFDNVRQVQCISFIAFKPPSAST

SEQ ID NO: 84334 - protein, 329 aa, Trifolium repens
MGRFNNVILVWSLLLMLCFIPYTTFAQLSPNHYANICPNVQSIVRSAVQKKFQQTFVTVPATLRLFFHDCFVQGCDASVLVASSGGNQAEKDNPDNLSLAGDGFDTVIKAKAALDAVPQCRNKVSCADILALATRDVINLAGGPSYTVELGRFDGLVSRSSDVNGRLPQPGFNLNQLNSLFASNGLTQTDMIALSGAHTLGFSHCNRFSNRIFNFNNQSPVDPTLNKQYAAQLQQMCPRNVDPRIAINMDPTTPRQFDNAYYQNLQQGKGLFTSDQILFTDTRSRATVNSFASSGNVFNANFINAMTKLGRIGVKTARNGKIRTDCSVL

SEQ ID NO: 84335 - protein, 272 aa, Staphylococcus aureus subsp. aureus Mu50
MENTVKYRKFILPIVVGLLIWALTPFKPDAVDPTAWYMFAIFVATIIACITQPMPIGAVSIIGFTIMVLVGIVDMKTAVAGFGNNSIWLIAMAFFISRGFVKTGLGRRIALHFVKLFGKKTLGLAYSIVGVDLILAPATPSNTARAGGIMFPIIKSLSESFGSKPKDGSARKMGAFLVFTEFQGNLITAAMFLTAMAGNPLAQNLASSTSNVHITWMNWFLAALVPGLVSLIVVPFIIYKIYPPTVKETPNAKSWAENELATMGKIALAENL

SEQ ID NO: 84336 - protein, 489 aa, Vibrio parahaemolyticus RIMD 2210633
MSIWQRVSFTHRFSQLPSAFYTLVEPQPLDNTRWVAWNGEFAQQFGLPAAQNDELLAVFSGQSEFEPFRPLAMKYAGHQFGVYNPDLGDGRGLLLAEIEHQNGTWFDIHLKGAGLTPYSRMGDGRAVLRSTIREYLCSEAMAGLGIPTTRALGMVVSDTPVYREKTEFGAMLIRMAETHVRFGHFEHLFYTNQLAEQKLLADKVIEWHFADCASAEKPYAAMFGEIVQKTADMIAYWQAYGFAHGVMNTDNMSILGQTFDYGPFGFLDDYEPGYICNHSDYQGRYAFEQQPRIALWNLSALAHALSPLVEREDLEQALSQFEGRLSQQFSRLMRSKLGLKTKIAEDGRLFESMFELLNQNHTDYTRFFRALSNLDKQPAQEVIDLFIDREAAQAWLDLYLARCELEVDEIGEPISAEQRSEQMRQTNPKYILRNYLAQLAIDKAEEGDFSEVHRLAEILRHPYDSQPEFEAYAKLPPEWGKKMEISCSS

SEQ ID NO: 84337 - protein, 200 aa, Staphylococcus aureus subsp. aureus Mu50
MIGIFVIALTLWIVGSFIHIDATLTAFIALALLLLTGVLTWQDILNETGAWNTLVWFSVLVLMADQLNKLGFIPWLSKSIATSLGGLSWPIVLVILILFYFYSHYLFASSTAHISAMYAALLGVAIAAGAPPLFSALMLGFFGNLLASTTHYSSGPAPILFSSGYVTQKRWWTMNLILGFVYFIIWIGLGSLWMKVIGIF

SEQ ID NO: 84338 - protein, 333 aa, Magnetococcus sp. MC-1
MSVTIGINGFGRMGRLVLRAGWNSPGIIWGPINETSTDAHGSAHLLQFDSVHGRWQHPCTAQQGEICIEDSRIPYHSVADIDAHHWSTCDLVIEATGKHHKQPHTLQRYFEQGVKKVLVAAPTEGALNLVYGVNDHLYQPQQHHLVTAASCTTNCLAPVIKVLHEKIGIVHGTMTTIHDITNTQTIVDKGHKDLRRARACGNSLIPTSTGSAKAITKIFPELTGKLNGVAVRVPLLNASLTDCVFEMAKPVTESAINTLFKEASESYLHGILGYEERPLVSVDFLNDPRSAIIDAPSTMVIDGTQLKVLAWYDNEWGYVNRLMDLALKIANTL

SEQ ID NO: 84339 - protein, 81 aa, Arabidopsis thaliana
MVGGGAPQRGSAAATASMRKRKPAGGSSSAGGGAGTMLQFYTDDAPGLKISPNVVLIMSIGFIAFVAVLHVMGKLYFVKSK

SEQ ID NO: 84340 - protein, 821 aa, Gibberella zeae PH-1
MNCNELQEHARADCFLVKKPRALQWFYKGELQKEKEEERQAGRFELFLDLLYVAIVANFSDELAEHPDGAHLAKYILIFAPAWHIWADLREIMNSYYTDDILQRLVILWVMALLVLYANNANDADVDIAAMRTTVGAYLVARFTTLTVFLVTSFAAYQHRAQARIMAGFMFVGLIITIPLFLEDISIRAKAAIVAVGIFYQEATWALTLSPWIKGKLNLTYSTAVDIAHEIDRMGAFFIIILGEFVYSIIVGNKTGIGLTSGYAKAVCTLIIAFVLNWIYSSGDGSVQAVHPIRRSAWTAFGFFLLHLPLAASFLIGGHVAAASTAIEEFEDGQRWLVGGGLGVGMFCLWVYGMLYRVEGECTLLMGQTLRIGMRLVIAIVLIIIPESHNHLNAEDFMLVVMGLFAFLLIWETLGGGCAICNDSFCTNGVTYASLSRGATRVLIAPPAPDPKVVTSAGGVNLLILTPTYYIINYQLLIPRPTTNISHNTIVAFHKQIPSSSHTLINPTSMADFAPPAGPPPPKAPDVPAGWAVRWNDQYKEWFYVNVYTKQSQWEKPTAPVFPSDDGAPAGPPPGYEPGNTPVVTDTKKNPYEDVTANAGGSSQDEDAKLAARLQAEEDARARSGHGGPDVPAGYGGSNNPFPQSNSPYPQQQQGGSNYPSELPPRDRGAKSGGFLGKLIGKGKQMADKRQQQQGQGGYGGGYPQQQYYPQQSQGGYPGQGPPMGYGAQPHYGGGGYGAPGGYGGYGGGPGYGQPGGGFGGGGMGGGRKPGGGGMGMAGGAALGAGAGLLGGAMLMNSFDNDEQEAYQDGFEDGADFDGGD

SEQ ID NO: 84341 - protein, 154 aa, Helicosporidium sp. ex Simulium jonesii
NGKTPMVRLRKLPLGCTANIVAELESMEPCKSVKDRTALNMVRRAEEHGLITPGQTILVELTSGNTGVGLAFVGAARGYRVMLTMPDTMSLERRILLKAFGVELQLTRNSGGMSDAIVRAERIVERVPGSYMLQQFDNMANPEVHYQTTGPEIW

SEQ ID NO: 84342 - protein, 318 aa, Haloferax lucentense
MTAELVTFGETMIRLSPPAGERIETARSLEFRTAGAESNVAVAASRLGCSAAWLSKLPDSPLGRRVTTELRTHGVEPYVRWDDDARQGAYYIEQGRAPRPTNVIYDRADAAVTTARPDELAVDIVEDAAAFYTSGITPALSETLRETTGELLQTATEAGTTTAFDLNYRSKLWSPSDARDACESLFPKVDVLVAAERDIRTVLELDGDAPTLASELAGDFDFETVVVTRGEDGALARHGGTVYEQPVFETDTVDAIGTGDAFVGAFLSRLIADEPVETALAYGAATAALKRTVHGDLAVVTPDEVERVLRGGDAGIDR

SEQ ID NO: 84343 - protein, 286 aa, Rubrobacter xylanophilus DSM 9941
MLDRLLAEGVEASLGERLVSARPLGGGCIGEVWRLELSDGSPVVAKVDREGSSHLEREAYMLRYLRERSRLPVPEVLHSSQSLLLMEFVEGESRFSPAAERHAAELLAELHGVGAGAYGHERDTLIGSLPQPNPWTESWAEFFGEHRLLYLARVAREAGRLPEEDSRRVERLAGRLEEFVGEPQPPGLIHGDVWSANVLAKGGRITAFLDPAIYHADPEVELAFVSLFDSFGEPFFERYAEIRGIREGFFEVRRDLYNLYPLLVHVYFFGGGYLAAARRLLDRFGV

SEQ ID NO: 84344 - protein, 161 aa, Helicosporidium sp. ex Simulium jonesii
ANPEVHYQTTGPEIWRDTEGRVDIFVAGVGTGGTITGTGRYLKEQNPDVQVVAVEPLESPVISGGEPAPHMIQGIGAGFIPKNLDMSIVDSVLTVGSAEAMVAARRLASEEGLLVGVSSGAALVAVDRLARRPENEGKLIVTVLPSMGERYLSSALFQDLR

SEQ ID NO: 84345 - protein, 483 aa, Colwellia psychrerythraea 34H
MPRRTKIVATLGPATDDREILKNVLAAGVNVVRLNFSHGIPQDHIDRADNVRAIAKELGVYVGILGDLQGPKIRVSTFKNGPIKLAIGDKFELDATLEKGEGCQEKVGIDYKKLVQDVNTGDILLLDDGRVQLKVLSTSDNSVFTEVTVGGPLSNNKGINRQGGGLTAPALTAKDKEDIKLAAKINVDFLAVSFPRDAADMREARLLAQEAGCDARLVSKIERAEAVNDDKILDGIILASDVVMVARGDLGVEIGDAALVGKQKHIITRSRQLNRVVITATQMMETMIEQPMPTRAEVMDVANAVLDGTDAVMLSAETAAGKYPVETVTAMANVCVGAEQHRSVNISNHRMELTFSEVSETIALSAMYAANHLEGVKAIISLTESGQTSKLMSRITSGLPIFSLSRHPKTLNKTAIYRGVYPIEFDSTHVNNDNLSDEMLKVVSGKIELAVGDKLILTHGDMMETVGASNTLKILTISKRHLK

SEQ ID NO: 84346 - protein, 338 aa, Streptococcus agalactiae NEM316
MTKQKIAVLGPGSWGTALAQVLNDNGHEVRLWGNVVEQIEEINTSHTNQRYFKDITLDSKIKAYTNLEEAINNVDSILFVVPTKVTRLVAKQVANLLKHKVVIMHASKGLEPGTHERLSTILEEEISEQYRSDIVVVSGPSHAEEAIVRDITLITAASKDIGAAKYVQKLFSNHYFRLYTNTDVVGVETAGALKNIIAVGAGALHGLGYGDNAKAAIITRGLAEITRLGVQLGADPLTFSGLSGVGDLIVTGTSVHSRNWRAGDALGRGEKLEDIEKNMGMVIEGISTTKVAYEIAQNLNVYMPITEAIYKSIYEGANIKDSILDMMSNEFRSENEWH

SEQ ID NO: 84347 - protein, 723 aa, Oryza sativa
MEAAAMAKSLLLSSLLAVVAAEVVGTGLNPQYCPPSSCGHLGNISYPFRLEGDSRQCVATPRPWYNLSCNNGRAAIQINKGTYYVTSINYTGEEFWVVDATLQDDDTNGSSCPLPRSDHLPYTKNYWRLYSGKTSTDSYGAIDLYTVSRNWACFVNCFRAITDIMPRYRPVTCLLPNNSFVFVSFDDCAVGEFQPSCRYLAMIPFDGWHISDSQLQNASYTDIIGFIRKGVSVSFPIGPYQSNDISVTECLKVLFRLLLGSLVIFIFLAHKYWKTRITIDAVEKFLRMQQMIGPMRFAYTDIIAITSHFRDKLGQGGYGSVYKGVLLPGNLHIAVKMLTGSSSCNGDEFISEVSTIGRIHHVNVVRLVGFCTEEMRRALIYEYMPRGSLDKYIFSPEKSFSWDKLNEIALGIARGINYLHQGCEMQILHFDIKPHNILLDDNFVPKVADFGLAKLYPRDKSFVPVSAARGTVGYIAPEMISRSFGVISSKSDVYSFGMLLLEMAGGRRNADPNAANSLQAYYPSRVYRELTRRETSEISDIADMHELEKKLCIVGLWCIQMRSCDRPTMSEVIEMLEGGSDELQVPPRPFFCDDEQFPGVESYNMPSDLTAISEEHEDDDDESICLFESYHQTNARTAQEGATATFRVDCVGWNGTAHSNSTETDSDLGPVFHQIRLAHELVILTTHRAQQMHGHAKAHQQNEVSVAIELQFSNFIVECISGG

SEQ ID NO: 84348 - protein, 280 aa, Agrobacterium tumefaciens str. C58
MLVTELNIYPLKSARGIALKESAVSAEGLPGDRRAMLTDPSGHFITQRELPAIATVLARHEDGGMALSRERSGEIFARPSGQRMDVAVWKSIVSANIADDETNDTLSAWLGREVKLVFFDDAAKRIASLEWTGNETPVTFADGYQILVTTTASLAALNDNMRGNGEDAVGMERFRPNIVLETEEAWAEDRWAAIEIGGIRFDLVKPCARCIMTTQDQMTGSRDVPSPMKAMGRIRMSGDRRVPGPLFGWNVTPRGEGRLSVGDVARVVEERPEGWAIKRR

SEQ ID NO: 84349 - protein, 412 aa, Zea mays
  misc_feature (179)..(179): Xaa can be any naturally occurring amino acid
  misc_feature (226)..(226): Xaa can be any naturally occurring amino acid
  misc_feature (234)..(234): Xaa can be any naturally occurring amino acid
MSEAEAAGSLSRRRMEDEEGAAAMEADAAHSGRGEAEDEEVESSDYTSEDEGTEDYRRGGYHAVRVGDSFKQGAYVVQYKLGWGHFSTVWLAWDTVHSRYVALKVQKSAQHYTEAAMDEVKILKQIADGDPDDSKCVVKLLDHFKHSGPNGNHVCMVFEFLGDNLLTLIKYTDYRGIPXLPMVKEICRHVLIGLDYLHRTLSIIHTDLKPENILLVSTIDPTKDPXRKSGVPPXFRPSMRTDEPPPKVPAQSGNGGLTKNQKKKIRKKAKRAAAATSEGTSAVASADTDGSDDQGDMGTTNEGSPRQDGTKKRATRDRRGSKGAKKMMAMKADLKCKLVDFGNACWTYKQFTNDIQTRQYRCPEVILGSKYSTSADMWSFACICFELTTGDVLFDPHSGDNFDRDELTLLVW

SEQ ID NO: 84350 - protein, 518 aa, Listeria innocua Clip11262
MFKIMKDFTEQEKIIVLDFGSQYNQLITRRIREFGVYSELHPHTITVEEMKALNPTGIIFSGGPNSVYDEDAFRADERIFDMGIPILGICYGMQLMTTHFGGKVERAKDREYGKADIHVENPSRLFAGLPTDQVVWMSHGDLVVEEPAGFEVTATSKSCPIAGIADEDRLLYGVQFHPEVRHSAYGNELLKNFALNICGCKGDWTMENFSEVEIAKIQEIVGDKKVLLALSGGVDSSVVGVLIHKAIGDQLTCIFVDHGLLRKGEADQVMATLQGEFNMNIIKVDAKKRFMDKLAGVSDPEQKRKIIGNEFIYVFDDEANKLDGVEFLAQGTLYTDIIESGTATAQTIKSHHNVGGLPEDMQFKLIEPLNTLFKDEVRALGTELGMPDAIVWRQPFPGPGLGIRVLGEITEEKLEIVRDSDYILREEIKNAGLEREIWQYFTALPNIRSVGVMGDGRTYDHTVVVRAVTSIDGMTADWARIPWDVLEKISVRIVNEVDHVNRVVYDITSKPPATVEWE

SEQ ID NO: 84351 - protein, 206 aa, Brassica napus
ENIKANGKASPSVLPEYEDCVPMVDKVVDVAWQSQEMITNVSKGPEYTSGLERIETVNHIWRWLTMFFMNILALFASLTLPQTIRHSQLIPSSARDELCDEPNARESRPPSPSRPSTIDERVIMSSVVSRLGDLENQIETLHLRKSEMPHEKEELLNPAVYRVDALEAELINTKKALHEALMKQEELLGYIDRQEEAKYKRKKFCW

SEQ ID NO: 84352 - protein, 714 aa, uncultured marine bacterium 443
MSFHYEKDSNNIVTVTMDMDGPVNSMSDAFLPALEATLGNLEADADLAGVVLASGKSTFFAGGDLNMLCAVTEETVEAFFEGMCATKAAMRRLEMLHAPVCAAINGAALGGGLELALSCHHRIAWNDRSVQLGFPEVTLGLLPGGGGNVKAVYLMGLMAANEYIVEGKRVAPEKALASGLIDAVIEDKDELLSAAKQWLLANKDDESARTQPWDTKGYKIPGGNIRNPQVAQMVTMGAPMIRKNTRGLLPAPEKIFDVAVQALTVDFETAMRIESRGLAELALTPQAKNMINTFFFQMNKVNGGASRPKEVPPQKTEKVGILGAGMMGQGIAYSSAMVGIEVVLKDISLDAAIKGKTYTQALLQKRVDKGRMTDEKMAQVLSLIHPTASDEDLDGCDLIIEAVFENMTLKHQMTRDLEPRLAEGGVWGSNTSTLPITQLAQASQNAEKFIGIHFFSPVDKMPLVEIIMGEQTGDLALAKAFDFTKQIKKTPIVVNDSLGFFTSRTFGTYLDEGVRLLVEGMKPLRIDNLGKAVGMPVGPLTVYDEVSLELSRKASQTWKEMGLSVGDDDRSITAGVVETMVGDYGRGGRYHGGGFYEYGADGSKEVWSGLAELYGATASPLSDADAKDRLLFRQVIEALKCLETGVLRTVADGNIGSIMGIGAPAWTGGLLQFVNTYGLQNFIERCASLSAAYGERFQAPAIVAEKLVKGETFV

SEQ ID NO: 84353 - protein, 337 aa, Synechocystis sp. PCC 6803
MTRVAINGFGRIGRNFLRCWLGRTDSQLEVVGINDTSDPRTNAHLLRYDSMLGKLDADISADENSITVNGKTIKCVSDRNPLNLPWAEWNVDLVIEATGVFVTHEGATKHVQAGAKKVLITAPGKGPNIGTYVVGVNAHEYKHEEYEVISNASCTTNCLAPIAKVINDNFGIIKGTMTTTHSYTGDQRILDASHRDLRRARAAAVNIVPTSTGAAKAVALVIPELQGKLNGIALRVPTPNVSVVDLVVQVEKNTIAEQVNGVLKEAANTSLKGVLEYTDLELVSSDFRGTDCSSTVDGSLTMVMGGDMVKVIAWYDNEWGYSQRVVDLAEIVAKNWK

SEQ ID NO: 84354 - protein, 525 aa, Oryza sativa Indica Group
MESLLAAGAGGIGVAAAAVGGFIAAATLAVAPPKNRRNPPPEKKPHQTFTKWAEIYGPIYTIRTGASSVVVLNSTEVAKEAMVAKFSSISTRKLSKALTVLSHDKSMVATSDSGDFHKMGKRYIMLSMLGTSAQKQFRDTRDMIINNMLSTFHQLVKDDPHAPLIFRDVFKDELFRLSMIQSLGEDVSSVYVDEFGRDISKEEIYNATVTDMMMCAIEVDWRDFFPYLSWVPNKSFETRVFTTESRRTAVMRALIKQQKERIVRGEARTCYLDFLLAENTLTDEQLMMLVWEALIEAADTTLVTTEWAMYELAKNPDKQARNIVTLFQLIFGILGFINQYFFFWSFSWHSWHLCQERLYQEIREVCGDETVTEEHLPWLPYLNAVFQETLRRHSPVPLIPPRFVNEDTKLAGYDVPAGTEMVINLYGCNMNKKEWESPEEWAPERFAGGRFKVADMYKTMAFGAGRRVCAGSLQATHIACAAIARFVQEFGWRLREGDEEKVDTVQLTAYKLHPLHVHLTPRGRM

SEQ ID NO: 84355 - protein, 106 aa, Glycine max
  misc_feature (10)..(10): Xaa can be any naturally occurring amino acid
  misc_feature (66)..(66): Xaa can be any naturally occurring amino acid
  misc_feature (81)..(81): Xaa can be any naturally occurring amino acid
ISSPTITRCXHSQAGMRTPFTVLKYMASFPTIKTNNDITSITTNGGRVQPMHVMTPLLMNKFKTTXYLPNLDDAQLAKEVXYLLKKVCIPCLEFELDHRFLFLEPN

SEQ ID NO: 84356 - protein, 519 aa, Oryza sativa Indica Group
MVEVGRLLYLLGRWLPLDQFDFAAVPGLPIIGNLHQLKEKKPHQTFAKWAEIYGPIYTIRTGASSVVVLNSTEVAKEAMVAKFSSISTRKLSKALTVLTRDKSMVATSDYCDFHKMVKRYVMSSMLGTSAQKQFRDIRDMMIHNMLSTFHKLVKDDPHAPLIFRDVFKDELFRLSMIQSLGEDVSSVYVDEFGRDISKEEIYNATVTDMMMCAIEVDWRDFFPYLSWVPNKSFETRVFTTETRRTAVMRALIKQQKERIVRGEAKTCYLDFLLAENTLTDEQLMMLVWEALIEAADTTLVTTEWAMYELAKNPDKQARNIVTLFQLIVGILGIINQSFLFLAFFLLSCQERLYQEIREVCGDETVTEEHLPRLPYLNAVFHETLRRHSPVPLIPPRFVHEDTKLAGYDVPAGTEMVINLYGCNMNRKEWESPEEWVPERFAGGRLEVADMYKTMAFGAGRRACAGSLQATHIACAAVARFVQEFGWRLREGDEEKVDTVQLTAYKLHPLHVHLTRRGRM

SEQ ID NO: 84357 - protein, 286 aa, Mycobacterium smegmatis str. MC2 155
MSRIAIIGGGSMGEALLSGLLRAGRQVKDMVVAEKFPERAKYLADKYSVRVTSVADAAENAHYVVVAVKPADVEKVIGEIAEAAANAETDTAEQVFVTIAAGVGTAYYEAKLPAGSPVIRVMPNAPVIVGGGVSALAPGRFATPEQLKEVSTLFDAVGGVITVSESQLDAVTALSGSGPAYFFLMAEAMVDAGVAVGLSRAVATDLVAQTMAGSAAMLLDRLDQVNAAGGAALDTTPAQLRATVTSPAGTTAAGLRELERGGLRAAVANAVEAAKTRSEQLGITSE

SEQ ID NO: 84358 - protein, 105 aa, Prochlorococcus marinus str. AS9601
MLSIKLEQSGSNNSAVIEKKPAELKNKSPKYKVLLHNDPVNSMEYVTISLREVVPQLSEQDAIAIMLEAHNTGIGLVIVCDLEPAEFYSESLKSKGISSSIEKED

SEQ ID NO: 84359 - protein, 408 aa, Prochlorococcus marinus str. AS9601
MVQVNENYLKLKAGYLFPEIAKRVKLYSQSNKNAEIIKLGIGDVTEPLPRACIEAMGKALDDMGTTDGFRGYGPEQGYAWLREKISEHDFISRGCQISPEEIFVSDGSKCDSSNILDILGKDNSIAVTDPVYPVYVDSNVMTGRTGDALENGTYQGLTYLAINEANNFLPELPEKKVDILYLCFPNNPTGATINKEELKKWVDYALQNKSLILFDAAYEAFIQDNDIPHSIYEIEGAKDCAIEFRSFSKNAGFTGVRCAFTVIPKNLKGLSSTNEEIELWPLWNRRQSTKFNGVSYVVQKGAEAVYSLEGKKQVRGLIDFYMENAKIMKNKLQNSGYKVYGGDNAPYIWIKVPDQMTSWDFFDFLLQKVSVVGTPGSGFGLAGEGYFRLSAFNSRSNVIDAMERIINI

SEQ ID NO: 84360 - protein, 586 aa, Xanthobacter autotrophicus Py2
MGSDFTIDQKRYLEGFVSGAKAVQITRGAAPAGAPAAAAEPTGPDAASLKAMARFEAEGKKLSPEEKGKREELGLDAYPRMRTAAHEGVFPKGPDVLRWKYHGLFHVAPAQDSFMCRLRIPNGILTHWQFRGVADIASAHGGNYTDVTTRANLQIREIPATDGIAVLEKLVDLGLTAKGSGADNIRNVTGTPTAGIDPQELLDTRPLAKEWHHYILNNRDMYGLPRKFNVAFDGAGTIGALEDTNDIGFQAVEVKDGFGVAPGIWLRLALGGITGHKDFARDTGIVVRPDEASDVAAAIVRAFIDTGDRTDRKKARLKYVLDAMGFDGFLTLVEKKLGRPFTRLPAEAVAPRAEADRLAHLGVHAQKQPGLNYIGVGLPVGRMSVEQMHGLADIAARLGDGDIRLTVWQNLLISGVADADVAQACTAITALGLSTQATPLQAGLVACTGSKGCRFAAADTKGTARAILAHCEERLDLDGPVNIHVTGCHNSCAQHYIGDIGLIGARVAINDDGDTVDGYHLFVGGGFGADAAIARELYRDVKAEDAPAVVERLLKSWLAHREEGEAFAHFTRRMDPDALKALAEVA

SEQ ID NO: 84361 - protein, 458 aa, uncultured marine bacterium 443
MDETLYTPPKPNSLPAVIALIRSLWKGDGNLLELLPAEAYHFDIGHLGRSRRGTVLFNKPSAVKEIMRDQQGVFPKSDLMVGALDPLIGESMFVTDGPKWRRQRAMIDPAFSLMRLNVAYGAMCAATDDHVAMISRLADTQSPFSLDLAMSHLTADVICRTVFSTPLASDIAEEVFDDFTLFEKSVAQVDILGMILKPAWSETKQVPEVLEACQRIRHHIGGLIDTHLDSHDGEFNDIASAVIEAKDKDTGLPFTREELIDQLGVFFLAGHETTASALTWVFYILAERPEWMVRLREELDPVMVDGALSFDDTKKLPLTRAFFKEVLRLYPPITFVPRVALENVEIEGKRLPRGALVMIAPWTLHRHSKYWENPHAFIPERFLPENEKSLTAGAYIPFGQGPHLCVGAGFAQVESLLIMSELITKFDFEMMPNQQVVPAARLTTRPAEQVMMRVRHRN

SEQ ID NO: 84362 - protein, 183 aa, Candidatus Blochmannia floridanus
MISHTDHQLTLIKENIKFIPNYPKQGILFRDITALLENPHAYSACIKLLADHYKNHQLTKIVGVEARGFLFGSPLALILKLGFIPARKAGRLPRNTISESYVLEYGTGCLEMHNDSIIPGDRVLIVDDLLATGGTIKAVVKLIRRLGGEVYHAAFVIDLEKLGGKLLLEKIGVHPYSLVIFSD

SEQ ID NO: 84363 - protein, 281 aa, Prochlorococcus marinus str. AS9601
MPKQVAYLGPQGTYAEKAAHILSKLANFHSPIFVPCNGLHSVIKSIAYNNCDAAVVPIENSVEGGVTATLDALWKFPEIFINKAIVLPIKHALISDGELSSISEVLSHPQALAQCSEWLSENLPNAIPLPTNSTSEAVNMVKGSKFRAAIGSKSIIQIEGLKELAFPINDVPGNCTRFVLLSKESNSNLANIASFAFSLISNKPGALLKAINYIADFGFNMSKIESRPSKRELGEYIIYIDVEINNQKNIKSFLELKNKIKPLCKNFVDFGNYFSENVELD

SEQ ID NO: 84364 - protein, 541 aa, Candidatus Blochmannia floridanus
MNYKVFARKWRPKKFCEVVGQLHVVKAIIHSLNLNRMHHAYIFTGTRGSGKTTIARLFAKGLNCETQITSDVCGSCKNCSDIESGCFIDLIEIDAASKSKVEDTRSFLDNVQYSPSQGKFKVYLIDEVHMLSRHSFNALLKTLEEPPKHVKFILVTTEYQKLPETILSRCLQFYFKPLNIIQIVTQLKYICNQENINIDTENSLEFLAYAARGSIRDALNLLEQAMILGKNNITIDVINSMLGLLHIEHALSLIESLTNGNINKIMNQIDNYSILGINWDYLFEEILIVLQKIAIYQFSPHSLKNQISIVEIKDIEKRMHKLSDFISPENVQLYYQIFLLGRRELSYAPSHRIGMEMTMLRALAFCPVNLDSKSEQYYNSENTSNKEEVCKNFSKKNVTQLININKYTDSISDKKQQIQNNFNNVTHTEKIKNIQDLTNVSGSKLEKLQLSLTNQAVINNKIISSNSKIRPQYPISHVTSEILDARNKLIKYQRDYKQSMLTKTKSNINTQDEQGLEDILRRFTNIDVKISKDGDIHNKKK

SEQ ID NO: 84365 - protein, 808 aa, Mycobacterium smegmatis str. MC2 155
MTVGIVVVSHSRPLARAAVGLAQEMLHGKAVRISIAAGLDDTTLGTDASAILEAITSADSGDGVLVLMDLGSAVLSAELALELLDDDVRARTVLCPAPLVEGLVVAAVAAAGDAALDEVAAEAAGALAGKAAHLEPATPPAPADDTAEPDELTGSFVVNNPHGLHARPAARFVAEVRRRDARVRIRNPRVDSPWVDGGSLSRIATLAVRCGDEVELRVSGGQAHETLQHLLSLAARNFDEDHTEAPPAAPATAHTPIGAGPGMGVGPAYSARSQTPDVPDAPAADPAAEWRRLGTAIADTRRTIGALRAATSRDIGEAEASIFDAHQLLLDDDALLGAARARIEQGENAAAAWSQAVAALAAEFDALPDPYLQARAEDVRAVGDQVLRAMLGTEGDAAAASGVLVAGDLTPAEAAELDPQRVVAVLLAFGSPHAHNVILLRAKGIPVIVGAGPGVLGIPDGTVVAVDATRGEFIVDPPADVREQFRHEAETLTRRRQAALQRAGEPAVTRGGRTVAVGANIAGVEDARAAAALGADHAGLIRTEFLFLGRRQAPDVDEQLAVYRKIAESLGDRRMTLRTLDVGGDKPLEFLPAAAELNPYLGVRGIRLSLAHPDVFSDQLLAMAKLAQDIPLSVMFPMVTTLDELFAARRLLDDAVRRAGPRPPTGLQVGMMVEVPAAALKSAAFSRHVDFLSIGTNDLSQYALAADRNNDAVAGLGDTFDPGLLHLIAATCRGAAGAASVSVCGEFAADARAVPLLIGLGVDALSVTPPAIPTTKEAVRAVDDRHATETAEAALAAAGPAAVRDLLG

SEQ ID NO: 84366 - protein, 213 aa, Hyacinthus orientalis
QLHGESLPAPAAPPQISHLRPAFDFPSSPAGSISIPHPSVPPPPPLPRPGPVAIGAQILRSEGPAALFCGISATVLRQTLYSTTRMGLYDILKTRWSSDGGHLPLHRKIAAGLVAGGIGAAVGNPADVAMVRMQADGRLPPAERRNYRSVVDAIGRMAKGEGVGSLWRGSSLTVNRAMIVTASQLATYDQAKEGIIGSGAMVDGLGTHVTASF

SEQ ID NO: 84367 - protein, 195 aa, Coprinopsis cinerea okayama7#130
MPAIVQRPAPTFKAEAVTEGLFNEVSLQDYQGKCEILAFNDALPQFQELNTVVLGVSTDSKFSHFAWATQPRKEGGLGPDLKLPLIADRNMKISRDYGVLLEDEGIALRGLFIIDPKGILRQITVNDLPVGRSVDETIRLIKAFQFTEKYGEVCPANWTEGSKTIKTDPVAKLEYFGAANGEVNGEGPKKRPRTE

SEQ ID NO: 84368 - protein, 613 aa, Bacillus pumilus SAFR-032
MEHTSVSSLVVVIIVAFFTPLLLHRFKLTIPVVVAEIIMGLIIGKSGLQLVVEHDAWLDTLSMLGFIFLMFLSGLEIDFSSFESKKKARELPNGLKEPNAFKAATIVFLGVFSISFILSYAFVLAGFIQNAFLMTLIISTISLGVVVPTLKEEKLMQTNIGQIILLVAVIADLVTMILLAVFSSIYGDGTGNMWLLLLLFAAGILLYLFGRVFKTKSIFQSMSKGTVQIGTRAIFTLIIVLVALSESLGAENILGAFLAGVLVSLLSPNKELVQQLDSFGYGFLIPIFFVMVGVDLNIWALFKDPTIMIMIPLLFIALLISKLIPILYLKKWYDMKKVIGSGFLLTSTLSLVIAAATIGERLGVIDHKMSGALILVAVLTSILTPVWFKALFKKEQAASHKKRVTFIGANQLTLPVTLDLHQDEYDIRILHVFQENKEALLADSIFEVESIEEYNDETLRKAGVGQEDVLVVATGSETKNKEIALFAKEEGAKQVIASVNKAEAELELKEAGIDTFSNFLSSKTVLRALIEAPDAIRLLTNEDTSLYQIQMNNHRYHNVMLREFPFTGDLVFVRIFRGIDSLVPHGDTTLRSGDRVLVSGSREYVAGLRAQLE

SEQ ID NO: 84369 - protein, 309 aa, Oryza sativa Japonica Group
MVKNAIQYAVVDAFAAEPFKGNPAAVCLLEGEDAAAAADERWMQSVAAEFNLSETAFLIRDPSSSAAAADAAPRFRLRWFTPVAEVNLCGHATLASAHFLFTTVLAKQQHAAAAMVEFVTRSGILTAKKVPAPPPPANDGGVPGEEKLFIELDFPMIDLVEYDSAETLSIPETLNGARVVSVWKSSTAGDLIVELSSGKEVADIIPNINEIKKCDGRGVIVTGPAPAGSDYDFFSRFFCPKFGIDEDPVCGSAHCVLAPYWGGKLGKQKLTAFQASPRSGTLYLELDGENRRVRIQGEAVTVMAGTLLA

SEQ ID NO: 84370 - protein, 303 aa, Zea mays
  misc_feature (114)..(114): Xaa can be any naturally occurring amino acid
NLLTHSLSHSQRQPRKGGNPSQLIPNPKPPIHPSPPHPLRAAMACSFAAATVVSSAPTPAARPLAAAPQSVSVSRSAVATAARPLRLVASRSARAIRLVARAGGVDDLPLVGNXKAPDFEAEAVFDQEFINVKLSDYIGKKYVVLFFYPLDFTFVCPTEITAFSDRYEEFEKLNTEVLGVSIDSVFSHLAWVQTDRKSGGLGDLKYPLISDVTKSISKAFGVLIPDQGIALRGLFIIDKEGVIQHSTINNLAIGRSVDETMRTLQALQYVQENPDEVCPAGWKPGERSMKPDPKGSKEYFAAV

SEQ ID NO: 84371 - protein, 337 aa, Triticum aestivum
MAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSTK

SEQ ID NO: 84372 - protein, 216 aa, Triticum aestivum
MSQDKAAGEKAAAEPKRQTPRLNERILSSLSRRSVAAHPWHDLEIGPGAPAVFNVVVEITKGSKVKYELDKKTGMIKVDRILYSSVVYPHNYGFVPRTLCEDNDPIDVLVLMQEPVLPGTFLRARAIGLMPMIDQGEKDDKIIAVCADDPEYHNLNHLSELSPHRLQEIRRFFEDYKKNENKEVAVNDFLQADDARAAIQHSMDLYAEYIMHSLRQ

SEQ ID NO: 84373 - protein, 200 aa, Vibrio parahaemolyticus RIMD 2210633
MSPIMDALVPMVVEQTSRGERSYDIYSRLLKERVIFLTGQVEDHMANLVVAQLLFLESENPDKDIFLYINSPGGSVTAGMSIYDTMQFIKPNVSTVCMGQACSMGAFLLAGGAAGKRYVLPNSRVMIHQPLGGFQGQASDIQIHAQEILTIKQKLNNLLAEHTGQPLEVIERDTDRDNFMSAEQAVEYGIVDAVLSHRGA

SEQ ID NO: 84374 - protein, 311 aa, Rhodospirillum rubrum
NGFGRIGRLAFRRIQDVEGIEVVAVNDLTDDEMLAHLLKYDTMQGRFTGEVEVVDGGFRVNGKEVKSYEEPDASKLPWGDLDIDVVLECTGFYTDKEKAEAHINAGAKKVLISAPAKGDVKTIVFNTNHNDLDGSETVVSGASCTTNSLAPVAKVLSDEFGLVEGLMTTIHAYTGDQMTQDGPHRKGDKRRARAAAQNIVPNSTGAAKAIGKVIPEIDGKLDGGAQRVPVATGSLTEVTVVLEKDVTVEDVNKAMKNASNESFGYTEDEIVSSDVVGMTYGSLFDATQTRVMSVGDRQLVKVAAWYDNEWG

SEQ ID NO: 84375 - protein, 181 aa, Brassica napus
STTRPLSSAAVATSPAQATMVAPFTGLKSSAAFPVTRKSNTDITSITSNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 84376 - protein, 304 aa, Vitis vinifera
MVLLVSGVSGAVDAGKKKVLLLKGKEREISHHLLQQNVTSPVKNILGANAPKQNQRREGSGRIIRSILLNKDARQSQSSMFQTEQQSQASNLEKEKRPPRPPHIQLASKETNGAQDDKVVGNDVHSFVSEKQDKRTRNKDRPDRGVWTPLRRSDGSHASDESLSSSASQPTSSDFPEGSHGEMRSDMSNARSGEVKALGSGRGGHSALDNGSHKHSGRRGPTHSVKDADGSSIVSEGKHSKRGSAPGYGSHEEFSALELHEQFTNFHSIKKPKAITSNHLFTQLVNTWSAKSNWIEQITVVFTR

SEQ ID NO: 84377 - protein, 318 aa, Heliobacterium chlorum
NGFGRIGRQSFKAMLEYYPEEFEIVAINDLTDAQTLAHLLRYDSTYGAFDGEVTVTEKAIVVEQDDIRYELLTLAERDPAALPWKELGVDIVIESTGRFTDAEKAKAHLAAGAKKVIITAPAKGEDITICLGVNDAKYDHEKHHIISNASCTTNCLAPVAKVLNDRFGIERGLMTTIHSYTMDQNLQDNVHKDLRRARAAAINMVPTTTGAAKAVALVIPELKGKFHGYAVRVPTPTVSMVDFSVLLSTKTSVEEINQAFIEASESEELEGILGVSHDPLVSTDFIGTTYSSVVDLPLTMSMGDDFFKIVAWYDNEWG

SEQ ID NO: 84378 - protein, 289 aa, Zea mays
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRALFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWNDHWIFWVGPFIGAALAAIYHQVIIRAIPFKSRS

SEQ ID NO: 84379 - protein, 547 aa, Oryza sativa
SDFTSPPFHKLGRLINGEHNALLLAIPLDGIGSFPPHPPPDPQEQEAAAPPPPPAEPAVPPRHRGHLHLFKKPLHRALSGLAATHGPVLLLHFGSRAVLHVTDPAVAEECLTDHDVTFANRPRLPSSCHLSNGYTTLGSSSYGPNWRNLRRIATVEVFSAHRLLRSADVRGGEVPHMARWLYLAAPAAGPSEPARADVKARAFELVLNVVARMVAGKQYYGGEGDAEAETEEAARFREMVREYFAMHGASNLQDFVLLLGLVDIGGAKRRAVKLSRERNTWAQRLIDEHRATATAAAATEARTMVGDLLKMQASEPEAYSDKVITALCLSILQTGTDTSSSTIEWGMALLLNHPAAMAKARAEIDRFVGTGRVVEEADLPNLPYLQCIIRENLRLYPVGPLLAPHESSADCSVSVAGGGRYAVPAGTMLLVNVHAMHRDARFWGPDPESFSPERFEGGRSEGKWMLPFGMGRRRCPGEGLAVKVVGLALATLVQCFEWRRVGDEEVDMTEGSGLTMPKAVPLEALYWPRPEMVPALSGIFFIYNFFY

SEQ ID NO: 84380 - protein, 312 aa, Blastochloris viridis
NGFGRIGRLAFRRIQDVEGLEVVAVNDLTDDDMLAHLLKYDTMQGRFTGEVEVIEGGFRVNVKEIKSFDDQMLGKLPWGDLDIDVVLECTGFYTDKEKAQAHIDAGAKKVLISAPAKGDVKTIVFNTNHDALDGSETVVSGASCTTNSLAPVAKVLSDEFGLVEGFMTTIHAYTGDQNTQDAPHRKGDKRRARAAAENIIPNSTGAAKAIGKVIPEIDGKLDGGAQRVPVATGSLTELTVVLDKQDVTVDQVNSAMKQASDESFGYTEDEIVSSDIVGMTYGSLFDATQTRVMTVGDRQLVKVAAWYDKEWG

SEQ ID NO: 84381 - protein, 140 aa, Helicosporidium sp. ex Simulium jonesii
MAALMATVATRPMPLAPVAIRARSALTSQLRYLSAPVRHQKVRASYKITFKMPENEEETIEAPEDQYILDAADDAGLDLPYSCRSGTCSTCLGRVVEGSVDQSDQSFLDDDQMGKGYSLLCVAYPTSDLVIETHKEEELY

SEQ ID NO: 84382 - protein, 197 aa, Triticum aestivum
  misc_feature (173)..(173): Xaa can be any naturally occurring amino acid
MEQYEVVEQIGRGAYGTAYLVHHKAEKKRYVMKKIRLTKQNDKFQRTAYQEMSLMASLSNPYIVEYKDGWVDEGTSVCIVTSYCEGGDMAQRIKKARGVLFSEERVCRWFTQLLLALDYLHCNRVLHRDLKCSNILLTKDNNIRLADFGLAKLLMEDLASSVVGTPNYMCPEXILADIPYGYKSDIWSLGELHYHFC

SEQ ID NO: 84383 - protein, 314 aa, Stanieria cyanosphaera PCC 7437
NGFGRIGRLVFRAGLNNPNIEFVGINDLVPPGNIAYLLKYDSTHGRFAGTVESQSDGIVVNGKFIPCVSIRNPEELPWSKYGVEYVVESTGLFTTHETASKHLTAVQKRVVISAPTKDPERVKTLLVGVNHQTFDPSKDTIVSNASCTTNCLAPIAKVINDNFGLAEGLMTTVHAMTATQPTVDGPSKKDFRGGRGAAQNIIPASTGAAKAVTLVLPELKGKLTGMAFRVPTPDVSAVDLTFRTEKATSYQEICAAMKQAAEGEMKGILGYTEEPVVSTDFTSDPHSSIFDAGAGIELNSNFFKVVAWYDNEWG

SEQ ID NO: 84384 - protein, 313 aa, Fischerella muscicola UTEX 1829
NGFGRIGRLVFRAGITNPNIEFVGINDLVPPDNLAYLLKYDSTHGIYKGKVEAKDNGIIVDGHFVPCVSMRNPAELPWGKLGADYVVESTGLFTNYEGAANHLQAGAKRVVISAPTKDPDRVKTLLMGVNHQLFDPAKDTVVSNASCTTNCLAPIAKVINDNFGLTEGLMTTVHAMTATQPTVDGPSKKDWRGGRGAAQNISLSTGAAKAVALVLPELKGKLTGMAFRVPTPDVSVVDLTFKTAKATSYQEICAAMKAAATGELKGILGYTDEEVVSTDFQGDTHSSIFESGAGIELNSNFFKVVAWYDNEWG

SEQ ID NO: 84385 - protein, 506 aa, Oryza sativa Indica Group
MEAFVSGGAGGVGAAAVVGVFVAAAVVGGFVAAVALAERAGVIAPRKRPNAPPGQPGLNISLSSLKLKAMVAKFSSISTRKLSKALTVLTRDKSMVATSDYGDFHKMVKRYVMSSTLGTSAQKKFRDTRDMMINNMLSTFHKLVKDDPHVPLIFRDVFKDELFRLSMIQSLGEDVSSVYVDEFGRDISKEEIYNATVTDMMMCAIEVDWRDFFSYLSWVPNKSFETRVFTAEARRTAVMRALIKQQKERIVRGEAKICYLDFLLAENTLTDEQLTMLVWEELIEAADTTLVATEWAMYELAKNPDKQARNICYSVPAHSWHYQPKRFLLGVFLVMPGTALPRNPEVCGDETVTEEHLPRLPYLNAVFHETLRRHSPVPLIPPRFVHEDTKLAGYDVPAGTEMVINLYGCNMNKKEWESPEEWVPERFTGGRLEVADMYKTMAFGAGRRACAGSLQVMHIACTAIARFVQEFGWRLTEGDEEKVDTVQFTAYKLHPLHVHLTPRGRM

SEQ ID NO: 84386 - protein, 261 aa, Pasteurella multocida subsp. multocida str. Pm70
MARRPLVMGNWKLNGSKAFTKALIEDLKTELAGVEGCDVAIAPPVMYLAEAEAALKCSCSCGGKAIALGAQNVDVNVQGAFTGDISTEMLKDFGAKYIIIGHSERRTYHKESDEFIAKKFAALKQAGLVPVLCIGESEAENEAGKTEEVCARQIDAVLNTLGAEAFNGAVIAYEPIWAIGTGKSATPAQAQAVHAFIRGHIAKKDNAVAEQVIIQYGGSVNDANAAELFTQPDIDGALVGGASLKAPAFAVIVKAAAKAKN

SEQ ID NO: 84387 - protein, 337 aa, Gibberella zeae PH-1
MAGSITLRGLLLAAFASKAIASCAYGTLLHPRAEDGSVEVNTFGYTGKIGPTNWVALDPAANAVCSTGVNQSPIDMVPGANAMIPASQLNLEIPDMTEGTEFENLGTTVEVIAGKGSMRFGNTSFTLQQFHFHLPSEHLDAGKSMAMEMHMVWESEDAKIAVVGVFIDVEDGAGGSTPGNSTGAAAKVKRDGFVKMVRKSTTDGHDHDHANEKRQLPAVGGSFFHVNAPATAATSSSNLLETVFGSVGEIAKPGTLTKTKSLNMAELVSTLAAGSFQTYEGSLTTPPCSEGVRWLVSDQKLAIKTSTFNSVRDVIGFNSRFPQGALGEPNALSGMMA

SEQ ID NO: 84388 - protein, 148 aa, Brassica napus
MASTALSSAIVGTSFIRRQTAPISLRSLPLANTQSLFGLKSGTARGGRVIAMATYKVKFITPEGEQEVECDDDVYVLDAAEEAGIDLPYSCRAGSCSSCAGKVVSGSVDQSDQSFLDDDQIAEGFVLTCAAYPTSDVTIETHREDDIV

SEQ ID NO: 84389 - protein, 323 aa, Triticum aestivum
MAAKRELVVSFGEMLIDFVPTVAGVSLAEAPAFVKAPGGAPANVAIAVARLGGGAAFVGKLGDDEFGRMLAKILRENGVDAGGVVFDSGARTALAFVTLRADGEREFMFYRNPSADMLLTADELKVDVIKRAAVFHYGSISLIAEPCRTAHLHAMKVAKEAGALLSYDPNLREALWPSLEEARTKILSIWDQADIVKVSEVELEFLTGINSVEDDVAMKLWRPTFKLMLVTLGDQGCKYYTKDFRGTVPSYKVQQVDTTGAGDAFIGSLLRKIVQDPSALQDKTKLEGAIKFANACGAITATKKGAIPSLPKEDEVLRLMEKA

SEQ ID NO: 84390 - protein, 330 aa, Coprinopsis cinerea okayama7#130
MVFNTTLTPSLYDAMYPATDFSSLSWLEQQWVSWYVTIGNPVLATGLMSFLLHEVVYFGRSIPWIIIDAMPYFRKWKLQPNKIPTPKEQWECTKQVLFSHFTIELPLIWLFHPTAEALGMQTHQVPFPSLKTMAPQVFLFFVFEDFFHFVAHQALHYGPLYKHIHKIHHKYSAPFGLAAEYAHPAEVFILGAGTILGPLIYCFFTQNLHIITVYLWIVLRLFQAIDAHSGYDFPWSLHNILPFWSGAEHHDFHHMAFVNNYSTSFRWWDRIFGTDDKYREYRAKVKAAKKAMKNASADDVKKLEQKLMDEVKAEGLRAEAEVENYKLKMN

SEQ ID NO: 84391 - protein, 594 aa, Oryza sativa Japonica Group
MGTYKCCIFFTRRFALSDASTPGDVRMLFTRHAGGAPYMGIDELRRYLAASGEAHVDADTAERIIDRVLQERSRTPRFGKPSLTIDDFQYFLFSEDLNPPICHSKEVHHDMNAPLSHYFIYTGHNSYLTGNQLSSDCSDIPIIKALQIGVRVIELDMWPNSSKDDVDILHGRTLTAPVSLIKCLKSIKEYAFVASPYPVIITLEDHLTSDLQAKVAKMVLEVFGDTLYYPESKHLQEFPSPEALRGRVILSTKPPKEYLESKGGTMKDRDIEPQFSKGQNEEAVWGTEVPDIQDEMQTADKQHENDILYTQRDVEEDDEKKMCQHHPLEYKHLITIKAGKPKGAVVDALKGDPDKVRRLSLSEQELAKVAAHHGRNIVSFTHKNLLRIYPKGTRFNSSNYNPFLGWVHGAQMVAFNMQGYGRSLWLMHGFYKANGGCGYVKKPDFMMQTCPDGNVFDPKADLPVKKTLKVKVYMGEGWQSDFKQTYFDTYSPPDFYAKVGIAGVPSDSVMQKTKAVEDSWVPVWEEEFVFPLTVPEIALLRVEVHEYDVSEDDFGGQTALPVSELRPGIRTVPLFDHKGLKFKSVKLLMRFEFV

SEQ ID NO: 84392 - protein, 181 aa, Hyacinthus orientalis
MGLAFGKIFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLQSLRQRHWYIQSTCATSGEGLYEGLDWLSSNISNKS

SEQ ID NO: 84393 - protein, 486 aa, Leuconostoc mesenteroides
MVSEIKTLVTFFGGTGDLAKRKLYPSVFNLYKKGYLQKHFAIVGTARQALNDDEFKQLVRDSIKDFTDDQAQAEAFIEHFSYRAHDVTDAASYAVLKEAIEEAADKFDIDGNRIFYMSVAPRFFGTIAKYLKSEGLLADTGYNRLMIEKPFGTSYDTAAELQNDLENAFDDNQLFRIDHYLGKEMVQNIAALRFGNPIFDAAWNKDYIKNVQVTLSEVLGVEERAGYYDTAGALLDMIQNHTMQIVGWLAMEKPESFTDKDIRAAKNAAFNALKIYDEAEVNKYFVRAQYGAGDSADFKPYLEELDVPADSKNNTFIAGELQFDLPRWEGVPFYVRSGKRLAAKQTRVDIVFKAGTFNFGSEQEAQEAVLSIIIDPKGAIELKLNAKSVEDAFNTRTIDLGWTVSDEDKKNTPEPYERMIHDTMNGDGSNFADWNGVSIAWKFVDAISAVYTADKAPLETYKSGSMGPEASDKLLAANGDAWVFKG

SEQ ID NO: 84394 - protein, 248 aa, Clostridium thermocellum ATCC 27405
MFKQFIEDAKSIAERDPAATSVLEVIFLYSGFHAVCLHRIAHWFYKRNMRFIARFISQLNRFLTGVEIHPGAKIGKGLFIDHGMGVVIGETAEVGDNCTIYHNVTLGGTGKDKGKRHPTIGNNVLISTGAKVLGPFKVGDNSRIGANAVVLNEVEPNTTVVGVPGRAVKRGNQKIVPSIELDQIHIPDPVAQELCRIKQRLESLEKELMEMRRASQGSNVQEPVPQEKSCEEECKLEMGKEIADNETL

SEQ ID NO: 84395 - protein, 569 aa, Clarkia lewisii
MATPALISETEAWKDLKAHLEGIKRTHLRELMGDTERCQSMMVEFDNIFLDYSRQQASPDTINKLYKLAEAAHLKQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVAAVAKHMVAVSTNLPLVEKFGIDPNNAFAFWDWVGGRYSVCSAVGVLPLSLQYGFAVVEKFLQGAHNIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEELKKENVSEHLIPHKTFTGNRPCLSILLPTLDAYRIGQLLAIYEHRVAVQGFVWGINSFDQWGVELGKSLATQVRKQLHASRVKGEPVEEGFNFSTKTLLTRYLQATTDVPADPSTLLPNI

SEQ ID NO: 84396 - protein, 361 aa, Bacteroides fragilis NCTC 9343
MKKKFTIFVVLLAGIIYTGHAQGVQWIYQQKQEKKNMKNLSEIYFAGGCFWGTDHFLKQIRGVKSTQVGYANGNIANPTYQQVCTGKTNFAETVKVEYNPQEVPLKLLIDLFFKTIDPTSLNRQGNDKGSQYRTGIYYTDKVDLPTIRTAIDELAKEYSKPIVIEVKPLSNFYKAEEYHQDYLDKNPGGYCHINPALFELAKKANAQAEQPQTNYKKPDDATLRSKLTPEQYAVTQKNATEPAFHNEYWDEKRDGIYVDITTGEPLFISTDKFDSGCGWPSFTKPIEKEVIKEKMDTSHGMIRTEVRSKTGDAHLGHVFTDGPKEKGGLRYCINSASLRFIPKEKMKEEGYGEYLKLLPQK

SEQ ID NO: 84397 - protein, 314 aa, Lyngbya aestuarii PCC 7419
NGFGRIGRLVMRSAIKNPEIEFVAINDLVPAENLAYLFKYDSTHGKLESQVEAKDDHIIVDGHSIRCTSVRNPDQLPWKEMGVDYVVESTGLFTTYDGASNHLSAGAKRVIISAPTKDPDKVKTLLMGVNHEEFNPQDHLIVSNASCTTNCLAPVAKVIQDNFGLAEGLMTTVHSMTATQPTVDGPSKKDFRGGRGAAQDIIPASTGAAKAVTLVLPELKGKLTGMAFRVPTPDVSVVDLTFKTEKSTSYKEICAAMKAASEGPMKGVLGYTEDPVVSTDFITDSHSSIFDADAGMELNSNFFKVVSWYDNEWG

SEQ ID NO: 84398 - protein, 795 aa, Bordetella bronchiseptica RB50
MRSRPARAGAGSIFPACAAASFTFAAPTYVIAIMDANFRKAALEYHEHGRPGKISVTPTKQLSNQRDLALAYSPGVAAACEEIVDDPVNVFRYTGRGNLVGVITNGTAVLGLGNIGALASKPVMEGKAVLFKKFAGLDVFDIEINETDPDKLVEIIAGLEATFGGINLEDIKAPECFTVERKLRERMKIPVFHDDQHGTAITVCAAFINGLEVVGKDIAQVKVVTSGAGAAALACLDLMVDLGLPLEHIWVTDIEGAVYQGRTALMDPDKARYAQPTEARTLAEVIEGADVFLGLSAGNVLKPEMVAAMAANPLILALANPNPEILPEAAHAVRDDIVMATGRSDYPNQVNNVLCFPYIFRGALDVGATTITREMEKAAVLAIASLAREEQNEVVAAAYGTYDISFGRDYLIPKPFDPRLIVRIAPAVAKAAMESGVATRPLADLDAYAEQLQQFVYHSGAFMKPLFSQAKQIVRDGGRARIVFTEGEDERVLRAIQVIVDEGLARPILVGRPAVLSARIEKFGLRLRLGQDVEVCNPDYDERFHQYWTTYWELMCRRGITKEMARVEMRRRLTLIGAMMVRLGDADGLICGTVGAYADHLRFIDEVIGRKPGAQTYAAMNILLLNERTVALVDTHVNDDPSAEQIAEYTVAAAEEMRRLNLAPKVALLSRSNFGTGSSASGAKMRRALELVRERAPELEIDGEMHGDCALDEALRLRILPSSTLKGEANLLVCPNVDSGNIAYNLLKTTAGGNVAVGPFLLGANAAVHILTSSSTVRRIVNMAAMAVVNADAVR

SEQ ID NO: 84399 - protein, 486 aa, Oryza sativa Japonica Group
MYAYVGLVGGAAALVLLLLLRHQARRWRNPRCGGQLPPGSMGLPLVGETFQFFSSDASLDIPPFIRHRLARYGPIFKTSLVGHPVVVSADEELNHMVFQQEGQLFQSWYPDSFVEILGKDNVGEQQGAMFRYLKNMVLRYFGPESLKEGIIRDVERAVSSSLCTWSTLPAVELKEAVSTMVFDLAASKLLGLEPSRSKILRKSFFDFVRGLISFPLYLPGTAYYSCMQGRRRAMVVLEQVLEERKQSTGLQRGGEAQQHGDFLDYVIQEITKEKPVMTEKMALDLMFVLLFASFHTTSLALTLAVKLLADHPLVLEELTVEHETILKDREAGSELDRITWKEYKSMAFTSQVINETVRLANIAPVIFRKALKDIRFNGYTIPAGWGVMVCPPAVHLNPYIYPDPLTFIPSRFKDKPEINRGSKHFMAFGGGLRFCVGADFSKLQLAIFLHFLVTKYRWIPLGASRVVRTPGLEFPDGYRIKVIQRH

SEQ ID NO: 84400 - protein, 210 aa, Magnetospirillum magnetotacticum MS-1
  misc_feature (192)..(193): Xaa can be any naturally occurring amino acid
MEPQLRALYRAAKDHVPAGLPPMGKDAPLSIMMPMITSVPEVIRLREVCERIRRAVGPPEVPLGIMIEVPAAAVQADAFARHCDFFSIGTNDLTQYTLAIDRQNTDLAPEADSLHPAVLRLIRLTCEGAARHGRFVGVCGGIAGDPFGACLLAGLGVDELSMTPRDLPGVKARLRHAALADLKALAAKGPGXXQEDAAAVRALDDAPAGA

SEQ ID NO: 84401 - protein, 314 aa, Anabaena sp. CA
NGFGRIGSNFARCWLGRENSNIDLVAVNDTSDPRTNAHLLKYDSMLGKLKDVDITADDNSIIVNGKTIKCVSDRNPENLPWKEWEIDLIIEATGVFTSKEGALKHVNAGAKKVLITAPGKNEDGTFVIGVNHHEYDHNVHHIISNASCTTNCLAPIAKVLHEKFGIIKGTMTTTHSYTGDQRLLDASHRDVRRVRAAAINIVPTSTGAAKAVALVIPELKGKLNGVALRVPTPNVSMVDFVIQVEKRTITEEVNQALKDAAEGPLKGILDYSELPFVSSDYQGSDASSIVDANLTLVMDNDLVKVMAWYDNEWG

SEQ ID NO: 84402 - protein, 326 aa, Zea mays
  misc_feature (177)..(177): Xaa can be any naturally occurring amino acid
  misc_feature (193)..(193): Xaa can be any naturally occurring amino acid
LGPSRPAGRSYHAGRAAAANHIVTSPHASPRLGFATQPKQIAWRLTHRLQLQWPPQPRATASLTTRSPAAGKRFVLSSPCLSFSSHRLTIAGLRHRHHTAAASRTARRRAASASPMVATIAVGDKLPDATLSYFDPADGELRMVTVAELTAGKKASLFAVPGAFTPTCSQKHLPGFXEKAGELKAKGVDTVAXVSVNDAFVMKAWKELLGLADGSGVLLLSDGNLELTRALGVEMDLSDKPIGLGVRSRRYALLAEDGVVKVLNLEEDDAFTTSSAEEMLRLACSDAVAAERAITCGFCGLHAVAVAQVGDAKRLACSDPGACDVG

SEQ ID NO: 84403 - protein, 315 aa, Stanieria cyanosphaera PCC 7437
NGFGRIGRNFVRCWLGRENSQLELVGINDTPDPRTNAHLLRYDSMLGVLKGVDIEADANSIIVNGKTIKCVSDRNPLNLPWKDWGVDLIIEATGVFVDEAGASKHLEAGAKKVLITAPGKGGGIGTYVIGVNHKDYEHGKDSIVSNASCTTNCLAPVVKVLHENFGIIKGTMTTTHSYTGDQRILDASHRDLRRARAAAINIVPTSTGAAKAVALVLPALKGKLNGIALRVPTPNVSVVDFVAQVEKKTITEEVNEALKRAAEGELKGILGYNDLPLVSCDYRGTDESSIVDASLTLVMDGDMVKVVAWYDNEWG

SEQ ID NO: 84404 - protein, 242 aa, Physcomitrella patens subsp. patens
MMARAESVAVQALRNVMQRVSQASERANRPASQVRLVAVSKTKPVELVQEVYDAGHRHFGENYVQELIDKAPQLPQDIKWHFIGHLQSNKAKALITSVPNLYMVEGVDSQKVANHLNRAVSGLGRPPLSVLVQVNTSREESKSGVNPSECVDLAKHLKEECPNLRFSGLMTIGMLGYSSTAEFFKTLVNCREKVCKELEIPVEECELSMGMSGDFELAIEMGSTNVRVGSTIFGARSYPGRQ

SEQ ID NO: 84405 - protein, 314 aa, Fischerella muscicola UTEX 1829
NGFGRIGSNFMRCWLGRENSNIDLVAINDTSDPRTNAHLLKYDSMLGKLKNADITADDNSIIANGKTVKCVSDRNPENLPWKEWEIDLIIEATGVFTAKEGAMKHVNAGAKKVLITAPGKNEDGTFVIGVNHHDYDHDKHHIVSNASCTTNCLAPIAKVLHEKFGIIKGTMTTTHSYTGDQRLLDASHRDVRRARAAAINIVPTSTGAAKAVALVLPDLKGKLNGVALRVPTPNVSMVDFVIQVEKPTIAEEVNAALKSASENELKGILDYSELQLVSSDYQGTDASSIIDASLTLVMGGDMVKVMAWYDNEWG

SEQ ID NO: 84406 - protein, 159 aa, Magnetococcus sp. MC-1
MLPCLFMLAVFFHQEFTMTIERTFSIIKPDAVAKNVVGEIQSRFEKAGLRIIASKMIRLTPEIAGKFYEVHKARPFYNDLCSYMSSGPVVVQVLEGDGAVLKNRDIMGATNPKDAAPGTIRADFAESIDANAVHGSDAPETAAQEIAFFFSGTELCDRP

SEQ ID NO: 84407 - protein, 397 aa, Bordetella bronchiseptica RB50
MSNVNTLSALAKSGALSGKRVFIRADLNVPFDDAGRISEDTRIRASVPGIRLALDAGAAVMVTSHLGRPKEGALTEADSLAPVAQRLSELLGMQVRLVPDWVDGVSVEPGEVVLLENCRGNVGEKKDDEGLSRKMAALCDVYVNDAFGTAHRAEATTHGIARFAPVACAGPLLEAELEALGRALHDPKRSLVAIVGGSKVSTKLSILQSLADKVDQLVVGGGIANTFMLAAGLPIGKSLAEPEQVEQARAVIEIMKRRGAEVPIPTDVVCAKSFGADAAATVKAAADVAEDDMILDIGPQTAQRLADILKAAGTIVWNGPVGVFEFDQFAHGTEVVARAIADSAGFSIAGGGDTLAAIAKYGIADQTGYISTGGGAFLEFLEGKALPAVAVLQARAA

SEQ ID NO: 84408 - protein, 315 aa, Lyngbya aestuarii PCC 7419
NGFGRIGRNFVRCLLTRENSNLDLVAINDTSDPKTNAHLLKYDSMLGTLKDVDIQADENSLTVNGKTIKCVSDRNPLNLPWADWGVDLIIESTGVFVTEEGASKHLEADAKKVLITAPGKGGKIGTFVMGVNDNTYKHEDYNIVSNASCTTNCLAPFTKVLHEHFGIIKGTMTTTHSYTGDQRILDASHRDLRRARAAAINIVPTSTGAAKAVALVIPEMKDKLTGIAMRVPTPNVSVVDLVVQVEKNTFTEEVNRVLQEAAEGPMKGILEYSDLPLVSSDYRGRDASSIVDASLTMVMGGDMVKVIAWYDNEWG

SEQ ID NO: 84409 - protein, 127 aa, Streptococcus agalactiae NEM316
MTDTMILNDNHKIPTLGLGTWMINNDRVAQVVKDAIELGYRHINTAQAYNNEKGVGVGIKESGITRESLFVTTKIAAEHKNYESATKSIDQSLEALGLDCIDLMIIHSPQPWKEWRETDKHFDQGNL

SEQ ID NO: 84410 - protein, 491 aa, Alkaliphilus metalliredigens QYMF
MTKTKEIIKTGWNLDSTYAHLPKQFFTIITPNPVSAPKLVILNEPLATVLGLDSEALQSKDSLEVLAGNRALEGALPLAQAYAGHQFGHFALLGDGRALLLGEQITPSGERFDLQLKGSGPTPYSRGGDGRASLGPMLREYIISEAMHALGIATTRSLAVVTTGEAVIRETDLPGAILTRVAASHLRVGTFEYIAKWGTVQELRALADYTLQRHFPEVGAVENPYLSLVQEVIKGQAALIAKWQLVGFIHGVMNTDNMTISGETIDYGPCAFMDSYDPKTVFSSIDRQGRYAYGNQPHIAGWNLARFAETLLPLLHEDQDEAVKLAQDEISRFIQLYHSHWLTGMRAKLGIFNEEVQDESLIEELLKMMEKNHADYTNTFRALSFETLEGTALFGTTEFAQWHELWRARLNRQQESKDASQQLMQNSNPGVIPRNHRVEAALDAAVKQGDYSVMEQLLNVLSKPYAHSPEQAEYCMPPAPSNRPYRTFCGT

SEQ ID NO: 84411 - protein, 669 aa, Oryza sativa Japonica Group
MLPPPAAAAAALLLLLALSAGANDIASDAAALQAFIAPFGSATVSWNTSQPTCSWTGVVCSGGRVVEVHLPGVGLRGNVPVGALGGLDKLAVLSLRYNALSGPLPSDLAKCAELRVINLQSNHFSGELPPEILALPALTQLNLAENRFSGRIPASIAKNGRLQLLYLDGNLLTGELPNVNMPLLTSFNVSFNNLTGGIPSGLSGMPATSFLGMSLCGKPLAACRTPISIPPSQAPALSPEGAVSAVGRGRGGRRLAGGAIAGIVIGCALGFLLVAGVLVLACGALQRKPRPHHSRDVAAELALHSKEAMSPSVYTPRVSDARPPPPPAAVVPAIQPAVAANVAGKKKLFFFGRVPRPYDLEDLLRASAEVLGKGTYGTTYKAALETGPVVAVKRLKETSLPEREFRDKVAAIGGLDHPNVVPLQAYYFSKDEKLMVYEFVAMGSLSSMLHGNRGSGRSPLLWESRRRIALASARGLEYIHATGSKVVHGNIKSSNVLLSRSSVDARVADHGLAHLVGPAGAPSSRVAGYRAPEVVADPWRLSQKADVYSFGVLLLELLTGKAPTHAVLHDDEGVDLPRWARSVVREEWTSEVFDTELLRHPGAEDEMVEMLRLAMDCTVTVPDQRPAMPEIVVRIEQLGGAGSARTARSVSMDDADDRPLRPAGSTRES

SEQ ID NO: 84412 - protein, 443 aa, Streptococcus pneumoniae
MTKRVLANLLGKKLPNPASINEEVIVIAHDLTPSDTAQLDKNFVKAFVTNIGGRTSHSAIMARTLEIAAVLGTNNITEIVKDGDILAVNGITGEVIINPTDEQAAEFKAAGEAYAKQKAEWALLKDAQTVTADGKHFELAANIGTPKDVEGVNNNGAEAVGLYRTEFLYMDSQDFPTEDEQYEAYKAVLEGMNGKPVVVRTMDIGGDKELPYFDMPHEMNPFLGFRALRISISETGDAMFRTQIRALLRASVHGQLRIMFPMVALLKEFRAAKAVFDEEKANLLAEGVAVADNIQVGIMIEIPAAAMLADQFAKEVDFFSIGTNDLIQYTMAADRMNEQVSYLYQPYNPSILRLINNVIKAAHAEGKWAGMCGEMAGDQQAVPLLVGMGLDEFSMSATSVLRTRSLMKKLDTAKMEEYANRALTECSTMEEVLELQKEYVNFD

SEQ ID NO: 84413 - protein, 540 aa, Oryza sativa Japonica Group
MQQRRKSVFASAPFAMKQAALGAGVAARRNGAPLSLAAVVFALFVFATFLYNEDIKSIADFPFGAGALRAKSPDLHVLQETVGAAHLAAGSIAKRGEEVIVRVLDAPASTAMAAAAGSSSNNSTIEVDEGQERERDVTLPSVKEGGADEARRREDEEAAEKESSAKAAAATAALRTVVSVPDTCDLYRGNWVYDEVNAPVYKESQCEFLTEQVTCMRNGRRDDSYQKWRWQPTDCDLPRFDARLLLERLRNKRLMFVGDSLNRNQWESMVCLVQSVIPKGKKTLTKFVNGGNSNIFYAHEYNATVEFYWAPFLVESNSDNPQVHSVPDRVIQWHSIAKHAHNWLGVDYLIFNTYIWWLNTLDMKVLKGSFDQGATEYVEVDRPVAYKEVLKTWAKWVDRNIDPNRTTVFFMSMSPNHITPEAWGNYGGIKCAMETLPITNRTTSLDVGTDWRLYAGAQEVLQTFRRVPVHLVDITALSELRKDAHTSVHTLRQGKLLTPEQQSDPKTYADCIHWCLPGLPDTWNQFLYARIASAPWSSDQ

SEQ ID NO: 84414 - protein, 460 aa, Arabidopsis thaliana
MSNILQNRRSSFSSSTKSSLAKRQAPSSSENSVKLMPAMTKKRAPLSNITNQKIASRLQNSDSVHCSNKSAKLKIAPSVCVNASFSSNLQQSIVPHKVASSPSKSDDGSVSMDETRSSSDSYKSPQVEYIENDDVSAVVSIERKALSNLFITPNSETIDNYCSRDVLSDMKKMDKNQIVNIDSNNGDPQLCATFACDIYKHLRASEAKKRPDVDYMERVQKDVNSSMRGILVDWLIEVSEEYRLVPETLYLTVNYIDRYLSGNVISRQKLQLLGVACMMIAAKYEEICAPQVEEFCYITDNTYLKDEVLDMESDVLNYLKFEMTAPTTKCFLRRFVRAAHGVHEAPLMQLECMANYIAELSLLEYTMLSHSPSLVAASAIFLAKYILDPTRRPWNSTLQHYTQYKAMELRGCVKDLQRLCSTAHGSTLPAVREKYSQHKYKFVAKKFCPSVIPQEFFNNS

SEQ ID NO: 84415 - protein, 506 aa, Saccharomyces cerevisiae YJM789
MPESRLQRLANLKIGTPQQLRRTSIIGTIGPKTNSCEAITALRKAGLNIIRLNFSHGSYEFHQSVIENAVKSEQQFPGRPLAIALDTKGPEIRTGRTLNDQDLYIPVDHQMIFTTDASFANTSNDKIMYIDYANLTKVIVPGRFIYVDDGILSFKVLQIIDESNLRVQAVNSGYIASHKGVNLPNTDVDLPPLSAKDMKDLQFGVRNGIHIVFASFIRTSEDVLSIRKALGSEGQDIKIISKIENQQGLDNFDEILEVTDGVMIARGDLGIEILAPEVLAIQKKLIAKCNLAGKPVICATQMLDSMTHNPRPTRAEVSDVGNAVLDGADCVMLSGETAKGDYPVNAVNIMAATALIAESTIAHLALYDDLRDATPKPTSTTETVAAAATAAILEQDGKAIVVLSTTGNTARLLSKYRPSCPIILVTRHARTARIAHLYRGVFPFLYEPKRLDDWGEDVHRRLKFGVEMARSFGMVDNGDTVVSIQGFKGGIGHSNTLRISTVGQEF

SEQ ID NO: 84416 - protein, 245 aa, Ligularia fischeri
RYRIRERTDALDAAGNTTAAIGKGFAIGSAALVSLALFGAFASRAEITTVNVLTPKVFIGLLVGAMLPYWFSAMTMKSVGTAALAMVEEVRRQFNTIPGLMEGTAKPDYATCVKISTDASIKEMIPPGCLVMLTPLIVGILFGVETLSGVLAGSLISGVQIAISASNTGGAWDNAKKYIEAGVSDHAKSLGPKGSDAHKAAVIGDTVGDPLKDTSGPSLNILIKLMAVESLVFAPFFAALGHHVN

SEQ ID NO: 84417 - protein, 501 aa, Candida albicans
MDQQEAPIYYGRSVNKVYNQEFIIDSRFKIVKELGHGAYGIVCSAKYDNGSKKVPDSNNGNASSSANASFVAIKKITNIFSKNILCKRALRELKLLQFFRGHKNITCLYDLDIIPNPMTGEFNEIYLYEELMECDMHQIIRSGQPLSDQHYQSFIYQVLCGLNFIHSADVLHRDLKPGNLLVNADCELKICDFGLARGFSENPDENAGFMTEYVATRWYRAPEIMLSFTNYTKAIDIWSVGCILAELLGGKPLFRGKDYVDQLNQILMILGTPPESTLQRIGSHRAQNYVRSLPITRKASYEELFPDANPLALDLLERMLTLDPRERITVRDALNHKYLELWHDPKEEIECQVKFDFKSFETVDGLDEMKQLIMDEVQKFREFVRKPIEEQQRIQMQLHMQKREEQRQEEEEKELLEQQRQFPAQESMDISQTPYNNLETNIGTPQVEDDYPRPQELDEFTFSNLESSSSMNLFQDMAKPSGEEYIKLEEELGFGLDWCYV

SEQ ID NO: 84418 - protein, 313 aa, Pseudanabaena sp. PCC 6903
NGFGRIGRNFLRCWAGRTDTNIELVGLNDTSDPRTNAHLLKYDSMLGKFAGDVSADDTTITVNGKTIKTVSDRNPDNLPWKDWVIDLVIESTGVFIDKEGASRHINAGAKKVLITAPGKNEDGTYVVGVNEDQYNHDIHNIISNASCTTNCLAPVAKVLLENFGIVKGVMTTTHSYTGDQRLLDASHGDLRRARAAALSIVPTSTGAAKAVALVLPELAGKLNGIALRVPTPNVSVVDFVVEVEKKAIAQEVNEAFRAAAEGPMKGILEYNELPLVSIDYRGTDASSIVDSSLTMVMGGNMVKVVAWYDNEWG

SEQ ID NO: 84419 - protein, 526 aa, Deinococcus radiodurans R1
MSTLLDGLLPFQHEPYFDFADPAVAEAQTAAYAQARQKYAGQTFPLLVGGQQVKGDGTLTVTNPATGEQLWHFQNATAAQLDEAVRAANEAFQSWRFSDPLQRASIFLRAAQLLRSRRMELNAVMSLENGKNWAEADGEIAECVDHCEVFARETLKWAQGKPVYPMPDEHVTTVYEPLGAVAVISPWNYPSAIPLGMALGALAAGNTVIWKPASETPLSSWLLIRLLFEAGLPRDCVQFLTGSDDVLGDPLVDHKDVRMVAFTGSREIGCRIYERAAKVQPGQKFLKRVIAEMGGKDPTVVCADADLDAAAAGIVASTFGYSGQKCSACSRVIAEASVYDTLLEKVKTLTEALKVGLPEHNAAVGPVIHQGSANRIRQYIENGKGTARLVCGGGEMEVADSGEASANYIQPTIFADVDAKDPLFQEEIFGPVLAFAKADDWRHAIDLANDSDYGLTAAFYSRDPHKLTEARRLMHVGNLYLNRKCTGALSGSHSFGGYGMSGTNAKVGGPDYLFWFLQTKTVAQKY

SEQ ID NO: 84420 - protein, 509 aa, Vicia faba
MLQRSRTLPSKIYQGVIEERKDGRHYIELEPLPKMETETKPITIQSKCLDDDGRVKRTGTFWTASAHIITAVIGSGVLSLSWAIAQLGWAVGPVVMVLFAVVNLYTSTLLTQCYRSDDSVAGPRNYTYTDAVKSILGGKKFKICGVIQYVNLFGVAIGYTIAASVSMMAIKRSNCYHESHGNDPCHMSSNVYMIAFGIAEVILSQIPDFDQVWWLSIVAAIMSFTYSAVGLGLGVAKVAENGTFHGRLMGISIGTVTPAGTVTGTQKVWRSLQALGAMAFAYSFSIILIEIQDTIKSPPAEHKTMKKATMLSIMVTTVFYILCGSMGYAAFGDHVPGNLLTGFGFYNPYWLLDIANFAIVVHLVGAYQVFSQPFFAFVEKWSAHKWPKNKFVTEEYDIPIPCIGVYKLNLFRLIWRTIFVLLTTLIAMLLPFFNDVVGLLGAFGFWPLTVYFPIDMYISQKKIGRWTNRWLGLQMLSGCCLIISTLAAVGSIAGVVLDLKTYKPFKTSY

SEQ ID NO: 84421 - protein, 361 aa, Deinococcus radiodurans R1
MRSGISILFMKALIPAAGLGTRLRPLTFTRPKPVLRVAGQPIIRHAIRTLTEAGITDIGIVVSDVTRDEIQHAVREIRDVKLTLINQHDQLGLGHAVLTAREWVGQDDFCVYLGDNLFEFGARPFIESFHQKHPAALIALVKVADPTAFGVAELDGEQITRLVEKPKDPPSNLAVAGLYCFTPQIFEVLDVMPPSARGEYEITDGIQGLIERGQTVVGQRVEGWWKDTGRPADLLDANRLLLEQIETDVQGDMEGSRMTGRVIVPASSKVLRSKIVGPVIIGEDVIIEDAYIGPFTSIGRGTVIRNAEIEHSSVDSGVVIENVQTRLQDCLIGVKAQVRGGRTLPKTHKLTISDASVVELA

SEQ ID NO: 84422 - protein, 372 aa, Deinococcus radiodurans R1
MPTACRGAVQMSSFVPVILAGGSGERFWPLSRRHRPKQFLTLDESGRSLLQATSDRLARLGGGQDRVVVVTGNDYRSQVLEQLPEMPIENLLVEPAARDTAAAILYAALWIAQDDPQAVMGVFPADHRVTDVEAFERVIQRAIEVAQESERLVTVGIAPTFPSTGYGYIQQGEVLQPGELPAFSVTRFTEKPDAVTAQAFLDTGRYTWNSGMFIWRVQSILAAFEQHQPQLYKQLHQVMSAGTASARRVQLQTTFPQLEKISIDYAILEKSDRVAVIPAEFGWDDLGDWNALERLLKGEGDNVAVGRHVGLDTGGAILYTTNGDDLIATIGLDDVVVVRAEDVTLVVRKDRTQDIKKVVQQLKAHPELERFA

SEQ ID NO: 84423 - protein, 312 aa, Stanieria cyanosphaera PCC 7437
NGFGRIGRLVARIMIEDPNSKLLAINTGADANYMAYQFKYDTVHGKWKGSLEVDGDDLIINGQRVKTTHFRNPNEIPWKGLGVEYLCEPTGVFLTADSAKPHVDSGVKKVIFSAPAKDKSPTIVMGVNENEYTTDMTFVSLNASCTTNCLAPMVKAIHDKFGIEDALMTTVHAMTSTQMVVDGSSKKDWRGGRGAAQNIIPSSTGAAKAVAQVILPSKGKITGMAFRVPTADVSVVDLTLRLATETTYEEICAEIQRRANTDMKGILGYTDEALVSSDFVTCPISSVFDAKAGIMLNPRFVKLVAWYDNEWG

SEQ ID NO: 84424 - protein, 968 aa, Magnetococcus sp. MC-1
MRLNHKILLLTIAILALLLSGSTALNVASFRSTYTDALLRGSFGIGHGINDILNEMLSLGLPLNSLDGMDTKLSNIVKQTPHITYAAITDLQGMVLFHSDAQLIGRHFKDEAAIKSTNTREPIWQIYNRFDGKRYYDVALPIFDQTKQHIGVIRLGFNSKEVDDRVWHEITLIVINMFITFGLIALLLNFVLVRLIIKPVEILSQQARAISEGHFETGPPTQRSDEVGQLSTALDRMSATLHQQFQDLTQYQAELELKVTRRTHELAAANHLLLERNDDLEQAITTQRRLNDQLHQNKEALRESKTLLVSILQSLSVGVFGLDLTGKIQFINPAAANMLGGVIESMLGQSGLSLWYHDGTGKNPNPIGVTLTNHQPQQGEGRFVHMRGHTLQVGYTVMPILEQGQVTGVVVTFNDITANRRTERLTRTIIQGTSKVTGEAFQRELVRNISESLEMRFVFVGRFHEDPMPRIETTSVWANGRQGAPFNYLLADTPCAEVIGKETSVYAEHVQTHFPNDPLLAELKVESYMGTPLFRSDGKPLGILVVMDVQPLTDIELARSILGIFSGRAAMELEREETELALRVAKERAEAASQAKSEFLAMMSHEIRTPMNAILGITELLQEQPSKKEQLEFLTVQAKAGQALLTLINDILELSRLEAGREQLQTAPFDLYELLRSVSTLLEPSAKHKGLSVHLEIAEGLSPNWIGDERRLRQVLINLVGNGIKFTNRGSIWISAQPMANGLEIRVKDSGAGINPRHHDKIFERFHQVDSTATRKHGGTGLGLAITKKLMDLMGGEIRMESQPDQGSCFTLALPLSEAPCALPAAEEAALPPLDVTAPLRALKILLVEDSADNALLIRSFLKSTPYHLEIVEDGQQALDRLQDSNFDLVLMDMQMPVMDGYTATSQIRLREALDELPPSIIIALTAHALKGDREKCLKAGCDDFLTKPIRKKQLLAFLAHYAVSPTL

SEQ ID NO: 84425 - protein, 407 aa, Pisum sativum
MAAATASSQLIFSKPYSPSRLCPFQLCVFDAKSVLSSSRRKHVNGSGVRCMAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVAVAVEESYSGNYIVVFDPLDGSSNLDAAVSTGSIFGIYSPNDECLPDFGDDSDDNTLGTEEQRCIVNVCQPGSNLLAAGYCMYSSSVAFVLTIGKGVFVFTLDPLYGEFVLTQENLQIPKSGEIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 84426 - protein, 401 aa, Glycine max
MATKRSVGTLKEGDLKGKRVFVRVDLNVPLDDNLNITDDTRVRAAVPTIKYLTGYGAKVILSSHLGRPKGVTPKYSLKPLVPRLSQLLGIEVTMANDSIGEEVEKLVTQLPEGGVLLLENVRFYKEEEKNDPEFAKKLASLADLYVNDAFGTAHRAHASTEGVAKYLKPSVAGFLMQKELDYLVGAVSNPKRPFAAIVGGSKVSSKIGVIESLLEKVNVLLLGGGMIFTFYKAQGYSVGSSLVEEDKLSLATTLLEKAKAKGVSLLLPTDVVIADKFAADANSKTVPASSIPDGWMGLDIGPDSIKTFGEALDTTQTIIWNGPMGVFEFDKFATGTEAIAKKLAELSGKGVTTIIGGGDSVAAVEKVGLADKMSHISTGGGASLELLEGKQLPGVLALDDA

SEQ ID NO: 84427 - protein, 409 aa, Arabidopsis thaliana
MTKISDLPRDLAEEVLSRVPVTYLRAIRFTCKKWNTLTKRRSFTKKLIGQEKAEAKVKEFHAIMTLNSRLHLMSVNLDGIHKDENVESSIKQKGKLISLTVADPDRIVISQVYHCDGLLLCITNEINSRLVVWNPYSGQTRWIEPRTSYREWDIYALGYESKNNAKRSYKILRYLDAYEDMGDMSVEPRTRVCEFEIYSLDTNSWKVIEVTTDWDLCFLHRGVTLKGNTYWFAREKIPPPPRERVIEDIPLGEAEINVEIPSFLLCFDFTIEKFGSRLPLPFRPCVDDTITLSSVREEKLAVLYQRWDITWTGIWISNKIEPNAVSWSKLFFPMGRIRPLEAASGTFFVDEENKLVVLFDKGESILNPTRNTAYIVGEDGYIKPVDLGESVHKYCFPLACSYVPSSVQI

SEQ ID NO: 84428 - protein, 1394 aa, Arabidopsis thaliana
MADLLPPLTAAQVDAKTKVDEKVDYSNLPSPVPYEELHREALSSVYPKSLFRSMSLKSDNFEGLRFDFTRALNQKFSLSHSVMMGPTEVPAQSPETTIKIPTAHYEFGANYYDPKLLLIGRVMTDGRLNARLKADLTDKLVVKANALITNEEHMSQAMFNFDYMGSDYRAQLQLGQSALIGATYIQSVTNHLSLGGEIFWAGVPRKSGIGYAARYETDKMVASGQVASTGAVVMNYVQKISDKVSLATDFMYNYFSRDVTASVGYDYMLRQARVRGKIDSNGVASALLEERLSMGLNFLLSAEFKWWLCSGFHLENNTNLLLRRLIRFLKRPITDSSEETDVEGDFVMDSAIEISSGSDSDDEVPPQPVWPQTRTRMDPTWLSRRPLPTVDSHARAEHTNQAPPNGASSDTSRPGVSKPFTGNGNTVNSRISSGSGADYVRLSSEQALKRTLPPSFNSPPLPARSGTNNISNASGSRVGVDYERPLSQQALKRTLPPSFNPPPLPSRSGTNNIRNAGGSRFGADYSHPAVSAVGNKSTFGDHYSGAHAEIGIQRGVNGVRILPPSLTHGTSASVLHHAGSSDPMHRFGGGEDRNPDNDERLVYQAALQVLNQPMTESDLPPGTLSVPLMRHQKIALAWMFQKETSSFNCPGGILADDQGLGKTVSTIALILKQKIVSQLKSESSCKQETEALVLDADDESDNAKHESGSHVKPELKVSSNSETSVLSACGNDENDSSDMEKAEDEEANSSTRAFQWKRPAAGTLIVCPASVVRQWARELDEKVSEESKLSVLVYHGSNRTKDPNELAEYDVVVTTYAIVTNEAPNKFLVDEDENDEKNTDRYGLASGFSNNKKRKVVVGASKKSKRRGRKSTNDTSSEPDCGPLGKVGWFRIVLDEAQTIKNYRTQMARSCCTLRAKRRWCLSGTPIQNTIDDLYSYFRFLRYDPYAVYKSFYSTIKVPISRNSCQGYKKLQAVLRAIMLRRTKGTLLDGKPIINLPPKVVNLSQVDFSVAERSFYKKLEADSRSQFKAYADAGTLSQNYANILLLLLRLRQACDHPQLVKRYNSDPVGKVSEAAVRRLPREARSRLINRLESSSAICYECNEPPEKPVVTLCGHIFCYECVLEYITGDENTCPVPRCKQQLARDVVFSESSLRNCTSDDSGCSSSHDNGLDRSVFQKRDFCSSKIKAVLDILQSLSQPDSPNSAQHGQMPSSSRPYDDDDVTIVEPMRLHSSSPSQGAVKTIIFSQWTGMLDLVELRILESGIEFRRLDGTMSLAARDRAVKEFSKKPDVKVMLMSLKAGNLGLNMVAACHVILLDLWWNPTTEDQAIDRAHRIGQTRPVTVTRITIKDTVEDRILKLQEEKRTMVASAFGEEHGGSSATRLTVDDLKYLFMV

SEQ ID NO: 84429 - protein, 438 aa, Candidatus Blochmannia floridanus
MSDSSKLDILVPNLPESVIDATVSVWHKKEGDKIKQGEILLEIETDKIMLEVPALQSGILLEILEKSGSIVIAGQILGRLECNNFSNQIKPLNFSDNQNSIKSTIAKKIEDNLVIQEEDKHSPISPVIRKLITKYNLNIDNIKGSGIKGRLTRQDIETYIQKNTLSQTYNVAINTDFKQSIYDNAQQKNDFTHDNRVNTIRNDVNNRTDTRVIMSRLRKKISERLLKVTNSTAILTTFNEVNMQCIINIRNKYQESFEKNHNIKLGFMSFFVKAVVEGLRRFPEINAYIDGEEIIYHNYFDISIAVSTPRGLVTPVLRNADKLRFVDIEKNIKLLANKGKTGKLTLDDLNGGNFTITNGGIFGSLLSTPIINPPQSAILGMHAIKDRPMALNGNIVILPMMYLALSYDHRLIDGKDSVNFLITVKNLIEDPMSLLLEN

SEQ ID NO: 84430 - protein, 399 aa, Candidatus Blochmannia floridanus
MNLYEYQAKQLFKQFNIPILKNHIITETSEIKDCISEIIKEGPPWIVKCQIRSGGRGKSGGVQIVNSMEDMLAFANRWFGKNLVTYQTTVDGERVNSILIEPAVNIAHEFYLSILIDRDLSNIICIVSTKGGVDIENVIHESVSTSDVIYKISIDPLIGACAYQGRLLASKLSLSGTQINQFTDMYINLVRMFIEKDLTLIEINPLIINKNNDLLCLDAKVSIDRNALFRQLDLVNLFLKNNNPNDNSHLPKLYSKYGGVNYVALDGNIGLLVNGAGLAMATMDLIKLFGGNPANFLDIGGDTNQESITEALKKLFKQESIKVIFINIFGGIVCCKLIADSIIHTLFDEHTELNIPIVVRLEGNNAKMGIDKLINANFKNVIIINNLINAVHKIMELVK

SEQ ID NO: 84431 - protein, 374 aa, Methanothermobacter thermautotrophicus str. Delta H
MNIDQSNPIKGNQDHGGEMFKEAKLALEDGTIIRGEAFGSETVKTGEVVFATGMTGYVESLTDPSYRGQILMPTYPLQGNYGVTEEWYQSDGIKAEGLIVREMCPAPSHSLSEKTLPEFLEEYGIPGIAGVDTRALTIKIRDKGTMKGALATEEIDDDELLEMAVKQPDITEIDLVDMVCVREPVILNEDASGRVVIVDCGIKRNSIDALLEKDLGVVIVPYTTSPAEIMDYEPDGLLISSGPGDPTRVRDAIDTVKALSERLPIFGICLGQQIIALAFGARIYKMKFGHRGVNQPVKDLRSGTVSITSQNHGFTVDPDSVKGTDIEITQLNLNDGTPEGIEHRELPVFSVQYHPEAGPGPHDTVNIFDRLWMF

SEQ ID NO: 84432 - protein, 519 aa, Glycine max
  misc_feature (375)..(375): Xaa can be any naturally occurring amino acid
MASITGPQILLHSGSPWLKQTMKPSSSPFLLFPKHTPRRTFCSINSNSKGSSSIVPDLLHYLNHSWTQFHATAEAKRQLLAAGFHMLDENHDWHLKPGGRYFFTRNMSCLVAFAIGDKYNVGDGFHVIAAHTDSPCLKLKPKTASCKCNYSMVNVQTYGAGLWYTWFDRDLSVAGRVILRTSHNSYVHKLVKVDRPILRIPTLAIHLDRTVNLDGFKPNLETHLHPLLSMKPEDTSLESNSKEKNSALSSKAHHHRLLMQVLSDELNCDVDDIVNIELNVCDTQPSCLGGGNNEFIFSGRLDNLASSYCALRALIDSCESPGDLASENAIRMVALFDNEEVGSGSVQGAGAPTMFQAMRRIVGDLTNNYVSEGSXFERTIRQSFLVSADMAHGVHPNFMDKHEELHRPKLQRVLVIKHNANQRYATSGITPFLFKEAGKIHNLPTQEFAVRNGMGCGSTIGPILASGVGIRTVDCGIAQLSMHSIREICAKEDIDIAYKHFKAFYQSFSSVDKMLTVDT

SEQ ID NO: 84433 - protein, 500 aa, Burkholderia sp. 383
MTDLLSAPEYAALAAALRFPSGPFIDGAFRTASSGDTFATVNPATDAVLAQIGACNAADVDIAVANARQAFEDGRWRKLAPSHRKAVLLKFADLLEQHAHELATMESLDSGKPIRECQTIDVPETIHTIRWHAELIDKIYDNTAPVGGNALALVVREPIGVVGLVLPWNFPLLMLAWKIGPSLAAGCSIVVKPAKETTLTALRVAELAHEAGVPAGVFNVLPGGGREVGEPLGRHADVDMVSFTGSTDTGRKFLKYAAESNLKRIVLECGGKNPAVVLPDAPDLDAVAQHIVNGAFWNMGENCSASSRLIVHADIKDDLLQRIGTQMREWKMGNPLDPAHRIGAMVSKAHFEKVRSYLEQAGAEHLHVAFGGQTDGGIFVEPTVVDGVSPHSRLFREEIFGPVLSVTTFTDIAEAIALANDSVYGLAASVYTGSLNLAIRLSREIRAGVVTVNCFGEGDVTTPFGGYKESGFGGRDKSVWAHDQYTEIKTIWIDVPVDPA

SEQ ID NO: 84434 - protein, 473 aa, Bdellovibrio bacteriovorus HD100
MGEGSKPLFFVSFQRVVVHLPAMKLHNSPVRAHTFQEMNLAPVLLPALTKMKISKPTPVQSQAIPASLDGSDIIAIAQTGSGKTLAFALSLLTTLQKKPEARGLILVPSREMAQQIYKVFLELCAEMPVSVCLAIGGTTGSKQANQLKKNPRLIIATPGRMNDHLSGNKLLLQNVEVIVLDEADRMLDMGFAPQLRTIQSTLRGPRQTMMFSASFGSNVESIAQLFMKPDVVMVRSEKAEAPVESLKQKVLFLDRSMKNDRLLDELNATRGGVIVFTGNQENCEAVGNYLKEYGFSTDLIHGGLSQGQRNRVVRGFREGEIRIVVATDLLARGLDVPHVDHVVNFDLPFQSEDFLHRIGRTARAGRGGEAITFVTPSDTRMYAKIKGYLQGAQEIKVDPTFAFIDRSKKFDKNKPAKGNEPARRNAPGKPQAVKKAAPAGKPKSKGGKINPFAGKTVAPKKSGAKKSGFAKRK

SEQ ID NO: 84435 - protein, 249 aa, Zymomonas mobilis subsp. mobilis ZM4
MTIRKLIAGNWKMNGSLGMLHELDGIAKATFNHPELDVVICPSFTLIAPAIVRQPDMTFGAQDCHYDESGSHTGCVSAPMLREVGASYVIVGHSERRIEQNETNEEIRAKTTTAIANGLVTIVCIGESRAAHASGQALPIIGAQLDGCIPPDATSDNLVVAYEPIWAIGTGNTPPPESIAEMHASIRDRLCLLLGSEGKKVRILYGGSVTGKNAEELMAIPDVNGTLVGGASLTAEQFVPIIEAGGRLA

SEQ ID NO: 84436 - protein, 278 aa, Xanthobacter autotrophicus Py2
MSESVLKSLSGPVVLLGAGKMGGAMLEGWLKLGLPAGKAVVLDPNLPADAAAALAARGVAVNPALADIPAPSVLLLAVKPQVAPDALPPLAPLVGAGTLVVSIMAGRTLAFMSAIFGAGAAIVRSIPNTPAAIGRGVSVCVPGANVSAAQRDLASALLGAIGIVEWIDDEALMDAATAVSGSGPAYAFLLAEVMAQAGAAAGLPPELAARIARATVAGAGALMDQSDLPAATLRQNVTSPGGTTAAALGVLMNETAGFGPLMVEAVAAATRRGKELAG

SEQ ID NO: 84437 - protein, 332 aa, Oncidium Gower Ramsey
MFPSSSSLSFFFIALFVFSTVSNGESSSGLIMDFYKESCPQAEDIIREQVKLLYKRHKNTAFSWLRNIFHDCAVQSCDASLLLDSTKKTISEKETDRSFGMRNFRYLEEIKDAVERECPGVVSCADILVLSGRDGIVSVGGPFIPLKTGRRDGRKSRAEVVEQYLPDHNESISSVLDKFAAMGIDAPGVVALLGSHSVGRTHCVKLVHRLYPEVDSKLNPDHVPHMLKKCYDSIPDPKAVQYVRNDRGTPMKFDNNYYRNILDNKGLLMVDHELAYDPRTRPYVKKMAKSQDYFFQHFGRAITILTENNPLTGDQGEIRRHCNVANKNHSEE

SEQ ID NO: 84438 - protein, 139 aa, Zymomonas mobilis subsp. mobilis ZM4
MAKFLIVEARFYSHLNDMLIQGAKQAIEEAGHECEVITVPGALEIPAAITMASDTGLYDAFVALGVVIRGETYHFEIVASESARGVMALTLDGLVIGNGILTVENEQQALVRADPQQKNKGGDAAKAAITMFNLKKKLS

SEQ ID NO: 84439 - protein, 246 aa, Helicosporidium sp. ex Simulium jonesii
LRGLGKAVESIGVMMQGTLAYRETLNKSQTLLTYNAKRPSLAAEVFVAPSASVIGDVKIGASSSVWYGAVVRGDVGSVSIGSHTSVQDNAMVHVAKHNAQNTLRGTSIGSHVTVGHGAVVHAATLEDGCFVGAGATVMDGATVQRGAVLAAGSLLAPGASVPAGEVWAGVPAKKLRGLAPGEQAYLASAAEEYSALAKVHAGECAKGFNAVELDSARRADRRGRDPAYDAQNGVARDPETREVTNA

SEQ ID NO: 84440 - protein, 324 aa, Candida glabrata
MSELKSRIGNSGSIANSGPVSILCYCASSILMTVTNKFVVNTDGFNMFFVMLFAQSLVCTMCLMVLKMFGYAKYRPLNLIDVKNWLPISFLLVFMIFTSAKALKYMPVPIYTIFKNLTIILIAYGEVLFFGGSVTPMELSSFILMVLSSVVASLGDQQAAKIAQPLANNSILSPEYYWMFLNCICSASFVLIMRKRIKLTNFKDYDTMFYNNALALPILLGFSFLSEDWSSENLAQNFSGESLSAMIISGMTSVGISYCSGWCVRATSSTTYSMVGALNKLPIALAGLIFFDAPRNFLSIMSIFIGFASGLLYAVAKQKKVQKN

SEQ ID NO: 84441 - protein, 713 aa, Escherichia coli
MSRIIMLIPTGTSVGLTSVAWRDPCNGTQRRSSERFQTYRSAAYRWRCADQTTTIVRANSSTTTAAEPLKMSYVEGLLSSNQKDVLMEEIVANYHANTKDAEVVLVEGLVPTRKHQFAQSLNYEIAKTLNAEIVFVMSQGTDTPEQLKERIELTRNSFGGAKNTNITGVIVNKLNAPVDEQGRTRPDLSEIFDDSSKAKVNNVDPANVQESSPLPVLGAVPWSFDLIATRAIDMARHLNATIINEGDINTRRVKSVTFCARQHSAHAGALRAGSLLVTSADRPDVLVAACLAAMNGVEIGALLLTGGYEMDARISKLCERAFATGLPVFMVNTNTWQTSLSLQSFNLEVPVDDHERIEKVQEYVANYINADWIESLTATSERSRRLSPPAFRYQLTELARKAGKRINLPEGDEPRTVKAAAICAERGIATCVLLGNPAEINRVAASQGVELGAGIEIVDPEVVRESYVGRLVELRKNKGMTETVAREQLEDNVVLGTLMLEQDEVDGLVEGAVHTTANTIRPPLQLIKTAPGSSLVSSVFFMLLPEQVYVYGDCAINPDPTAEQLAEIAIQSADSAAAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQ

SEQ ID NO: 84442 - protein, 252 aa, Helicosporidium sp. ex Simulium jonesii
MARKFFVGGNWKCNGTKESVSALVKALSAAKLPSADKVDVVVAPTFLHLSQALSSLPSRVEVSAQNCWIKGGGAFTGEISAEQIVDLGAKWVILGHSERRHIMGESDATVADKVAYALSKGLGVIFCIGEQLSEREANHTMDVCTRQMAALASKISDWSRIVVAYEPVWAIGTGKVATPDQAQEVHGLCRRWVAQHVSPAVAETTRIIYGGSVTAGNCRDLAAQPDIDGFLVGGASLKPEFVDIVASAELKS

SEQ ID NO: 84443 - protein, 533 aa, Magnetococcus sp. MC-1
MSPLAFTLDIAMSDALHSEKILILDYGSQYTQLIARRVRETQVYCEIHGHEMAAEAVRAFNPQGVILSGGHQSVYDVGAAELNDAVMALGVPVLGICYGMQLLGRHFGGTVAPSDKREYGRAEIQACAGQVGALFEGFVEAGAKSTVWMSHGDHVEMLPKGFVTTASTLNAPLAAMANEATHMYGVQFHPEVNHTDNGERLIHNFVRTICGCHGLWTSDGFIEYEVERVRALVGDDKVILGLSGGVDSSVVAALLHRAIGEQLTCVFVDNGLLRLNEGDQVMETFAQNMGVKVIRVDAEARFLGKLAGVSDPEKKRKIIGHTFIEIFDEEAGKIENAKWLAQGTIYPDVVESAGTKTGKATNIKSHHNVGGLPEDMQLKLLEPLRELFKDEVRKVGLELGLPHRMVFRHPFPGPGLGVRILGEVKKEYADLLRRADAIYMDELYASGHYERISQAFTVFLPVKSVGVMGDGRTYDYVVALRAVETKDFMTATWYPMPHDLLSHIANRIINEIDGINRVTYDITSKPPGTIEWE

SEQ ID NO: 84444 - protein, 137 aa, Oryza sativa
TRAGYSLGLWDLQHFMVLLRPDPARAQALVFDFQPRDPEDALAAFAVLSRSEIPGVVRRRTLRRVPDTRCWLVGHHRSGGGAGAAAAVLAADAFTARGPTDLVVGRHDCRDFTNGLVEELTGEKRVLDALRSSGCQW

SEQ ID NO: 84445 - protein, 226 aa, Helicosporidium sp. ex Simulium jonesii
QAHVLGKAKHTFTSAEEAVKALRAGPNGDVISDQWLEPFVIVDSDTQHPVGPIQDGDAVVIFNFRADRVIEISKAFEYAEFSSFDRERWPCTRFAGLMQYDGDLKLPANYLVAPPAITGTSGEIPSDKVPFNQLPLMKAREIAEAGKEALRSGKFDVVRINFANPDMVGHTGDLAATIKAVEVVDVCVKELLDVVDELGGRFLLTSDHGNADDMVQRAKKTLKPLF

SEQ ID NO: 84446 - protein, 445 aa, Porphyromonas gingivalis
MKTQEIMTMLEAKHPGESEFLQAVKEVLLSVEEVYNQHPEFEKNGIIERIVEPDRVFTFRVPWVDDQGKVQVNIGYRVQFNNAIGPYKGGIRFHPSVNLSILKFLGFEQMFKNALTTLPMGGGKGGADFSPKGKSEAEIMRFCQSFMTELWRNIGPDTDIPAGDIGVGGREVGYMFGMYKKLAREHTGTLTGKGFEFGGSRLRPESTGFGAVYFVQNMCKQNGVDYKGKTLAISGFGNVAWGVAQKATELGIKVVTIYGPDGYVYDPDGINTPEKFRCMLDLRDSGNDVVSDYVKRFPNAQFFPGKKPWEQKVDFAMPCATQNEMNLEDAKTLHKNGVTLVAETSNMGCTAEASEYYVANKMLFAPGKAVNAGGVSCSGLEMTQNAMHLVWTNEEVDKWLHQIMQDIHEQCVTYGKDGNYIDYVKGANIAGFMKVAKAMVAQGVC

SEQ ID NO: 84447 - protein, 149 aa, Deinococcus radiodurans R1
MPERASVPLRLLLVEDNAADIFLMEMALEYSSVHTELLVARDGLEALELLEQAKTGGPFPDLILLDLNMPRVDGFELLQALRADPHLAHLPAIVLTTSNDPSDVKRAYALQANSYLTKPSTLEDFLQLIERLTAYWFGTAAIPQTYQPQ

SEQ ID NO: 84448 - protein, 377 aa, Magnetococcus sp. MC-1
MQQSNQGRAVLVLEDGTRFDGRSLGAQTEQVGEVCFNTSMTGYQEIMSDPSYAGQIVTMTYTQIGNVGINPEDMESRRPWIRGFIVKESARRFSSWRAQESLSVFLTRHNIPAIEGIDTRALVSHLRDKGAMRGVLSTLDFNTENLIAKAKSFPGLAGMDLTGEVSCQTPYPWQQGLWDLEQGYRQIESGSNRKRVTVMDFGVKHNILRGLVQAGCDLTVVPTDTPAEKILAGNPDGIFLSNGPGDPDAVKHGVRTIRALLETKIPIFGICLGHQMLCLALGAQTLKMKFGHRGGNHPVQNLSTGVVEVTSQNHGFVVSDSALPDTLEVTHRSLFDGSVEGVRMKDKPVFSVQYHPEASPGPHDAHYLFKQFADLMR

SEQ ID NO: 84449 - protein, 488 aa, Mycobacterium smegmatis str. MC2 155
MTASSTPSSTTGTAQIGVTGLAVMGSNIARNFARHGYTVALHNRSIAKTDALLAEHGSEGKFVRSETIAEFIDALEKPRKVLIMVKAGEATDAVIDELADAMEPGDIIIDGGNALYTDTIRREAAIRARGLHFVGAGISGGEEGALNGPSIMPGGPAESYESLGPLLEEISAHVDGVPCCTHIGPDGAGHFVKMVHNGIEYSDMQLIGEAYQLLRDGLGMSAGEIADVFEEWNRGDLDSFLVEITAKVLRQTDAKTGKPLVDVIVDEAEQKGTGRWTVKSALDLGVPVTGIAEAVFARALSGSVPQRKATVGLASGALGATPSDAADFIEAVRRALYASKIVAYAQGFNQIQAGSAEYNWNLTPGDLATIWRGGCIIRAKFLNRIKDAYDAEPDLPTLLAAPYFRDAVEAGIDSWRRVVVTATQLGIPVPGFASALSYYDALRTERLPAALIQGLRDYFGAHTYGRIDAEPGKKFHTLWSGDHSEVEA

SEQ ID NO: 84450 - protein, 416 aa, Glycine max
  misc_feature (204)..(204): Xaa can be any naturally occurring amino acid
  misc_feature (232)..(232): Xaa can be any naturally occurring amino acid
  misc_feature (275)..(275): Xaa can be any naturally occurring amino acid
MEGSKENRVPPLPLIPSSNLQQGGGPRMKRLLHHHHRLPLGNISQNVMPHSHVNKLDLARKFTPHTVQHHFPQPHPQPQENKKQNLLAPTPSYQLDCDIVDIDDDDGDGSDDAVPVFVKHTEAMLDEIDKIEEVEMEDVEEEPVLDIDACDRKDTLAVVEYIDDIYSFYKDIENSSRVSPNYMNSQFDINERMRAILIDWLVEXVHYKFELLEETLFLTVNLIDSSLSVRQXIRKKLQLVGVTAMLIACKYEEVSVPTVEDFILITDKAYPRNEXLDMEKLMMNILQFKLSVPTPYMFMRRFLKAAHSDKKLELLSFFLVELCLVECKMLKFSPSLLAAAAIYTAQCSLYQFKQWTKTTEWYTDYSEEKLLECSRLMVTFHQKAGSGKLTGVYRKYNTWKYGCAAKIEPALFLLDN

SEQ ID NO: 84451 - protein, 251 aa, Nocardia farcinica IFM 10152
MSGAAGTPVADAVAARAAELSANLDALLARIEAACRASGRAPDSVRMLPVTKFFPARDVAILHDLGLREFGESREQEASAKVAELSGLDGIAWHMIGRLQRNKAKVVARWAHTVHSVDSERLATALDRGACAALAAGERAEPVRVLVQVSLDADPARGGVVPAELDALADRIAAAEGLQLAGLMAIPPLDAEPDSAFALLETLHTRILARHPGARELSAGMSGDLESAIAHGSTCVRVGTALMGARPITSG

SEQ ID NO: 84452 - protein, 104 aa, Bdellovibrio bacteriovorus HD100
MGKKIYVGNLSYNVDQDQLGGLFADFGTVDSVNIITDRDTGRSKGFAFVEMSSDSEATAAIDKLNGMDLGGRAMNISEAKPQEPRSGGGPRRNGGGFGGSRRSY

SEQ ID NO: 84453 - protein, 245 aa, Streptococcus thermophilus CNRZ1066
MTTEYIVIKIGGVASKLLTPDILAKLSEWQQAGQKIIIVHGGGFAINQLMEEHDITIHKVNSLRVTSQSDMVLIKEALVDIVGKNLASQLTQAGFPIYQVVDELPDLVHADFLDQEIYGYVGEVKSITNQTLVALLSQGKIPLIPSLGYSEQGDLLNINADYLARSVAISLGAKKLILMTDVKGVLENGQVLNHLNIVDVQKKIDSGVITGGMIPKIQSAVQTVESGVDQVIIGDNLTDGTIIKE

SEQ ID NO: 84454 - protein, 533 aa, Zea mays
  misc_feature (89)..(89): Xaa can be any naturally occurring amino acid
  misc_feature (123)..(123): Xaa can be any naturally occurring amino acid
MHSTNLLLEEPIRMASILEPSKPSYFPAMTKIVGTLGPKSRSVDTISACLKAGMSVARFDFSWGDAAYHQETLENLKLSIKSTKKLCAXVMLDTVGPELQVVNKSETPISLEENGTVVLTPHXGQDASSSLLPINFSGLAKNCSLQAVTPGATIFVGQYLFTGSETTSVWLEVSEVKGDDVVCIIKNTATLAGSLFTLHCSQIHIDLPTLSDEDKDVIRKWGTPNKIDFLSLSYTRHAEDVRQAREFLSKLGDLSQTLIFAKIENVEGLNQFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKQTVKYVGEPMTHLESIASSAVRAAIKVKASVIICFTSSGRAARLIAKYRPTMPVLSVVIPRLKTNQLRWSFTGAFEARQSLIVRGLFPMLADPRHPAESTSNTNESVLKVALDHGKACGVIKSHDRVVVCQKVGDSSVVKIIELDD

SEQ ID NO: 84455 - protein, 209 aa, Ustilago maydis 521
MSWFGRGTTGNASSNGNAFAGTGSSRWINMDTQQIKNFGGELTGENDAFSKTFGIELTRQQRMIGFAACMLGGFVISLLGTVLLVTGSMAVFVILYSVGVLVSLTGTGFLIGFMKQFQQMFKPVRIAFTLVMIVAFVMVWVSVFAINSTILAIIFVIVLYVAFLLYSLSYIPWCIDFIKRMFHTFDPSLQSRTLALPNVASKRMAMSWL

SEQ ID NO: 84456 - protein, 376 aa, Streptococcus thermophilus CNRZ1066
MTKLFSNYKRAAIDFASAQGNYLTDTTGKTYLDFSSGIGVTNLGYHPRVNQALTDQVGKILHQPNLYYNQLQEDVAGLLTGDKDYLAFFCNSGAEANEAAIKIARKASGKQEIITFQNSFHGRTFGSMSATGQDKIKQGFGEGVPHFSYAIFNDMDSVKALANKETSAIMLELVQGESGVQPADKAFVKALSDYCQETGIYLIVDEVQTGIGRTGKLFAYEHYDIEPDIFTLAKGLANGVPVGAMLAKSSLGGAFSYGSHGSTFGGNKLSMAAAKATLEVMLTPGFLDTALENGNKLQVKLQEVLSDKETVTTVRGLGYMIGIETTGNLSELVQAARDKGLIVLTAGTNVIRLLPPITLSDAEIEKGVAILSEIFD

SEQ ID NO: 84457 - protein, 412 aa, Bdellovibrio bacteriovorus HD100
MKFEKFHLSEDLLRNLTDNGFFRTTDIQYKAIPSILKGEDVLAIAQTGTGKTAAFAIPIINMIHTEKSSKRAIGIKCLILVPTRELAQQIGEVFNKLSKHTKVKPFALFGGVEQDAQIQKLQDGIDILISTPGRMFDLIAQGHVDISRIETLVLDEADHMLDLGFIDDITSVKRKLTKRHQTLFFSATINPEIKKLAFSQVRSSAIRIQISPEDPVSKNITHFVMHVEMDDKRFFLAEYLRQNPDGKFIIFVRTRVRAERVAKALARVEVQSLTLHGEKDQTDRAEVMKTFRKGDCKILIATDLSARGIDIPDVTHVINYDLPEKPENYVHRIGRTGRGFNKGVAVSFCSTEEKPLLAEVESLITKKIEVLKVSKQDYKAIVETQDLSLDASLQELLNSEDNYKKASKRKKK

SEQ ID NO: 84458 - protein, 379 aa, Zymomonas mobilis subsp. mobilis ZM4
MSKNTPIVKGSTKRHPFLSSVEELIEEARNGRIFILVDDEDRENEGDLIIPAQMATPAAINFMATHGRGLVCLAMTKERVTSLGLAPMSRENNAPLQTAFTVSIEAKEGVTTGISAGDRARTIAVAIDSSRGAEDIVTPGHVFPLAAKSGGVLVRAGHTEAAVDIARLAGLNASGVICEVMKEDGTMARLDDLVTFAQRHNIKIGTIRDLIAWRREHDNNVELIEEKSFNSLYGGDWQAIRFRNKATGSESLALVKGQISADEPTLVRMHAIDPFTDMLGQTGSRQQLLSRSMEIIAKKGAGVVVLVQRSQENSADKSSVWAASRNQETIHRDYGIGAQILAELGVRDMILLTNSHHMPVALAGYGLNITGEQPITEGA

SEQ ID NO: 84459 - protein, 564 aa, Solanum tuberosum
MGSCFSSSKVSGSNSNTPSTNNTATNTNTTVNVHPNRRETSKAPSTTVVNSRNQEGSNYNRGKGNINQKNQQKQPRNSQQNVKPSSRRQGGVIPCGKRTDFGYDKDFEKRYTIGKLLGHGQFGYTYVATDKSSGDRVAVKRIEKNKMVLPIAVEDVKREVKILKALGRHENVVQFYNSFEDHNYVYIVMELCEGGELLDDCQKTVGIREDAAIVVPQMLKVAAECHLHGLVHRDMKPENFLFKSTKEDSPLKATDFGSSDFIRPGKVQDIVGSAYYVAPEVLKRRSGPESDVWSIGVITYILLCGRRPFWDKTEDGIFKEVLRNKPDFRRKPWSNISNSAKDFVKKLLVKDPRARLTAAQALSHPWVREGGDASEIPLDISVLSNMRQFVRYSHLKQFALRALRSTLDEEEIADLRDQFSAIDVDKNGVISLEEMRQALAKDLPWKMKESRVLEILQAIDSNTDGLVDFPEFVAATLHVHQLEEHNSAKWQQRSQAAFEKFDVDRDGFITPEELKMHTGLRGSIDPLLEEADIDKDGKISISEFRRLLRTASMTSPTVRDSRGM

SEQ ID NO: 84460 - protein, 153 aa, Brassica napus
MSDLLAETLTRSDSVAKKRVRHELDELVLDSPDVKRLRDDLFDDSGHDSEIQDLDSLMKSFEDELSSTTTEQGSGETLPDLGYLFEASDDELGLPPPPPPPSTLLHPSSEETEKTVTELVRASSEVDVACYEYSDVCLDSGDMFSWRPETLPA

SEQ ID NO: 84461 - protein, 444 aa, Bacteroides fragilis NCTC 9343
MNAAKVLEDLKRRFPNEPEYHQAVEEVLSTIEEEYNKHPEFDKANLIERLCIPDRVYQFRVTWVDDKGNVQTNMGYRVQHNNAIGPYKGGIRFHASVNLGILKFLAFEQTFKNSLTTLPMGGGKGGSDFSPRGKSNAEVMRFTQAFMLELWRHIGPETDVPAGDIGVGGREVGFMFGMYKKLSHEFTGTFTGKGREFGGSLIRPEATGYGNIYFLMEMLKTKETDLKGKVCLISGSGNVAQYTAEKVLELGGKVVTMSDSDGYIYDPDGIDRAKLDYIMELKNLYRGRIREYAETYGCKYVEGARPWGEKGDIALPSATQNELNGDDARKLVANGVIAVSEGANMPSTPEAIKVFQDAKILYAPGKAANAGGVSVSGLEMTQNSIKLSWSSEEVDEKLKSIMKNIHEACVQYGTEPDGYVNYVKGANVAGFMKVAKAMMAQGIV

SEQ ID NO: 84462 - protein, 659 aa, Magnaporthe grisea 70-15
MAALPQNQDVIRVISTGGVTKVVKIADCNTCEEVMRVTLRKFALREDHERNYCFWVLSGLDPDPKQCRRLGDTELWRVIKDQKRPERNRLILRRVPAGEPGQSELERAAAIAMEEAQQSHSRAMDNVGARSQIKVQKVLGENWDNLQPPLSPVLYQDRERNVYNAARDLERPEPLDSGRLQPRRKVLRSFGGLRPPSELIASDLTTYFPDHPREDIDRTARLSMRRSARLSKVNSRLSVASSFSMASSIQDAPPIPTIADSWLQSTPLPKARPRDLQSRLQHGYRDSVASSMLDTLQEEGSPIEPNRKSYVSFADSGSDSAAVSVTDPDGNIVRHSYFDEGSTIGSGSGSGSFGDVSKALNEDGEDADEDLQSFLSGESWDDSKWMKGALIGQGSFGCVYLALHAITGELLAVKQVEAPSPGANSQNDARKKSMIEALKREISLLRDLRHPNIVQYLGCGSSAEYLNIFLEYVPGGSVQTMLNSYGALPEPLVRSFVRQILNGLSYLHEREIIHRDIKGANILVDNKGTIKISDFGISKKIEATNLLNGANNNKHRPSLQGSVFWMAPEVVKQTSYTRKADIWSLGCLVVEMMTGTHPFPDCTQLQAIFKIGGGKATPTIPEDASTEAKAFLAQTFEMDHNKRPSADDLMLSPFLTPIT

SEQ ID NO: 84463 - protein, 461 aa, Cytophaga hutchinsonii ATCC 33406
MKKFVTLFLALFFYVTCLHAQNCWKSVSVGDGYTLALKEDGTLWGWGLNNQGQLGNGTLVNKTVPTQIGTATNWSQISAAHNFSTALKNDGTIWAWGDNTFGQLADGTTTNKTAPIQIGTATNWQSVSAGYNHIAALASDATIWLWGNNYSGQLGDGTNTDKKSPLQIGTNEWKAIHAGSGYTIALKTDGTLWTWGNNTSGNLGNGTLADRNTPGKIGTAADWQKIYSAPMAMKADSLLWGWGYNGYGQLGNGLNGSLNNLKNPAQIGASHWKEVSPSGTHTLGIKGNGTLWAWGYNENGKLGDGTQTDRSLPTQIGTDSDWKMVNANYYHTMAIKTDGSLWAWGTNSNGQLGDGTKISKSSPTPVACSGIALSINTSLNETAIEVYPNPSQGFFLITVDPAATEHGVVRVLNMTGNIVLEKQFSEKQFEVDLTNQPEGIYYIQVQTDNTLLHTGKIIKRH

SEQ ID NO: 84464 - protein, 243 aa, Zea mays
  misc_feature (232)..(232): Xaa can be any naturally occurring amino acid
  misc_feature (241)..(241): Xaa can be any naturally occurring amino acid
MASSTSTLEIEARDVVKIMLQFCKENSLHQTFQTLQNECQVAQLKLPRKKLEDLYEQIVLEMAELRELDTARAILRQTQVMGVMKQEEPERYLRLEHLLVRTYFDPNEAYQESTKEKRRAQIAQAIASEVSVVPPARLMALITQALKWQQHQGLLPPGTQFDLFRGTAAMKQDEEEAYPTTLSHQIKFGKKTHPECARFSPDGQYLVSCSVDGIIEVWDYVSGKLKKDPQYXADESFMMHXDA

SEQ ID NO: 84465 - protein, 112 aa, Helicosporidium sp. ex Simulium jonesii
MGGAVIQVTNKTEFDSHLSTAASKGKLVVVDFTATWCGPCKMIAPFFAKLSGEYPDVVFLKVDVDEVEAVAAEHGITAMPTFLFFKDGKQVDSLTGANQERLRAMLTQHAQS

SEQ ID NO: 84466 - protein, 122 aa, Helicosporidium sp. ex Simulium jonesii
TAFTVTVDAREGITTGISAQERARTIQALADPTTTAANLRRPGHIFPIRARPGGVLERRGHTEAGVDLARLAGCTPAGVLCEIVEEDGSMARGPSLQRFARRWNLKCVTIADLVHYREVMSV

SEQ ID NO: 84467 - protein, 300 aa, Deinococcus radiodurans R1
MSGSEGTDLPRVLVVGSANLDFVTRLSHLPAPGETVLGESYTTAPGGKGANQAVACARAGGAVAFCGALGTDPFAEPLLASLRESGVQDWTVRASTPTGAAFISVSEAGENCIAVASGANGTLRPEQLPPLTGVGWLVLQLEIPLETVQAAAQAAREAGAQVVLNAAPARTLPPELLRLVDVLIVNEGELRTLIGATDLRAGVRQAQASGPRTVVVTLGERGCLALSGDDWTELPALPVPVRDTTGAGDTFVGVLVAALSRGEPFAAALRWAVAGSALACTREGAQPAMPGREEIQANLG

SEQ ID NO: 84468 - protein, 270 aa, Magnaporthe grisea 70-15
MKAVVFEGPYKISVQDRPVPQLQDDKDIIVKVHASGLCGSELHSYRGIEESGSGFIMGHEFTGTVTEVGSAVKTVQVGDKVTQTSRCEHSQLFGSAGLDGGQAEYVRVPFADGTVVKAPAEFAEDDKVLVLMADIWPTGYFGASNAFKLLEATPDPVVVVIGCGPVGLCAVVAALEHKPKHLFAIDGVDSRLDLARGLGAEPLNFVTDREGMFKRIMEVTGGRGVDAVVEVVGLKDALRTAFDILRPFGVISSIGVHSTELPWTAAEAYE

SEQ ID NO: 84469 - protein, 626 aa, Neptuniibacter caesariensis
MSEVTLSSINVFPIKSLGGLNLSDVFVSEQGLSFDRRFMLSNPDGELLSARQIPSLLQYSVLLRDDGIEVIAPDGDHLSIKYPELFQNYKQVTVWGTEINAQHCGIGFDEWFTEKLGRDCHLLFFGEQSERFTSRRPEKPVAFADGYPILVISQASLDDLNSRSSTPITMDHFRTNLVVDGCEPFAEDSWKRIRIGEVEFEAVKPCSRCVMTTFNPSTGEKIPQGEPINTLAKYRLGADNEVYFGQNLIPLNEGKISTTDRVEVLETQASETYPNNAPIIRSNDSSIEENSWQAGQEVTLQCLQRVDETRDVVTFRFALPKGLRAEYIAGQFITLNLMIDDSPVSRCYTLSSSPSRPQDIAITVKRVTDGKISNWLHKNLQPGDQIQALAPIGEFNEAVTGNGSLLLLSAGSGITPMLSAVRQLTDTHSERDIVFYHQARTEADLICEDELLWLTRQNPKLRLIFSLSQPEPDWLGIKGRISREQLIHHIPDLPQRTVMCCGPEGFMSHAKDYCRQLGLAEQRWFEESFGAPPGIDPTADSHSVQVTLNGDSFTGDNQQTLLEQAEENGFSIPAGCRSGVCGACKVQLIAGDAHRSSEIPLTEEEKAKGIVLACSCTPETDVVIEY

SEQ ID NO: 84470 - protein, 345 aa, Moorella thermoacetica ATCC 39073
MKALVFEGPNELKLRDVPLPEPGEDEILVKVAACLICGTDLRIFRGAKTRGVRIPSILGHEFAGVVEATGVNVKEFHVGDRVGVAPVIPCHTCFYCKNGLENVCANRTALGYEYEGAFAEYVCIPAPAVKGGNVYHLPSNISLEEAALAEPLACCLNGHHNSKVKLGDVVVILGAGPIGLMHLQLAKSSGASYVIISEPNEHRRAIAKEFGADRVVDPQTEDLNSIVKNVTDGLGADIIFLAIGIPALAQDALTLVKKGGTINFFAGFSVGDKAALDVNLIHYNEIKITGTSAARRDDYRKALDLIAKGKVKASKMITHRFPLDKAEEAFRIAGSSQGIKVAIIP

SEQ ID NO: 84471 - protein, 334 aa, Zea mays
MGSVASAAVPPPPPQSALPQAGAPPYGPGLAGILPQMSKGEEKKDEKVDYLNLPCPVPFEEIQREALMSLKPELFEGLRFDFTKGLNQKFSLSHSIFMGSLEVPAQASETIKVPTAHYEFGANFLDPKLMLIGRVMTDGRLNARVKCDLTDNLTLKVNAQLTQEAHYSQGMFNFDYKGSDYRAQFQIGNNAFYGANYIQSVTPNLSMGTEMFWLGHQRKSGIGFASRYNTDKMVGTLQVASTGIVALRYVQKISEKVSLASDFMYNHMSRDVTASFGYDYLLRQCRLRGKIDSNGGVAAYLEERLNMGVNFLLSAEIDHCKKNYKFGFGMTVGE

SEQ ID NO: 84472 - protein, 206 aa, Prochlorococcus marinus str. AS9601
MTDTPTKQEIQSKNDNVPAATPVEQKKNNRNDRKRNRRGDSKNLERDSDWQERVVQIRRVSKTVKGGKKMSFRAIVVVGNEKGQVGVGVGKAGDVIGAVRKGVSDGKKNLVRVPLTPNNSIPTLSLGSDGAANVLIRPAAPGTGVIAGGSIRTVLELAGIKNVLAKRLGSKTPLNNARAAMVALSQLRTHKSVSRERGISLEQLYS

SEQ ID NO: 84473 - protein, 402 aa, Methanothermobacter thermautotrophicus str. Delta H
MLQVILNIRLDHKTSDVKTMESSHERMEAIVAELESSGTVMEKVPIRTCNRIEYYLSVQEIPPGFEFDGFTVEGDEDALRHILRLASGLESMIIGEDQILGQIKAARVQALREGTCGPVLDMVFTKAVHVGQTVRRKTQINRGSVSIGSAAVDLAESIHGDLKCRKVLAIGAGKMGTLVARALAEKHLSAIMVANRTYERAYQLACELGGDAIHFDRLNRALRDADVVISATGSPHYILTRERVRDAIPPERRSAVVMVDIANPRDIEESVRELGIRLFTIDDLRGVAEENRRRREAEAREAERIVEGELKLLLRSLKHMEVEPLLAEVRGNMESLRRREAERALNKIMNSSDPEGVIEALSRSIVDKIFHDIAISIRQAAERGDEEFLSMCAKLFNCKDLK

SEQ ID NO: 84474 - protein, 136 aa, Solibacter usitatus Ellin6076
MPLERANGNARSVLVVEDSENSAAMLEIAFLGIPNVAVLLTESAVEAMRILDSGDAHVNVIVTDLNMPRMDGFELIRRVRADCRLANLPIIVVSADTDPTTPSRVAELGVDAFFPKPFSPAQVRRKLEQLLDGRTP

SEQ ID NO: 84475 - protein, 298 aa, Nocardia farcinica IFM 10152
MIGGMKIRKAVIPAAGIGSRLLPLTKAIPKEMLPVGDKPVIEHTVRELVASGITDITIVVSGGKSLIQDHFRPNPALVAQLRADGKTAFADAVEEVGELSRLGHITYLDQHGPYGNGTPVLNAARTMGDEPMLVLWPDDVFVAETPRAQQLIEAYERTGAPVLALMPMDPAESQRYGVPVVADDHGEGLLRITGLREKPKPEDAPSSYAAIGGYVVTPGIIEELRRQTAAWYEHRTGEVYLTDAINVHAADNPVFGQVIRGRWYDTGNPADYLVAQFASALAHPEYGPLLRNLAAELG

SEQ ID NO: 84476 - protein, 469 aa, Solibacter usitatus Ellin6076
MRVTVIGTGYVGTVTGACLAYLGHQVTCVDTDAAKIARLQRGESPIYEPHLEPLLALAAERGGLEFSTEVSGAVCASDVIFIAVGTPPLPSGEANLTYLESAARSIGAAMDGSRFRVIVNKSTVPVGSGNLVEALVREGVGETRAGERIRFGVASNPEFLREGSAVADSLYPDRIVVGGDAATVAVMRELYEPLVAQVFTPPPGVPRPSSMISVPLLSTSLTSAEMIKYAANAFLAMKIGFANEIANICERVGAEGPEVMAGIGLDSRIGAKFLNPGVGWGGSCFGKDIQSLLHTAKEYGYTSKLLEATLEVNAAQRQMVIQKLQEKLYILKGRTIGLLGLAFKPDTDDLRDAPALHIAERLMQMGVRVKAYDPIANAACREQRPELKMRYCDSVQELASGADALVLVTEWHEFHNLDLGELAGLMANPILVDGRNFFVPERAMQAGFDYCGIGRCARTRSTARMEATT

SEQ ID NO: 84477 - protein, 582 aa, Chlorobium tepidum TLS
MVVETSNAELDAMRRQSLERLLARHCGDCLAPCELACPAGCDIPGFVSAIAKGNDREALEIIRRTIPLPGILGRVCPAPCEEACRRHGVDEPVSICALKRFAADQDMVEGSGLPERKPASGKRVAIVGAGPAGLTAAWYLLLDGHAVTVLDANEKAGGMMRYGIPKFRLPEAVIDADVKPLVKMGAEFRFSTLFGKDANLEELQQEHDAVLLTIGASQASKLGIPGEELDGVQSGIGFLANVADGKAAAPGKSVIVIGGGNTAIDAARTALRLGAESVTILYRRGREEMPANRLEIEEAVAEGVELRLLAAPVAIEKGANSLVVTAVEMQLGEPDASGRRRPVPVAGSEFTLHADTVISATGQQVDLPAEAAAGIGVERNGTVKINGESMLTGAAGVFAAGDCVSGPDLAIKAVRQGRLAAEAIDRYLNGGDPAATGMSMFNSSYGARDKAPHQFYDRARPAARVAVPELEAESRRQSFEEAVTGYDPEKAREEAKRCLRCRCQAVDDCRLRNLATAFGVATPATEEAHEYFSIDRSGDMRFEREKCIDCGICIRTLESASADAVTIREELIDHCPTGAISR

SEQ ID NO: 84478 - protein, 692 aa, Hordeum vulgare subsp. vulgare
MLLQPYHMIAPLLLLLVAAGSCHAAIDGGGSDDGRMFVYNGFTGANLSVDGPSLIMPNGLLLVANATGRTGGSLNGHAFRPFPLPFHTASNATGSVRSFSTSFVFGIIRQYEGLGSDGMAFFVSASKEALSTAQPGPSLGLLNDINNRNRNSSARIFAVELHTSRNVQLHDINDNHVGVDVDSSLVPLDSASAGYYDDDEDGGRFQNLSLISRKAMQVWVDYDGRATEITVTIAPLGLAKPKKPLLRTITDLSGVLQSTAYMGFSASTGYRTRHFVLGWNFALDGPAPVLDLSMLPALPTALSNSRSMSITMKIVLALASVALVSVGIGVYIFVRRRLKYSEVHEDWEVPFGPNRFSYKDLFHATEGFSDKNLLGRGGFGSVYKGVLRKSDKEVAVKRLSHDSRQGKKEFIAEVVSIGHLRHQNIARLLGYCRRKGEFLLVYEYMENGSLDKYLHTRNGPTLCWSQRYSIIKGVASSLLYLHEEWEHVVIHRDIKPSNVLLDSKMNGWLGDFGLAKIYGRETAAPATHVAGTIGYLAPELARTGRPTPFTDVYAFGMFLLEVTCGRKPIFTDKQNNRLLLVEWVLEHHRDGSILDTVDPRLQGEFNMEEVTIVLKLGLICTYPLPNMRPIMRKVMQYLVHNQSPPDLSPAYISYMSLMQNQGFNSDNMNTTCPEATTSVATASSATILRDGR

SEQ ID NO: 84479 - protein, 518 aa, Alkaliphilus metalliredigens QYMF
MSILTVKNLTHGFGDRAIFNNVSFRLLKGEHIGLIGANGEGKSTFMNIITGKLEPDEGQVEWAKKVRVGYLDQNTSLEKGMTIRDALKGAFQYLFDVETEMNEICDKMADASPEELEHLLEDMGSIQDTLTNNDFYIIDAKVEEIARGVGLDEVGLEKDVHDLSGGQRTKVLLAKLLLEKPDILLLDEPSNYLDEQHIEWLKRYLQEYENAFILISHDIPFLNSVINLIYHMENQELNRYVGDYASFGLVHEAKKQQSEAAYRKQQQEITELKDFVARNKARVATRNMAMSRQKKLDKMDVLELAKEKPKPEFNFKCSKSPGKLIFETNDLVIGYEEPLSKPLNLRMERGQRIALVGANGLGKTTLLRSILGQIHAVSGSVELGDYLEVGYFEQEIKEANYKTCIEEVWQDFPSYTQQQIRAALAKCGLTTQHIESKIVVLSGGEQAKVRLCKLVNQESNLLILDEPTNHLDVDAKEDLKRALKEYKGSILLISHDPDFYRDIATDIWNCETWTTKLV

SEQ ID NO: 84480 - protein, 265 aa, Mycobacterium smegmatis str. MC2 155
MINLRGRRKPKVVTQRTSAELDAMAVAGALVASALRAVKAAAAPGVSTLELDRIAETVIRDGGGTPSFLGYHGFPASICASVNERVVHGIPSADEVLAAGDLVSIDCGAIVDGWHGDSAVTFGVGPLIPADEALSEATKAAMEAGIAAMVPGNRLTDVSHAIEVETHAAEKRDDRKYGIVANYGGHGIGRQMYMDPFLPNEGAPGRGPYLAPGSVLAIEPMLTLGTTKTVVLDDEWTVVTADGTRAAHWEHTVAVTEDGPRILTQ

SEQ ID NO: 84481 - protein, 164 aa, Xylella fastidiosa 9a5c
MHLIAHLDTVRGPIKINLFADKAPLTVANFVNLTKRGFYDRLNFHRVIANFMIQGGCPEGSGRGGPGYRFEDETNNGVSHERGSLSMANAGPNTNGSQFFITHVATPWLDGKHTVFGKVVDGQDVVDAIAQGDIINKITIEGDADSVLALKADRIIKWNSILAT

SEQ ID NO: 84482 - protein, 317 aa, Xanthobacter autotrophicus Py2
MSAENGPMKLVAGNSNRALAEAIAAYLATPLTKAVVRRFADMEIFVEIQENVRGQDVFVVQSTAFPANDRLMELLIIIDALRRASSKRITAVLPYFGYARQDRKPGPRTPISAKLVANLITHAGADRVMTLDLHAGQIQGFFDIPTDNLYSAPVMVRDIKERFDLSNVMVVSPDVGGVVRARALAKRIDAQLAIVDKRRERPGESEVMNVIGNVEGRSCILVDDIVDSGGTLVNAAEALLARGAKEVHAYITHGVLSGGAVARITASKLKELVITDSIQPTEAVRVARNIRVLSIATLIGEAIARTAHEESVSSLFD

SEQ ID NO: 84483 - protein, 225 aa, Triticum aestivum
MSDQSQPVRTGDVYPPSAAAHDARRQRDEVLTTHDDQQQKQDGRRGELRVTETDEPHAGRRVVTATAGGQVMAQFTVPVPGAGVEEATDAVTIGEALQAAAQTSAGERPVDLADAAAVQAAETRATGLGGVVPGGVAAAAQQAAETNMRPDLAEEEKVRLRDVLGSAAAVLPANKVATREDAVAVATAAKRNAPAGGGGGGKGVADAVAAAADMNEKRMTRTRQA

SEQ ID NO: 84484 - protein, 437 aa, Legionella pneumophila subsp. pneumophila str. Philadelphia 1
MIGNKTMDMDIKHKPLKRELSLFGATMMGLGSIVGTGVFVSIGIAAGVTGPSVILAIALAALVATCNAFSSAQLAANHAVSGGTYEYGYRYLHPAFGFTAGWMFLCAKSASAATAALGFAGYFIHLSGLETVPVIPIALAVSITLILLVLSGLRRTNTVNIIIVMITLITLTVFIISGLPDFMQRGTANLRPFFPVSKQEGLSHFFYATALMFVAYTGYGRIATLAEEVKNPGKFIPAAIIITLMVSAVLYILVGLVAIGAVGVEKLAQVTETNATPLESAARAIGIPGLSVLVSIGACTAMLGVLLNLILGLSRVALAMGRKGDLPKMFCYVSETRHVPVSAVIGVGVVIIALVLTGSVETTWTFSAFTVLIYYAITNLAALHLPKEEQLYPPLFAIGGLLSCLFLAFWVPIGVWITGISLLFLGLLWKVVANRFL

SEQ ID NO: 84485 - protein, 1243 aa, Aspergillus nidulans FGSC A4
MASSRSREQDHIDGRRARELYRYFQPQRSLSADRLLTHSTSDSESAQLGDAPAGESIFATTPPSPALSGQVASTTTGLLPEALILGEYNATLNSFAQLAALRLDVERVVISVSDRSSMFIIAQSSRSHRNGKKPSEKDDSGTWDGCYPLSSATWAMCKKTVDLPPSNRERGEYHFLEINDMSRDERYKNISFVKGDQRFRFYAGMPLTTESHKINIGCFFLLDTKPHNGLTVEEKEIMGSISVLIMNFLKVSRQASEGRRAARLSRGLSCFVEGSSSFVDTADPSYTGSVSTLPGSPPFSAPRGNHLSVRSSNSVEGLLKRSHSSDARSFSSISDYKIDPGRSSNPPTPLPEWWSGTQRRELEGLDQSHGNSWAFKRAANLLRESLELGGDGGVVFLETGTTPALDIDSGSDYTAENVTPASVLAMSTNEEPFAPSPGSTVASPAANLDTGFLQQLIRRYSKGKLWSFHRDGSVSSSDDENAKPSRNSARTARAQELTKSAPKRWRSVENTLLNTYFPNATQVLFVPLWNAASSQWFAGCFCWNTVESRVFSSSVELSSVLGFGSSIMVEHSRLESLISDRQKGDFIGSISPLHGILAAAEFLSGTNLDEFQGQLLDTINACSLTLLDTMNQVLDFSKIVSLERKARQMRQNKKQQFAGFSGKASVGLDNSVRTDIALLAEEVVEGVCLGHAYSLKSSSNPMSPAADLPKGKRVSHPRAEMGVEVVVDIAQNNWTYNAQPGALRRIIMNVFGNAMKYTEAGHVCVRLEAAESNDDRHSQPAEDLITLTVSDTGKGISEEFLRGRLYTPFAQEDTLAVGTGLGLSIVRSLVKSLGGSIDIHSRAGEGTTVRVTVPLTRPGDDVEVISPTTTEPDIVRSASEKDPPNHCDLLRHNYTNKRAAIIGKGPTDARAHLLWSTISDYLTRWYEFELVSWPSEQPVDIVLADEHMLADLPRTFSTLTSLPPLIILCSRSIDYEVARMQWSPLADVVSIITRPCGPYKLARTIQKCFDSAKGTVSEQAQAERTLPFRPKTTLLTAANAIPEEEQKSFGILNITPDSTDGASSNTPNSKGSDRSTPSQESSEMSDPMSTLASSCQLRPQPVAESTAKLERTPKILVVDDNFINLNLMLTFLRKRRLQYLDSAENGQLAVDAVERTPGGYDLIFMDISMPVMNGFEATRAIRAIERERGTELPTPATIIALTGLSSVRDESEALSSGFDLFLTKPVSFKEVSKLLDEWSAKAI

SEQ ID NO: 84486 - protein, 468 aa, Streptococcus thermophilus CNRZ1066
MSSGKIAQVVGPVVDVAFATGDKLPEINNALVVYTDEEKSRRIVLEVALELGEGVVRTIAMESTDGLTRGLEVLDTGRPISVPVGKETLGRVFNVLGDTIDMEAPFADDAEREPIHKKAPTFDELSTSTEILETGIKVIDLLAPYLKGGKVGLFGGAGVGKTVLIQELIHNIAQEHGGISVFTGVGERSREGNDLYWEMKESGVIEKTAMVFGQMNEPPGARMRVALTGLTIAEYFRDVEGQDVLLFIDNIFRFTQAGSEVSALLGRMPSAVGYQPTLATEMGQLQERITSTKKGSVTSIQAIYVPADDYTDPAPATAFAHLDSTTNLERKLTQMGIYPAVDPLASSSRALSPEIVGEEHYAVATEVQRVLQRYRELQDIIAILGMDELSDEDKTLVGRARRIQFFLSQNFNVAEQFTGQPGSYVPVAETVRGFKEILEGKYDNLPEDAFRSVGPIEDVVAKAKAMGY

SEQ ID NO: 84487 - protein, 237 aa, Oryza sativa Japonica Group
MAAEDELKLLGFWASPYVCRVKLALHLKGLIYDYVKEDVFTNKSELLLSCNPVHAKVPVLIHNGKPICESQVIVQYIDEVFPDAGVTLLPADPHDRAAARFWAAYIDDKLLPPWVHAYRGKTDEEKAERMKQTLAVVDALETAMEECSKGNAFFGGDTVGYVDVALGGLLSWLHGTEELCGAKILDAAKTPLLSAWARRFGELDAANAALPDVGRLVEFCKMRHVELEAAEAAAARN

SEQ ID NO: 84488 - protein, 230 aa, Triticum aestivum
ILIEKHAHHAYADEEAERTRRRRANGGHPHPPLEVPIQSRHRVRSAKRGAAGRGHLILLVPPPSLVSSSPDLNPPISNKVHQDMSAPISHYYVFTGHNSYLTGNQLNSDSSDVPIIAALQNGVRVIELDMWPNSAKNCVDILHGGTLTAPVEIMRCLKSIKEYAFCASTYPLVITLEDHLTADLQAKVAGMITETFGDLLYVPSSDTLNEFPSPEALMRRIIISTKPPQE

SEQ ID NO: 84489 - protein, 67 aa, Glycine max
MSVSYNNFLIVMSIFKWSLQVMPKQPGFERRDLYMLYHYLNHYNLFGSGYRSSAMPIIDDYLAFLKA

SEQ ID NO: 84490 - protein, 599 aa, Oryza sativa
  misc_feature (475)..(475): Xaa can be any naturally occurring amino acid
MSLASTTTIRPSGSWTPTCRMQTATALFLAPIIVLSFGGFQGPSYTRELTLQGIWWATFVNCSQAVKNNNKYIHVDCQNTSSSFVYVLNVAPYYALMENLEPSCGYLAMIPVSWTPASGKKYQYFAELMRKGFSVRFPFVLDHPTAFELIKQCLNRSIRGFREEPFSTTAHVKNRIADIVFVDLIFWACIIGKTSQTSDYFETPLYMVEMLHGKRIFYSGFVLQFVMWTVKWIYVICRFVLAPLALLTFLAQRYWKTRITIDAVEKFLRMQLMLGPTRYTYTDIIAMTSHFRDKLGQGGYGSVFKGVILPGDVYVAIKMLDNYNCNGEEFISEVSTIGSIHHVNVVRLVGFCAEEMRRALVYEYMPHGSLDKFIFAPEKSFSWDKLNEIALGIARGINYLHQGCDMQILHFDIKPHNILLDSNFVPKVADFGLAKLCPRDNNYVPVSAARGTVGYIAPEMISRSFGVISSKSDVXSFGMLLLEMAGGRRNSKQNMSSSTQVYYPSLVYNQLIQQEMGEITNTLNMHELERKLCVVGLHCIQVKPPDRPTMSEVIEMLEGDVDGLQLPSRPFFCDDEPLPLLVDSYRFSSELTEISEEDG

SEQ ID NO: 84491 - protein, 451 aa, Solanum tuberosum
MAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIII

SEQ ID NO: 84492 - protein, 70 aa, Arabidopsis thaliana
MRLSVANMKAADVKDVASSITAIANEKLKAEKEAAAGKKKSGKKKQLHVDKPDDDLVSGPYDAMDDDDFM

SEQ ID NO: 84493 - protein, 306 aa, Salmonella enterica subsp. arizonae serovar 62:z4,z23:--
MDIAVIGSNMVDLITYTNQMPKEGETLEAPAFKIGCGGKGANQAVAAAKLNSKVLMLTKVGDDIFADNTIRNLESWGINTTYVEKVPCTSSGVAPIFVNANSSNSILIIKGANKFLSPEDIDRAAEDLKKCQLIILQLEVQLETVYHAIEFGKKHGIEVLLNPAPALRELDMSYACKCDFFVPNETELEILTGMPVDSSDRIRAAARSLVDKGLNNIIVTMGEKGALWMTRDKEVHVPAFNVNAVDTSGAGDAFIGCFAHYYVQSGDVEAAMKKAVLFAAFSVTGKGTQSSYPSIEQFNEYLSLNE

SEQ ID NO: 84494 - protein, 283 aa, Brassica napus
MLVAAASTLFSLSSAVFTRRRSFRVSATLSREPSPLLRAAHHTVDSYVKSGMVVGLGSGEASDLAIRYLGHQLRSGSVQDVVGVPMSARSASEAAKYGVPLKHFRDDFQIDFAFHDADAVEEGTLVSVVGRRRTTQEDDYILRQKSIVKAADEAVFMVKEEQYKSGLEGSIPVLVQSLNWLAIAEEIDDLYLGDAEVWRRASVGDAGPLGGDFPIVTSDGHNILDVIFTTPIPSLANVAKSLDNIDGVVDHGLVIKTRCTVVIAGETEVRTVTLQTSAVEDGV

SEQ ID NO: 84495 - protein, 194 aa, Physcomitrella patens subsp. patens
KLYVGNLPWTCDSAQLAEICGDISSVEAVDVVYDQQSGRSRGFAFVTMSTNEGAQSVIDRLDGSDFGGRPLKVSFPQPRENRDNKPRFGNNERGDRRSDRPPRQGSDRVLDNTNKMFIGNLSWSCDADALVQVFSEYGSVVDAKVVYDRDTGKSRGFGFVTMSAASEVSNAVQNLDGAEFEGREMRVSEAGERP

SEQ ID NO: 84496 - protein, 483 aa, Streptomyces coelicolor A3(2)
MRHRLSELSELSDLSEPSERLPDELRVLNPATEEVVATVPAASAADVDAAVARAARAQTAWAALAPGDRARLLRRFAVTVDEHLEELARLEVRQAGHLLGNARWEAGNVRDLLDYAAGGVERLTGRQIPVAGGLDVTLLEPLGVVGVIAPWNFPMPIAAWATAPALAAGNAVLLKPAETTPLTALRLAELALVAGLPEDLFQVLPGHGPVAGDALVEHPDVAKIVFTGSTAVGRQVAAKGAALLKPVTLELGGKSPNIVFADADVEAAAAATPMSFLDNSGQDCCARTRILVQRSVHDRFLELLAPAIEAVRVGDPADESTEMGPLISRAQLERVRSHVPADAAGIRGRAPRGGPGFWFPPTVLTGVDAHARVAVEEVFGPVAVVLPFDDEADAVRLANATDYGLAGSLWTRDVGRALRVSGAVRAGNLSVNSHASVRYWTPFGGFKQSGIGRELGPDALTAFTETKNVFFSTTPSSTEGPAQ

SEQ ID NO: 84497 - protein, 200 aa, Arabidopsis thaliana
MADQGTEGSQPVDLTKHPSGIVPTLQNIVSTVNLDCKLDLKAIALQARNAEYNPKRFAAVIMRIREPKTTALIFASGKMVCTGAKSEHLSKLAARKYARIVQKLGFPAKFKDFKIQNIVGSCDVKFPIRLEGLAYSHSAFSSYEPELFPGLIYRMKLPKIVLLIFVSGKIVITGAKMREETYTAFENIYPVLREFRKVQQ

SEQ ID NO: 84498 - protein, 725 aa, Zea mays
MATATHHSDAPGLNGAEGMEMMAEANELRRRGKPSDDRTASYGAGAEEDEAAAAAAPSSSSVERAFADQPVPSWREQLTLRAFVVSFFLAVMFSVIVMKLNLTTGIIPSLNISAGLLGFFFVRLWTKAIESVGLLRQPFTRQENTVIQTCVVASYGLSFSGGFGNYLLAMSDKIAAMVTEANNAQNIKNPQLGWIIGFLFLVSFIGLFGLVPLRKIMIVDYKLTYPSGTATAYLINGFHTPQGAKLARKQVKKLGTFFVLSFVWGFFQWFYTANPDECGFQKFPSLGLQAFDNKFFFDFSPTYVGVGMICSHIVNVSILLGAILSWGIMWPLIAKKKGVWFSADLDDNSLHGMQGYRVFIAIALILGDGLYNFLKIFILTVVSLRSQVRKANASTLPISDDGTVTSTAPTSYDEERRNEHFLKDQIPWYAALGGYVAIAAISIGTVPQIFPQLKWYHILVAYIFAPILAFCNAYGNGLTDWSLVTTYGKLAIFAFGAWVGASNGGVLAGLAACGVMMNIVGTAADLMGDFKTGYLTLASPRSMFISQVIGTAMGCVIAPCVFWLFYKAFGNIGVAGSEYPAPNAVVFRSMAVLGVDGFSSLPENCLTLCYVFFAAAIVINLIRDLVPKKVSRFIPIPMAMAIPFYIGAYFAVDMFVGTVILFVWQRLDRAKADTFAPAIASGMICGDGIWVLPQSVLALAKVKPPICMKFLSRAMNDKVDVFLGS

SEQ ID NO: 84499 - protein, 272 aa, Nocardia farcinica IFM 10152
MEVLLHQIDAFADAPFSGNPAAVMPLLSWLPDELLQNLAEENNLAETAFYTSQLPPEAVAPPPDRPVFHLRWFTPRAEVDMCGHATLAAAAQILADIHPGEDRVSFFTRSGWLHVDRTDDDEYVLDLPAVTSVEIDPDPALVAALGVRPVRAYTGVDEVLVVESEREVRQVNPLFGSFPPLARAVIVTAPGEQADFVSRVFAPAVGIPEDPVTGSAHAQLVPLWAARLGGTNFVARQLSRRGGTLRCELVGDRVLLLGRCRRYLDGVVTLPE

SEQ ID NO: 84500 - protein, 420 aa, Blastopirellula marina DSM 3645
MQNVLSVILAGGKGSRLEPLTRDRAKPAVPFGGVYRIIDFALSNCLNSGLRHIQLLTQYKGQSLDRHANTGWQRYFCRELGEFIDVIPPQQRIDEQWYQGTADAVYQNIYAMEKHRPDYVMILAGDHIYKMNYASMIDYHIENGADVTIGALRVSTEEAKSFGVMQVDADQRIVGFEEKSPTPKTIPGDPEHCLASMGIYVFNAHFLFEQLCQDATRRDSAHDFGKNIIPSIIDKQRVFAFPFRDENRKQDAYWRDVGTLDAYFEANMDLITVDPQLNLYDQDWPLRTYQPNVPPPKFVFAGSAQEGRRGCALDSIVCGGSIISGGEVERSIIGANVRVNSFAHVEDSILFEGVNIGRHTRIRRAIIDKGVHIPSGTEIGFDLEMDRRRGFTISSGGVVVIAKGDAVESMVRAEQEQVVV

SEQ ID NO: 84501 - protein, 188 aa, Streptococcus agalactiae NEM316
MLLLVDNYDSFTYNLKQYLSVYKEIFVIKNDDPNLFLLAESAEAIVLSPGPGHPKDAGKILELINQFIGQKPILGICLGHQALAECLGGRLNLANHVMHGKQSWVTINDHTSLFKGIDSPTQVMRYHSLVVTDLPENIAIIARSNEDNEIMAFHCPSLKVYAMQFHPESIGSIDGMKMIENFLTLIND

SEQ ID NO: 84502 - protein, 463 aa, Glycine max
MGAVYFSQSCYKPRQIFNLERESTLVGRCPVVQIRCRRVVSACLNVDVDAPNTGNTTSEKKKTKDVIEMEGMYLVGTYARTPVVLERGEGCKLYDVEGNEYLDLSAGIAVNALGHGDADWLKAVVEQAGTLTHTSNIFHTIPQVELAKRLVASSFADRVFFANSGTEANEAAIKFARKYQRHTTSNGKVPATEFIAFSNCFHGRTLGALALTSKVQYRMPFEPVMPGVTFLEYGNAQAAVELIKQGKIAAVFVEPIQGEGGIYSATKEFLQSLRNACDETGALLVFDEVQCGLGRSGFLWAHEAYGVFPDMMTLAKPLAGGLPIGALLVTERVASAINYGDHGSTFAGSPLVCSAALAVLDKISKPDFLSSVSKKGLYFKELLREKLGENRHVKEIRGVGLIIGIDLDVPASPLVDACRSSGLLVLTAGKGNVVRLVPPLIITEKELEQAAGILCQTLPVLDN

SEQ ID NO: 84503 - protein, 120 aa, Bdellovibrio bacteriovorus HD100
MAKKLYVGNLPYSVDDEALHQHFAQFGAVDSAKVIMDRETGRSKGFGFVEMSDDSAADQAIERGNGIELGGRPINISEARPQAPREGGPRRGGGGFGGGRGGGGGERRGGFGGGGRGGPR

SEQ ID NO: 84504 - protein, 474 aa, Mycobacterium smegmatis str. MC2 155
MTNPEMVEEQPQLRRVMGPGLLLLFVVGDILGTGVYALTGQVAKEVGGAAWLPFLVAFLVATVTAFSYLELVTKYPQAAGAALYAHKAFGIHFVTFLVAFIVMCSGITSASTASRFFAANFFTGLHLDWGKAGVVVLALLFMALIAAVNFRGVSESVKLNVFLTFIEITGLALVILVGLWAFTGGSADIDFSRVVAFDTPSDKGVFLAVSTATSLAFFAMVGFEDSVNMAEETKDPVRIFPKMLLTGLGIAGLVYVVVSIVAVALVPVGVLAGSETPLVEVVKAGAPGLPIETILPFISMFAVSNTALINMLMASRLIYGMARQRVLPPVLGSVHPRRLTPWVAILFTTLIAFGLIFYVSAFANSSAIAVLGGTTSLLLLAVFAVVNIAVLVLRRDLREKGTHFKTPTVLPVIGFIASTYLVLPFSGRPAQQYILAGILIAIGIVLFGITTIINRRLGISSKAQIDPTHLTDAP

SEQ ID NO: 84505 - protein, 1057 aa, Solibacter usitatus Ellin6076
MKRISVVMLLVTAAFSQNRSRLVDYALVLEDPPVAQKVQSRAALKSSEAQAHLAKVRGAQRSVIAELGRRKVQVSSTSQVLVNAVFVRVAAEDSAALKNIPGVKWMQYLPPSKPLLNTALDLVGVPAAWAAIGGSSNAGAGIRIGIIDTGIDQNHPGFQDSSLKPPAGFPAGDAAFTNNKVIVARSYVSLLNDTDPTYSTPDDFSARDRQGHGTAIAMIAAGVQHSAPLGTISGVAPKAFLGNYKVFGAPGVNEYTLFPAWNQALTDAINDGMDIVTLSLGEGDPAIVGPLDVGVAVCGDDICDVRSQAVESATKLGLLVVAAAGNGGDIGTKFPTQNSLNTPGVAPSALTVGASMNRHLLYQRVRVNGSSLGDLRALFGDGPKISSPVNTQVADVATLGNDGQACTALPAGSLTGVYALIQRGTCAYANKINNAQAAGATGVILYNSDGNQDITQRLFAENTGIPAALIGNNDGLALKQYLTANPKGTVTLDPAMQAADNPQVNTVAPFSSRGPSIGNFAATRDFALKPEIVAPGTDVYTATQKFDPNGDTYNATGYTRVSGTSYAVPFAAGVAAMVKAKNPKWTPGQLKSAVVNTATMSDLQGTVHVTDAGAGKLNATDAVSVAATLEPAAISFGAATALPVNRNLTLTNVSGANVTFTLAVRPIFDSPTAHVTLSDTVVSLQPGAFKSIQVSLSGSRPAAGSYEGFIDVTGAGPTLHMPYLYIGGSGVPFNIFPIIDGSFTGVTSDTAWLLAMRVIDPFGVPVANLPVSFRIQSGGGKFNAAGGDKATDVLGNAGVYVDLGPQQGDQIFIGTAGNFTQEFDGFARRPAVIKSGGVVNAATFQAGAGMAPGSYISIFGSDLSDTSFAETTPSLPVSLGQVSVSFDGGGKSLPGHLHFISPGQVNVQIPWEYQGQSSVAMKVTLYGYQSSTPYTVPLTTYSPGIFAVTNAAGAAITAANPAKRGDVIVIYANGLGPVDTPQTSGDPASATKLVGTLAGPVVTIGGTGSTVQFSGLAPGFVGLYQVNVLVPAGAPTGAQTLKLSIGGADVSVNLNVQ

SEQ ID NO: 84506 - protein, 311 aa, Zea mays
  misc_feature (87)..(87): Xaa can be any naturally occurring amino acid
FPVSPPPHLLLCAPRSPGRAHPLPHRRTHPHVGLVPRWRRRCASRGSRGSLCLWTRPSPPPSSGGSGARPPRARTRGRNAGGGGGAXAVRCQTGSTAPPVLRTEEAPAAAAGARNAQAGFTVVMKFGGSSLASAERMREVAGLILSFPDETPVVVLSAMGKTTNNLLLAGEKAVSCGAPKASEIPELAVIKDLHLRTVDELGLDRSIVSGLLDELEQLLKGVAMMKELTLRTRDYLVSFGECMSTRIFAAYLNKLGKKARQYDAFDIGFITTDDFTNADILEATYPAVAKRLHEDWMDDPAIPIVTGFLGK

SEQ ID NO: 84507 - protein, 462 aa, Streptomyces coelicolor A3(2)
MSPGQKEALPVADRTPPLGVEELHALVAAGDIDTVVLAFPDMQGRLQGKRFAARFFLDEVLEHGTEGCNYLLAVDADMNTVDGYAMSSWDRGYGDFAMRADPATLRRLPWNEGTAMAVADLAWEDGSPVLAAPRQILRRQLERLAGHGYTAQVGTELEFIVFRDTYEHAWDANYRGLTPANQYNVDYSVLGTGRVEPLLRRIRNEMAGAGLTVESAKGECNPGQHEIAFRYDEALVTCDQHAVYKTGAKEIAAQEGMSLTFMAKYNELEGNSCHIHLSLADADGRNAMAEGGGMSDVMRHFLAGQLVALREFSLLYAPHINSYKRFQPGSFAPTAVAWGHDNRTCALRVVGHGRSLRFENRLPGGDVNPYLAVAGLVAAGLHGIEQRLELPEPCPGNAYTADFAHVPTTLREAAELWENSTLAKAAFGDEVVAHYRNMARVELDAFDAAVTDWELRRSFERM

SEQ ID NO: 84508 - protein, 235 aa, Chlamydomonas reinhardtii
FPAGLRLLVVDDDPLCLKVVEQMLRKCSYEVTVCSNATTALNILRDKNTEYDLVLSDVYMPDMDGFRLLELVGLEMDLPVIMMSSNGDTSNVLRGVTHGACDYLIKPVRLEELRNLWQHVVRRRRQRKADAAGQRERRVGPLGGGACVRRVNRAQPSKLNQGHVQRERGRGRVGKAPLLNGSNKKARVVWSVEMHQQFVNAVNQLGIDKAVPKKILEIMGVDGLTRENVASHLQK

SEQ ID NO: 84509 - protein, 263 aa, Oryza sativa Japonica Group
MAGLGKAFYAVGFWIRETGQALDRLGCRLQGNYYFHEQLSRHRTLMNIFDKTPHVHRDAFVAPSASLIGDIQVGQGASIWYGCVLRGDANNVQIGSGTNIQDNSLVHVAKSNLSGKVFPTIIGDNVTVGHSAVLQGCTVEDEAFVGMGATLLDGVVVEKHGMVAAGALVRQNTRIPCGEVWGGNPAKFLRKLTDDEITFIKESASNYSTLAKAHAAENAKPVEKTEFEKLFRKKSAHQDEEHDSMIGATREVTPELTPSSSAQ

SEQ ID NO: 84510 - protein, 434 aa, Zea mays
MPTATPIAANRGYTSGRTQGLAIRLGRGRDGEGRGKWREAKRRPRAEFGTRENPNFPAAAFLSLDPQLAPFLQVRTHRPAYALPPNDLRAAMANSAAPGGMRSFLQAVSTVTEEAPTPLRVVQMEGLAVLKIIKHCEEFAPALVTGQLLGLDVGSVLEVTNCFPFPIREEDDEADADGANYQLEMMRCLREVNVDNNTIGWYQSCLLGSFQTVELIETFMNYQESIRRCVCIVYDPSRSSQGVLALKALKLTDSFMDLYRNNGLTGEKLREKKLSWVDIFEEIPIKVSNSALVSAFMKELEPESPVTQCDLDRLKLSTAPFMERNLEFLIGCMDDLSSEQNKFQYYNRNLSRQQSQQQAWLQKRRQENMARKAAGEEPLPEEDPSNPIFKPIPEPSRLEGYLVTNQICSYCNHINGVAGQNFDRLYLMKALHED

SEQ ID NO: 84511 - protein, 445 aa, Bacteroides fragilis NCTC 9343
MNIEKIMSSLEAKHPGESEYLQAVKEVLLSIEDIYNQHPEFEKAKIIERLVEPDRIFTFRVTWVDDKGEVQTNLGYRVQFNNAIGPYKGGIRFHASVNLSILKFLGFEQTFKNALTTLPMGGGKGGSDFSPRGKSDAEIMRFCQAFMLELWRHLGPDMDVPAGDIGVGGREVGYMFGMYKKLTREFTGTFTGKGLEFGGSLIRPEATGFGGLYFVNQMLQTKGIDIKGKTVAISGFGNVAWGAATKATELGAKVVTISGPDGYIYDPNGISGEKIDYMLELRASGNDIVAPYADEFPGSTFVAGKRPWEVKADIALPCATQNELNGEDAKNLIDNNVLCVGEISNMGCTPEAIDLFIEHKTMYAPGKAVNAGGVATSGLEMSQNAMHLSWSAAEVDEKLHSIMHGIHAQCVKYGTEPDGYINYVKGANIAGFMKVAHAMMGQGII

SEQ ID NO: 84512 - protein, 178 aa, Chlamydomonas reinhardtii
MASITCSSGKAAVVSRAKTARPVARRMSVVASAAPQGNASRRELLGLSAVAASLLLSSRPAHAIFGFADDNTALFDTYTAETSAILDKVKVTLALDKDDPAKEDSVKGLRKDINNWVAKYRREPKVSGKPSFGNTYSALNALAGHFNSFGATAPIPKKRLERLQKELDDATLLLTRNR

SEQ ID NO: 84513 - protein, 887 aa, Oryza sativa Indica Group
MAPAAHRDGAAEAVGQRVFHFGKGRSDGNKTMKDLLGGKGANLAEMASIGLSVPPGFTVSTEACQQYQAQKAMPAGLWDEILAALTWVEGNMGAVLGDPRRPLLLSVRSGAAVSMPGMMDTVLNLGLNDHVVAGLAHRSGERFAYDSYRRFLDMFGNVVMDIPHSLFEEKIEAMKAALGLRNDTELTARDLKELVAQYKNVYVEAKGEEFPSDPKKQLHLSVLAVFNSWDSARAKKYRSINQITGLKGTAVNVQCMVFGNMGDTSGTGVLFTRNPSTGERKLYGEFLVNAQGEDVVAGIRTPQDLDTMKDCMPEPYAELVENCKILESHYKEMMDIEFTVQENRLWMLQCRTGKRTGKGAVKIAVDMVNEGLIDRRSAIKMVEPRHLDQLLHPQFESQSSYGDKVIATGLPASPGAAVGQIVFTADDAEAWHAQGKSVILVRTETSPEDVGGMNAAAGILTARGGMTSHAAVVARGWGKCCVAGCSGIRVNDAEKVVLVADKVLCEGEWLSLNGSTGEVILGKLPLSPPALSGDLGEFMSWVDEVKKLKVKANADTPADALTARNNGAEGIGLCRTEHMFFSSDERIKAMRQMIMAETIEHRQIALDRLLPYQRLDFEGIFRAMDGLPVTIRLLDPPLHEFLPEGNVEDMVRLLSSGNVYTQEEILTRIEKLSEVNPMLGFRGCRLGISYPELTAMQARAIFEAAISMTEQGVKVFPEIMVPLIGTPQELAQQVDVIREVAEKVFANAETTISYKIGSMIEVPRAALIADEIAALAEFFSFGTNDLTQMTFGYSRDDVGKFLPTYLSKGILQNDPFEVFDQKGVGELVKVAVERGRKARPDLEVGICGEHGGEPSSVAFFAKVGLNYVSCSPFRVPIARLAAAQVIL

SEQ ID NO: 84514 - protein, 439 aa, Shewanella oneidensis MR-1
MSKSENKIGVVQLTIITIVNMMGSGIIMLPTQLAQVGTISVLSWLVTAAGSTALAFAFAKCGMFSKKSGGMGGYAEYAFGRSGNFMANYTYAVSLLIANVAIAISAVGYAAVLLEVNLSPMAICLATIGVLWLATVANFGGARITGRVSSVTVWGIILPVIGVSLIGWFWFDIDLYKGAWNPHDMPFFKALGGSIAMTLWAFLGLESACANSEAVDNPEKNVPIAVMGGTLGAALIYIVSTNVIAGIVPNAELASSNAPFGLAFAQMFNPVVGKIVMACAIISCTGSLLGWQFTIAQVFKASADEGFFPKVFAKVSKADAPIWGMTIIVSIQTLLSLMTISPSLSKQFEALVNLAVVTNIVPYILSMAALGVMQKQLKVPANKARVANVIAVIGALYSFYALYSSGETAVMLGAIATFFGWTIYGVISNKTPSVEIKAA

SEQ ID NO: 84515 - protein, 365 aa, Methanothermobacter thermautotrophicus str. Delta H
MKFYEYSAKEIFRAEGISTPRGGVAETPEEAERIAAELGCDVAVKSQVLTGGRGKAGGIRFASPSGVAEVTGDLLSSEVRGETVEKVLIEEKIPIDRELYVSAVIDRTAKMPLIMASAEGGVDIEELAARSPEKIVRYHINPLDEFLPYEAREIARKMGLESELIPSVGGVIWKLYQLFRKYDARLAEINPLVISGDSVIAADAKLEVDDDSIYRHREFMEMEEYEPEEFAFVKLDGDIAVIGNGAGLTLTAMDLIKLNGEPATFLDIGGGASEDVIRRALDLVISHPSVRVVFLNVLGGITRADDVARGVVNALRDARRDVPLVIRLTGTNEEEGQRILREAGIPFETSLERAAEKAVEIAKNL

SEQ ID NO: 84516 - protein, 441 aa, Streptomyces coelicolor A3(2)
MRVSVFGLGYVGCVSAACLAGMGHQVVGVDVNQAKVDLVNDGKAPVVEERIGELIAEVVGSGALRATGDVREAIMESEISLVCVGTPSEPNGSLCTTYLERVTEEIGTALAERGGGGGRHTVVFRSTMLPGTCANLLVPILEKYVGGTAGVDFGVAVNPEFLREGTSVRDFFDPPKTVIGELDAAGGDAVLALYDSLPGEVFRVPVATAEAIKYADNAFHGLKIGFANELGAVCHALGVDSHQVMDVFLADRKLNISPAYLRPGFAFGGSCLPKDLRSLVHAAQRADVSVPILSHVLPSNSAHLERAVELVERTGKRRVGMFGLSFKPGTDDLRESPLVELAERLFGKGYDLRIHDANVSLSRLLGANREYVETRLPHLAQLLADSVDEVLDHAEVCLVGTRDPAVLSALPHGAGPLLIDLIHLPDADTRRTEPGYMGLAW

SEQ ID NO: 84517 - protein, 392 aa, Legionella pneumophila subsp. pneumophila str. Philadelphia 1
MDIALAKRVQKVKPSPTLAVAAKAAQMKAQGLDIIGLGTGEPDFDTPQHIKLAAISAIEAGDTKYTAVDGIVELKEAVKNKFKRDNELDYQLNQILVSVGGKQSCYNLCQAYLNPGDEVIIPAPYWVSYPDMVLLADGVPVIIETTPAQRYKINAQQLEQAITPKTRMIFLNSPSNPSGIAYTQNELKELGDVLKKHPQILIATDDMYEHIIWSQPFTNILNACPELYDRTIVLNGVSKAYAMTGWRIGYAAGPAPLINAMKTIQSQSTSNPCSIAQRAAVAALNGSNESIEEMVNAFHQRHDYVADRLQSIDGIEVIPADGTFYIFPSVQAIIEKRGYANDIEFSEKLLNEVGVALVPGSAFGTEGCIRISFATGIDTLKDALNRLQRFCS

SEQ ID NO: 84518 - protein, 530 aa, Streptomyces ambofaciens
MTVLNDVPQVSAALVGARGRVAELHGIRAQAVAGPSEKATAAQHAKGKLTARERIALLLDEGSFQEVEQLRRHRASGFGLEAKKPYTDGVVTGWGTVEGRTVFVYAHDFRIFGGALGEAHATKIHKIMDMAIAAGAPLVSLNDGAGARIQEGVSALAGYGGIFQRNTRASGVIPQISVMLGPCAGGAAYSPALTDFVFMVRDTSQMFITGPDVVRAVTGEEITQNGLGGADVHAGTSGVAHFAYDDEETCLAEVRYLLSLLPQNNREYPPCVPCSDPAGRRGEALVDLVPADGSRPYDMTEVIGEIVDDGEYLEVHEGWARNIICALSRLGGQVVGIVANQPSALAGVLDIEASEKAARFVQMCDAFNIPVITLVDVPGFLPGVDQEHGGIIRHGAKLLYAYCNATVPRISLILRKAYGGAYIVMDSQSTGADLTFAWPANEIAVMGAEGAAGVIFRRQIAAAPDPEAMRQKMVKEYRAELMHPYYAAERGLVDDVIDPAETREVLIRSLAMLRTKHADVPSRKHGNPPQ

SEQ ID NO: 84519 - protein, 814 aa, Yarrowia lipolytica CLIB122
MTDNTEESKRLIDNSGAAENADDSLATAILRKKKKDNALVVDDATNDDNSIICMSPATMDLLQLFRGDTVLVKGKKRKDTVLIVLADEELEDGVCRINRCVRGNLRVRLGDVVSVHPCPDIKYATRISCLPISDTIEGLTGSLFDVFLKPYFVEAYRPVRKGDLFTVRGGMRQVEFKVVDVDPPEYAIVAQDTVIHCEGDPIEREDEEGNLNEVGYDDIGGVRKQMAQIRELVELPLRHPQLFKSIGIKPPKGILMYGPPGTGKTLMARAVANETGAFFFLINGPEIMSKMAGESESNLRKAFEEAEKNSPAIIFIDEIDSIAPKRDKTNGEVERRVVSQLLTLMDGMKARANIVVIAATNRPNSIDPALRRFGRFDREVDIGIPDPTGRLEILRIHTKNMKLGDDVDLETIAAETHGYVGSDIASLCSEAAMQQIREKMDLIDLEEETIDAEVLDSLGVTMENFRFALGNSNPSALRETVVQSVNVTWEDIGGLDGIKQELKETVEYPVLHPEMYTKFGLSPSKGVLFYGPPGTGKTLLAKAVATEVSANFISVKGPELLSMWFGESESNIRDIFDKARAAAPCVVFLDELDSIAKARGGSVGDAGGASDRVVNQLLTEMDGMNAKKNVFVIGATNRPDQIDPALLRPGRLDQLIYVPLPDEAGRLSILKAQLRKTPLEPGLSLQELAKSTHGFTGADLSYIVQRSAKFAIKDSIEAAITAQREAEAAGNEDVEMEDPVPYITRAHFEEAMKTAKRSVSDSELRRYEAYAQQIQSSRGNIGFRFSEDAAGEAAAADAGAGTAFGADQEDDLYN

SEQ ID NO: 84520 - protein, 248 aa, Bacillus licheniformis ATCC 14580
MIICKTPREIEIMREAGRIVALTHQELKKHIKPGISTKELDQIAERFITKQGAIPSFKGYNGFRGSICVSVNEELVHGIPGKRVLRDGDIISIDIGAKLNGYHGDSAWTYPVGTISDDDQKLLDVTEESLYRGLKEAKPGERLSNISHAIQTYVESEQFSVVREYVGHGVGQDLHEDPQIPHYGPPNKGPRLKPGMVLAIEPMVNAGTRYVKTLADNWTVVTVDGKKCAHFEHTIAITDAGFEILTKA

SEQ ID NO: 84521 - protein, 349 aa, Hordeum vulgare subsp. vulgare
MSDNSIQRALVPDNHNADVLQRKPLEGAKRFRRSRSAPRSEADQKPEENGSSPPAKELLSVIRPSFRLAGLLLFLYLLAGVVVFYLVMDQLSGKRTNRVLDALYFCIVTMTSVGYGDLVPNSDTAKLLACVFVFTGMAIIALFVSKSADYLVEKQEVLFFKALHMNMKCSEAKMLRQIETNKTKYKFYTAALLLMTTIVVGTVFLWKVEKLSLVDSFYCVCATITTLGYGDKSFSSKLGRTFAVFWIITSTIILALFFMYLAEIYTERRQKMLAKWVLTRRITNMDLEAADLDNDRKVGAAEFVVYKLKELGKISQEDISCFLEEFEKLDVDQSGTLSTYDLTQAQSGQ

SEQ ID NO: 84522 - protein, 164 aa, Cucurbita pepo
DRGEMMSMVYNWPADQVDVIVVTDGSRILGLGDLGVHGIGIAIGKLDLYVAAAGINPQRVLPVMIDVGTNNEKLLKDPLYLGLQQNRLDGDEYLAIIDEFMEAVFTRWPHVIVQFEDFQSKWAFKLLQRYRNTYRMFNDDVQGTAGVAIAGLLGAVRAQGRPMI

SEQ ID NO: 84523 - protein, 213 aa, Physcomitrella patens subsp. patens
MEVSAGSGEDDVAAPVAEEQLGSKVYVGNLPWTCDSAQLAEICSQHGTVDVVEVIYDKLSGRSRGFAFVTMASHDDAQALINALDGSDMGGRALKVNFPQSQKDKPRFEKSEARPPTADRRPRDDPNKLFVGNIPWGCDEAAMTSLFSPYGSVVDAKIVYDRDSGRSRGFGFVTMEKVGDAQTAMENLDGTELDGRELRVNFAGEKPPSRYRG

SEQ ID NO: 84524 - protein, 304 aa, Erythrobacter sp. NAP1
MTADTPLQDQAKGLSKAEVLIEALPYFQRYAGRTFVVKYGGHAMGEPKAARDFAEDIVLLKAVGINPVVVHGGGPQIGEMLARLGVESTFIDGLRVTDEATAKVAEMVLSGAINKELVGWLSNAGGKALGLSGKDGGLVTARKVSRTARDPESLIEKAVDLGFVGEPAHVDTSVIDTAVAAGMIPVIAPIAGGEDGATYNINADTMAGAIAAALGAARLFLLTDVAGVLDVEGQLISDLTPADIAKLKDEGVIKGGMVPKLETCVSAVESGCEAAVVLDGRVPHAMLLEFFTARGAGTLVKADQ

SEQ ID NO: 84525 - protein, 223 aa, Streptococcus agalactiae NEM316
MNLQENKTAIFDNVSKLALKAGRAPESVHIVAVTKYVNCQTTEALIRTGVNHIGENRVDKFLEKYQALKDEKLTWHLIGSLQRRKVKDVINYVDYFHALDSVKLAAEIQKRAQKPVKCFLQVNISREDSKHGFTIEQIDDALNLISRYDKIELIGIMTMAPLKATKEEISSIFEETESLRKRLQARNIERMPFTELSMGMSRDYDIAIQNGSTFVRIGTSFFK

SEQ ID NO: 84526 - protein, 401 aa, Blastopirellula marina DSM 3645
MSHRFSSVQSAVDAISRGEIVIVVDAEDRENEGDFVAAAEKITPESVNFMITHGRGMLCAPVLPDVCQRLDLHPIVETNNAPLQTSFITPVDHHTSKTGITAKERSDTIQALADPQTTVDDFVRPGHVYPLLAKEGGVLRRAGHTEASVDLARMAGLRPAGVLCEILDEAGDRADRDQLIELAEKFKLEIISIEQLIAHRRVNEKLVSRAAEADLPTKYGQFKIIVYSVEYETQEPVVLIFGEPEKQERPLVRLHSSCFTGDLISSLRCDCGDQLQMALETISKEGHGALVYLPQEGRGIGLTQKIRAYGLQDHGLDTVEANHALGFKADMRDYGIGIQILKDIGLRQIRLLTNNPKKTDAFIYGGFDLEVVDQVPMASPVNEFNEKYLATKRDKMGHTLP

SEQ ID NO: 84527 - protein, 549 aa, Escherichia coli
MKNINPTQTAAWQALQKHFDEMKDVTIADLFAKDGDRFSKFSATFDDQMLVDYSKNRITEETLAKLQDLAKECDLAGAIKSMFSGEKINRTENRAVLHVALRNRSNTPILVDGKDVMPEVNAVLEKMKTFSEAIISGEWKGYTGKAITDVVNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLVALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDDKEISSHDSSTNGLINRYKAWRG

SEQ ID NO: 84528 - protein, 445 aa, Vitis vinifera
  misc_feature (414)..(414): Xaa can be any naturally occurring amino acid
MDTHSTHPTAPVRSRSSQSPSHSASASASASATSSIHKRKLTSDDHAPPFSADITSNDDLDSISARAGGHGSDSDDDSEEDAVVDDEEDDFDNESMRTFTTARLDNSATASAAVRNTKIKPENSTVKVESSEIGKDGGSSAAAPVGTSSVPAIVVKEDATKIFTENMQTSGTYCAREESLKREEEAGRLKFVCLGNDGVDQHMIWLIGLKNVFARQLPNMPKEYIVRLVMDRSHKSVMVIRRNQVVGGITYRPYVSQKFGEIAFCAITADEQVKGYGTRLMNHLKQYARDIDGLTHFLTYADNNAVGYFIKQGFTKEISLEKDRWQGYIKDYDGGILMECKIDPKLPYTDLSTMIRRQRQAIDEKIRQLSNCHIVYTGIDFQKNEVGIPRRIIKVEEIPGLKNHVSSCCSSACXHRRLGGLLINMAILDLEQQVPLRIEHRIENP

SEQ ID NO: 84529 - protein, 451 aa, Nocardia farcinica IFM 10152
MANPLELIDDLSPSRRALNADEIDAAAKRISDIIEPTPLQLSPRLSAATGARVYLKREDLTAVRSYKLRGAYNLIVQLDERERAAGVVAASAGNHAQGVAFACQAMGIQGRIYVPTTTPKQKRDRIRVHGGQFVELIAVGDTYDAAAAAAAADVERTGATMVAPFDDPRTAAGQGTIAVEILEQLGAAPDLVVVPVGGGGCLAGIGTYLRDRSPATGILAAEPAGAASMTAALIAGGPVTLPEIDPFVDGAAVRRVGALPYAAAVGFGGRVVTHASLPLLTAVDSPQGHGAFRLLQVDEGAICTTMLELYQNEGIIAEPAGALAVAALAEVDVEPGSTVVCLISGGNNDVSRYGEIIERSLVHQGLKHYFLVDFPQEPGALRRFLDEVLGPDDDITLFEYVKRNNRETGAALVGIELGAADGLDALLERIAASPIQCERLEPGSPAYRYLT

SEQ ID NO: 84530 - protein, 411 aa, Methanothermobacter thermautotrophicus str. Delta H
MMVIPVSFKFKTMDDIEVTGKTVLVRVDINSPVDPNDGTILDDTRMRLHAETIRELSDRGARTVVMAHQSRPGKNDFTTLEQHARALSGILRRPVKYVEDIFGSAARENISGLGDGEIILLENVRFYSEEVLKRDPEEQAETHLVRKLAPLLDYFINDAFAAAHRSQPSLVGFALRVPSAAGRVMERELRTLQGALENVERPCVYVLGGVKVDDSIMVMKNVLENGSADLVLTTGLVANIFLAGCGVKIGKVNMDFIKSRGYCDFIKVAKKLKKRFPERIVVPVDVAVCRDGKRVDVPVKKIPNHPIQDIGMETIKLYARRIREARTLFANGPAGVFENPDFSIGTEDILNAISSSEGFSIIGGGHLAAAAVKMGFEDSINHISSGGGASISLLAGEELPAVRVLEESRHP

SEQ ID NO: 84531 - protein, 508 aa, Oryza sativa Japonica Group
MQMQQRRKPPPAAAPVAAKQPSPRRTPGPLSFAGALLSLLVVATFLYINDHGNMMPPHASPDPDLRLLQEAAHQKVNSILLSRHAPAPPPRTNTNTSSSDQHLRLINIPMSSDLDLELGGNSTSSSGVEIQFEQQQQQEEKNLRGCELYKGRWVYDAAGREAPLYRESECGFLTEQVTCMRNGRRDDSYQRWRWQPEGCDLPSFDARALLERLRNKRMMFVGDSLNRNQWESMVCLVQSAIPYGQKTLTKFVNNGSLNVFRAHEYNATVEFYWAPFLVQSNSDDPQVHSVRDRVIAWRSIAKHAANWKGVHYLVFNTYIWWLNNFQIKVLKSRGAPFAGSGGWSSRYALVDRAIAYREVLKTWAKWVDRRIDPNKTHVFFMAMSPNHFMPEAWGGSAGAVKCAMETQPIVNRTSGGLDIGTDWRLHGVARGVLRSMRRVGVRFVDITALSELRKDAHTSVHTLRQGKLLTPEQQADPRTYADCIHWCLPGLPDTWNHFLYAHIVAHAA

SEQ ID NO: 84532 - protein, 354 aa, Arabidopsis thaliana
MSCSSSSGSEEDDEGFDAYRKGGYHAVRIGDQFAGGRYIAQRKLGWGQFSTVWLAYDTRTSNYVALKIQKSALQFAQAALHEIELLQAAADGDPENTKCVIRLIDDFKHASPNGQHLCMVLEFLGDSLLRLIKYNRYKGMELSKVREICKCILTGLDYLHRELGMIHSDLKPENILLCSTIDPAKDPIRSGLTPILEKPEGNQNGTSTMNLIEKKLKRRAKKAAAKISGRRVSIVGLSETPKKNKRNLDGIDMRCKVVDFGNGCWADNKFAEEIQTRQYRAPEVILQSGYSYSVDMWSFACTAFELATGDMLFAPKEGNGYGEDEDHLALMMELLGKMPRKVRDQRITLTDTAT

SEQ ID NO: 84533 - protein, 415 aa, Solibacter usitatus Ellin6076
MRKLLSRFRYHLVVFFAVLGPGFITAVVDNDSGGIFTYSAAGARFGYLPLWTLLPITIVLIITQEMCSRMGAVTGKGLSDLIREEFGLRITFLLMGVLVLANMTNVMAEFAGVASSLELFHISRYISVPLAAIAVWFVVVKGNYQSVEKIFLFACVFYVTYVISGFLVKPDWKEAAINSVKPVLMLEPGYIYMLIGMVGTTIAPWMQFYLQAAVVEKGITAKEYKQSRVEVVVGCIMTSVIAFFIIVACAGAIYTVRPRDIQDASEAALGLKPFGEYAFLLFSAGLFNASIFAACILPLSTAYSVCEGLGFEAGVNKRMKEAPIFYGLYTLLIAVGAGVILIPKFPLVQMILLSQVLNGILLPFVLIFMVLLINKHELMGEWTNSRAANLVSWITVVIMIGLTLALVGITVRGMH

SEQ ID NO: 84534 - protein, 499 aa, Aspergillus oryzae
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCLIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMHDLYNMINTVKSDCPDSTLLGTFVENHDNPRFASYTNDIALAKNVAAFIILNDGIPIIYAGQEQHYAGGNDPANREATWASGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 84535 - protein, 469 aa, Solibacter usitatus Ellin6076
MSPISIEICSPATGELLGKVPDFDAEAVDCAVAAARASFENKTWRGLDPSKRERILWNIGELLLKYRDELSRLISQETGKTLREAAGADVAPAADCFHYYAGWVRKQYGETIPVDGPYLNYTLREPVGVVGAIVPWNFPLQTAAWKVAPALACGCSVVLKPSELTPLSALRFGEICAEAGLPAGVLVVATGYGETTGEALALHEDVDKISFTGSVTTARKLLQNSAVSNLKRLSLELGGKSPNIVFPDADFDAAVRAALWGIYGNKGEMCTAGSRLLLHEEIHDRFVEELASKARKLRLGNPLDPATQMGPQISGRQLDRILDYIEAGKTEGARLVCGGERDTEGDKAHGFFVKPTIFAGVHPDMRIAREEIFGPVLSVMRFRDAEEAVRIANATTYGLASAVWTNDLKLAHRMAAALKAGSVWVNTYNAFDSGSPFGGYKQSGFGRDLGSYALDQYTNVKSVWIALGK

SEQ ID NO: 84536 - protein, 466 aa, Streptococcus thermophilus CNRZ1066
MKKMSQKQHHNDDDNQIKNGMVRGLQNRHVQLIAIAGTIGTGLFLGAGRSISLTGPSIILVYMLTGVLMYLMMRAIGEMLYMDPDQHTFINFITKYLGKGWGFFSGWSYWVSLVFLGMAEITAVANYVQFWFPSWPAWQIQIVFLFILSSVNLIAVKIFGEVEFWFGMIKIITILALIATGIFMVVTNFETPAGHASLINITQGFQMFPKGWVSFAMAFQMVFFAYQAIEFVGITTSETANPRKVLPKAIKEIPVRIAIFYVGALIAIMAIFPWQKLPVNESPFVMVFQMAGIKWAAALINFVVLTAAASSLNSTLYSTGRHLFQIAKETPNSKVMKSLKLDTLARNGIPSHAIIVSAIVVCISAFINVLPGVSDAFALITASSSGVYIAIYILTMLAHLKYRKSQEFMADGFLMPAYKILNPLTIAFFVFVFVCLFLQKSTVVGAIGSVIWIVVFGIYSNLKYSK

SEQ ID NO: 84537 - protein, 502 aa, Rhodococcus sp. RHA1
MTVLDTAPHTLQFVPVADRILVAGQWRQANGPAFAVTDPSTGETLQVIHQATADDADEAVRKGRAAADDPAWRALLPHQRAKYLHRIADAIEANTSRLALLQSYNTGKTVAETTALVGSAAGTFRYFAAVLETADDDLTTPRGNFLTMSVLEPIGVVGAIAPWNSPVASDAQKIAPALAAGNAVVLKPAEWTPLVSLELARLIDQTQLPAGLLSVLPGKGSVVGDAIVTHPGVGKVTFTGGTNTGRSIAHAAADKLMPVSLELGGKSPTIVLDDADLDAAVNGVMYGIFSSTGQSCIAGSRLFVDRRIYDEFLEKLVAKTQQLRLGPGRDPGTQVGPMVHRKHRDSVAAYVDLAREEGGRVLCGGAIPDDERLRDGAYYLPTIIDGLANSSRTCQEEIFGPVLVVLPFDGDADLVAQANDSVFGLASGIWTGDYRRAWKLARRLQAGTVWINTYKQFSISTPFGGVKESGLGVEKGRSGIAAYSRQKSIYWGLDEEPNPWAE

SEQ ID NO: 84538 - protein, 484 aa, Shewanella oneidensis MR-1
MKFKQDFFTQLPEFYSQVYPQGISNPHWLAWSDDAAALIGLHQPTDELLQGLSGNAAVEGASYYAQVYSGHQFGGYTPRLGDGRSIILGEAIGPNGAWDVALKGGGPTPYSRHGDGRAVMRSAVREFLVSEALHHLGVPTTRALAVIGSDMPVWRESQETAAITVRLARSHIRFGHFEFFSHSERGQADKLTQLLNFTLKQHYPHLSCDPAGYKAWFLQVVQDSAKMIAHWQAIGFAHGVMNTDNMSILGDSFDFGPFAFLDTFQEDFICNHSDPDGRYAFGQQPGIGLWNLQRLAQALTPVIASDDLIAALNQYQHALVQHYLALMRAKLGLVQQADSSAEQDQQDLELIGRFTVLMEKNQLDYSHTWRRFGQLDPSSLHSSLRDDFIDLNEFDAWYQVYQARLGKVTDVEAWQQQCNRVNPKYILRNYLAQEAIIAVDEGNLAQLQRLHQVLRQPFTEQIEHEELAKRPPDWGQGLIMSCSS

SEQ ID NO: 84539 - protein, 446 aa, Escherichia coli
MISEHDSVLEKYPRIQKVLNSTVPALSLNSSTRYEGKIINIGGTIIKARLPKARIGAFYKIEPSQRLAEVIAIDEDEVFLLPFEHVSGMYCGQWLSYQGDEFKIRVGDALLGRLVDGIGRPMESNIAAPYLPFERSLYAEPPDPLLRQVIDPPFILGVRAIDGLLTCGIGQRIGIFAGSGVGKSTLLGMICNGASADIIVLALIGERGREVNEFLALLPQSTLSKCVLVVTTSDRPGLERMKAAFTATTIAEYFRDQGKNVLLMMDSVTRYARAARDVGLASGEPDVRGGFPPSVFSSLPKLLERSGPAPKGSITAIYTVLLESDNVNDPIGDEVRSILDGHIVLTRELAEENHFPAIDIGLSASRVMHNVVTSEHLRAAAECKKLIATYKNVELLIRIGEYTMGQDPEADKAIKNRKLIQNFIQQSTKDISSYEKTIESLFKSGA

SEQ ID NO: 84540 - protein, 353 aa, Coxiella burnetii RSA 493
MGAEKATVKETLLLLKIQSIIYNRLMLNRRISIAPMMGCTDRHFRMFMRQISRHVLLYTEMVTTGALLKGKQWRCLDYSPEEHPLALQVGGSDPQSLALCARLAEEKGFDEINLNVGCPSGRVIAGRFGACLLKEAELVADCVAAMSAEVNIPVSVKTRTGVDDQDSYEHLYHFVKTVAEAGCRIFIIHARKAWLKGLSPAENRTVPPLAYPMVYQLKQDFPGLEIIINGGIKTIEAINDHLREVDGVMIGREAYANPLFCAAFDDLSKPVFSLGVADKKQTPLTPKRVLLRYLPYMAKQLANGVPLYAMTRHLNGLFQGQPGAKKWRRFLHENTRREGPIAAIEEALRLASP

SEQ ID NO: 84541 - protein, 165 aa, Bdellovibrio bacteriovorus HD100
MKDKRINTKDLIEKIEKMTKARIASQEVVPLDQFREAKKKLDPKIILVIEDDETMRLAMKRILESEGYVTKLAADGTELSTVLDDHSVDLILMDVGLPWINGFELAQLLKEHRDLKKIPLVFVSGKASEEDMKKAFEIGADDYIKKPFDVEKLKKTVETLLKLNP

SEQ ID NO: 84542 - protein, 176 aa, Cucurbita pepo
RVGLSGKGIPVGKLSLYTALGGVRPSACLPITIDVGTNNEKLLNDEFYIGLKQRRATGEEYYELLHEFMTAVKQNYGEKVLIQFEDFANHNAFELLAKYRTTHLVFNDDIQGTASVVLAGAVSALKLIGGTLADHTFLFLGAGEAGTGIAELIALEISKQTNAQLRRPARRFGWWT

SEQ ID NO: 84543 - protein, 149 aa, Zea mays
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGLADWQSSQHPWIYEK

SEQ ID NO: 84544 - protein, 193 aa, Cucurbita pepo
TRVIVEKPFGRDSDSSGELTRSLKKYLTEDQIFRIDHYLGKELVENLSVLRFSNLVFEPLWSRSYIRNVQLIFSEDFGTEGRGGYFDNYGIIRDIMQNHLLQILALFAMETPVSLDAEDIRNEKVKVLKSMRPLQLEDVVVGQYKGHSKGGKSYPAYTDDPTVPNDSITPTFAAAAIFVDNARWDGVPFLLKA

SEQ ID NO: 84545 - protein, 122 aa, Arabidopsis thaliana
MALRNAILRHLRVPVQTLGLNQSKIGFLGTIRSFSSHDDHLSREAVVDRVLDVVKSFPKVDSSKVTPEVHFQNDLGLDSLDTVEIVMAIEEEFKLEIPDKEADKIDSCSLAIEYVYNHPMSS

SEQ ID NO: 84546 - protein, 483 aa, Oryza sativa Japonica Group
MAYQGIDLLSTKAAGDDHGENSSYFDGWKAYDTNPFDLRHNRGGVIQMGLAENQLSLDLIEEWSKNHPEASICTPEGVSQFKRIANFQDYHGLPEFRKAMAQFMGQVRGGKATFDPDRVVMSGGATGAQETLAFCLANPGEAFLVPTPYYPAFDRDCCWRSGIKLLPIECHSFNDFRLTKEALVSAYDGARRQGISVKGILITNPSNPLGTITDRDTLAMLATFATEHRVHLVCDEIYAGSVFATPEYVSIAEVIERDVPWCNRDLIHVVYSLSKDFGLPGFRVGIIYSYNDAVVAAARRMSSFGLVSSQTQYFLARMLSDEEFIGRFLQESKCRLVARHERFTSGLREVGIGCLRGNAGLFSWMDLRRMLREKTAEAELELWRVIVHQVKLNVSPGTSFHCREPGWFRVCHANMDDETMEVALGRIHDFVRQHQQRRVKAERWAANRQLRLSLPHHHHLSPAHLSSPLALLSPQSPMVRATS

SEQ ID NO: 84547 - protein, 472 aa, Physcomitrella patens subsp. patens
MSPKKGRNENIKEEARRQCAGSSPTTFSAKYVPFTPGMESDESYSLDEVIYRSKTGALLDVQHDMEALKKAGDGAYWRKLFDSRVGKTTWPYGSGVWSKKEWVLPEIDDDDIVSVFEGNSNLFWAERFGKEELEMTDLWVKHCGISHTGSFKDLGMTVLVSQVNRLRRLGKPLLGVGCASTGDTSAALSAYCAAAGIPAIVFLPANKISIAQLVQPIANGALVLSMDTDFDGCMRLIREVTSELPIYLANSLNSLRLEGQKTAAIEILQQFDWEVPDWVIVPGGNLGNIYAFYKGFYMCKELGLVDRMPRLVCAQAHNANPLYRAYKDGWENFKAVKALPTFASAIQIGDPVSIDRAIYALNQCDGIVEEATEQEIMDVCAQADKSGMFTCPHTGVALVALQKLRASGVIGPHDRTVVVSTAHGLKFTQSKVEYHSSELPDITSQFANPPISVADDFGSIMDVLRQKLSLKG

SEQ ID NO: 84548 - protein, 576 aa, Magnaporthe grisea 70-15
MQEPTIYRAPVTSADPGDQPTSDEITGYQNMTVIDSAPEKSDDGYRDFVIPEDRKLGVFSTTLLIINRVVGTGIYSTPSAIITNTDNVGATLLFWVLGGMMTFALFVYLEFGTALPRSGGEKVYKDCTHTFSCGIVVQLERVYQKPRYLATCIFAVQFVLFAVSTGNTISFASYIFKAALGDTASIENGATSDVRTRSIAVGAITLVCLIHAFLPKTGIWLSNILGCFKLVLLLLVVCAGFAALNGHIANPALRPDNFSTFQGQGTIMKAPDTKAAGSYAIALLQVLYAYSGWENANYVLTEVRDAPRTLKIAAPMAIASVTLLYVLANIAFFAAMSKQQIADSKVIVAAAFFENVWGEGTFTKRVVPIFIALSALGNVFAQSFAMPRVKQELAKEGILPFSRVFASDWPFKAPSGAILLHWIFTVVFILGSVTSDSYTFVTNVFIYTGNWIKLLIGVGLLYLTFKVSEGWREQRTTFRSYPLLTIFWIISLLYSVGAPFAPNRMIDAVPFWVVPTLGTSMLAIGVAYWMVWANLMPLIGFQIQHEVIQLPDGSERVKYVHVPRQRVPRLRRSRVT

SEQ ID NO: 84549 - protein, 321 aa, Marinobacter sp. ELB17
MMDWTTPHYRYMARQLSKHALLYTEMVTTGALIHGDTERFLHHNAAEYPLALQLGGSNAGELAHCADLAQQFGFSEVNLNVGCPSDKVQNNMIGACLMGHPDIVAEGFKAMQAATDIPVTVKHRTGINGRESWDELCGFIETVAAAGCKTFIVHARIAVLEGLSPKENRDVPPLKYDWVYHLKAKYPQLEIIINGGIKTVNECHQHLAHTDGVMLGREAYHNPWILTQVDSEFFGEPEKAVNRHEALEAMYPFIEQELARGVYLGHISRHMLGLFHGVPGGRQFRRYISENAHKPGAGLDVLRQALAKVPQIGTATAFTEA

SEQ ID NO: 84550 - protein, 310 aa, Erythrobacter sp. NAP1
MGLNIEEQKAVERFRNEVVEPSKTKLVIVDFWAEWCGPCKALAPVIEKVAAEYADKGVVLAKINVDEDKFVASQFQVQSIPTVYALFQGQPVADLTSARTESQLKQALDQLLAQLPIEAGAGGADGAPQGPSAEELEQFVKMGEDALGEGDAQRAASIFAQVTEFASDNAPAHAGLVRSLVALGQVEEAKQVMTAIEADPKLASDPSIAAAKSALELAGTQVDDGELASLRDTAKASPDNMEAQMAYAEAAFAGGQRDEAADTLLAMIEADREWNDGAARAKLLQIFEATGLEDEWVVATRRRLSKILFG

SEQ ID NO: 84551 - protein, 304 aa, Pyrococcus furiosus DSM 3638
MVSYMDNETDPEGSPLLRAMKLEEKLNISKIYLKLEMHNPTRTHKDRIAKAHVKQAKDLGFSGITVGTCGNYGVAIAYFAKKEGIKAVIFVPRQYRNSRVEEMKEYGADVIFVDGAYEEAVLMSKIFAKTMNYYDANPGTQPAVDYEAYSLISKEILEEIEPYAVFVPVGNGSTLAGIYYGFKKYGVMPRIIGVTTSYGNQVLNAFYTGRVEEVKDFVETDFNEPLVSSISFDLQNALEAIKDSNGYIFGFGDDTALKYAKILEMSEGIKALPASTLTLVGLVKFVRKFGVNNENFVLLLTGGI

SEQ ID NO: 84552 - protein, 325 aa, Solibacter usitatus Ellin6076
MTITLGATSTADDVLSGVNLHGKRILVTGVSAGIGVETARALAAHGAHVVGAARDLAKAEAATAQVQKDAAANGGGFELTALDLADLKSVRACADGLIAKGEPFDVVIANAGVMATPFGHTADGFETQFGTNHLGHFVLINRIASLIRTGGRLVNLSSAGHRISNVDVEDPNFERTPYDPMIAYGRSKTANILFAVAFDQRHRSRGVRATAVHPGAIQTELGRYMERAQLESMIDRINQQLAAEGKGPFEWKTIPQGAATSVWAGVLAPADEIGGRYCANCQVGRIVRGDAVITAAGEGVREYALDPHNAAALWKKSEELVGESY

SEQ ID NO: 84553 - protein, 286 aa, Streptococcus pyogenes MGAS10394
MITLKSAREIEAMDRAGDFLAGIHIGLRDIIKPGVDMWEVEAYVRRRCKEDNVLPLQIGVDGHMMDYPYATCCGLNDEVAHAFPRHYILKEGDLLKVDMVLSEPLDKSIVDVAALDFDNVPEMKKWTGSYTGGLADSCWAYAVGTPSDEIKQLMDVTKEAMYRGIEKAVIGNRIGDIGAAVQEYAESFGYGVVRDLVGHGVGPTMHEEPMVPNYGTAGHGLRLKEGMVLTVEPMINTGTWEIDTDIKTGWAHKTLDGGLSCQYEHQFVITKDGPVILTSQGEERTY

SEQ ID NO: 84554 - protein, 427 aa, Nocardia farcinica IFM 10152
MALTPDQITAIDAAHVWHPYGGFPATTEPLVVASASGVRLTLADGRELVDGMSSWWAAVHGYRHPVLDAALVAQSQRMSHVMFGGLTHEPAARLTELLVQLTPEGLDKVFLCDSGSVSVEVAVKMCLQYWRSLGKPGKRRLLTWRGGYHGDTFTPMSVCDPEGGMHALWTDVLAEQVFVGMPPAEYRPGYVAELEAALAAHADELAAVVVEPVVQGAGGMRFHDPRYLADLRRLCDAHDVLLVFDEIATGFGRTGELFAAEHAGVRPDVMCVGKALTGGYLTLAAALCTTRIAETISAAHGGLMHGPTFMGNPLACAVAVASVELLLARDWRGEVRGIEDGLRAGLAPVRDLPGVVDVRVLGAIGVVELDRPVDMRAATAAAVAAGVWLRPFRNLVYTMPPFISTAADVAAITRGIAAAVAAGDVPS

SEQ ID NO: 84555 - protein, 181 aa, Zea mays
MGLTFTKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEAKDELHRMLNEDELRDAVLLVFANKQDLPNAMNAAEITDKLGLHSLRQRHWYIQSTCATTGEGLYEGLDWLSNNIANKA

SEQ ID NO: 84556 - protein, 353 aa, Dechloromonas aromatica RCB
MAYELTIEPLGQTIEVEDGQTILDAALRAGIYLPHACCHGLCATCKVQVTDGEVDQGEASTFALMDFEREEGKCLACCARLESDVVIEAEIEDDPDSENLPVKDYSGEVVRIETLTPTIKGIWLKLDRPMKFQAGQYVNLEVDALGGQTRAFSLANSPQTGDIVELNVRIVPGGQVTTWLHEQLAVGDRLKFTGPYGRFFVKKSANVPLIFMAGGSGLSSPKSMIEDLLSEGCSLPITLVYGQRSRAELYYDAEFRELAAKYPNFNYVPSLSDEPAGSDWSGSRGFVHEAAKAHFDNDFRGHKAYLCGPPAMIEACITTLIQGRLFERDIYMEKFFSAADASQQLKSPLFKNI

SEQ ID NO: 84557 - protein, 291 aa, Triticum aestivum
MAISTDSRSEEKPSQHSQVEKRWVLSDFDVGKALGRGKFGHVYLAREKRSSQIVALKVLFKSQLKQSQVEHQLRREVEIQSHLRHPNILRLYGYFYDQTRVYLILEHAAKGELYKELQRCKHFSERRSATYIASLARALIYLHGKHVIHRDIKPENLLVGVQGELKIADFGWSVHTFNRRRTMCGTLDYLPPEMVEKTEHDYHVDIWSLGILCYEFLYGLPPFEAKEHSETYRRIVKVDLKFPLKPFVSPAAKDLISQMLVKNSAHRLPLHKVLEHPWIVQNADPSGVYRG

SEQ ID NO: 84558 - protein, 362 aa, Streptococcus thermophilus CNRZ1066
MAKRLLILEDGTIFEGQAFGADVDVTGEIVFNTGMTGYQESITDQSYNGQILTFTYPLVGNYGVNRDDYESITPTTKGVVVSEASRRASNWRNQMTLDEFLKAKNIPGVSGIDTRALTKIIRQHGTMKATLAKPGDSIEHLQDQLRATVLPTNNIEQVSTKTAYPAPGIGKNIVLVDFGLKHSILREFSKRDCNVTVVPHDITAEEILHLNPDGVMLSNGPGNPEDVPHALDMIRGIQGKIPIFGICMGHQLFSLANGAKAYKMKFGHRGFNHAVREIATGRVDFTSQNHGYAIDRDTLPECLMVTHEEINDKSVEGVRHRDFPAFSVQFHPDAAPGPHDASYLFDEFLELIDAFQAENARR

SEQ ID NO: 84559 - protein, 922 aa, Candidatus Kuenenia stuttgartiensis
MAPKYVYFFGEGKADGKADMKHLLGGKGANLAEMTNIGIPVPPGFTITTEVCDAYYKNKQQYPKGLDKEIAQNLSMLEKLMGAKLGDSNNPLLVSVRSGAAASMPGMMDTVLNLGLNPETVMGLIKKTGNERFTWDAYRRFISMFGDVVMGIERHYFEEILDKYKKKSRVKNDTDLTTEQLKNIVEEYKEIYKKNAREPFPNNPAEQLHRAIQAVFASWNNPRAIKYRQLYEIKGLIGTAVNVQAMVFGNMGDHSATGVCFTRNPSTGENKFYGEFLINAQGEDVVAGIRTPEPIANLEKEMPAVYKQLFKYKNILEKHFKDVQDIEFTIQENRLFMLQTRNGKRTAPAAIKIAVDMVKEKLIDKKTAISRIDPNQLDQLLHPTFDPKAKREVIAEGLPASPGAATGRVVFSAEQAERLAEKNEQVILVRKETSPEDIGGMHVSQGILTTSGGMTSHAAVVARGMGKCCIAGCSAIHVDYKKQLFKVDGKVIREGTFISLDGSSGEVMMGNVATLVPKLSDDFATLMTWADEIRKLKVRTNADTKIDARKAREFGAEGIGLCRTEHMFFGENRIDFVRQMILSAPDVKNLKTKIAYIQKEISNAQNNKINVLKKDLARAQNEIKYPMTAYMSALKKLLPMQRRDFEQIFKEMDGLPVTIRLLDPPLHEFLPQEENNQREIAKRMKISFQEIQEKVSALHELNPMLGHRGCRLGITYPEIYEMQVQAIIEAACNMKKKGIIIYPEIMLPLISTEKELIILKELIQKNAKEIMEKKGVKVNYLIGTMIELPRAALIADNIARHAEFFSFGTNDLTQMTFGFSRDDVGSFVPEYIDNEILEKDPFQVLDQEGVGKLIQIGINGGRSTRKELKIGICGEHGGNPQTVSFCHGIGMDYVSCSPFRVPIARLAAAHAALEQPVSRATI

SEQ ID NO: 84560 - protein, 216 aa, Legionella pneumophila subsp. pneumophila str. Philadelphia 1
MSELKIKAAKAAIAYIEDDMVIGVGTGSTVNFFIKELAAIKHKIEACVASSKATEALLRAEGIPVIDLNSVQDLPIYVDGADEVNERGEMIKGGGGALTREKIVANVATQFICIVDESKVVKRLGEFPVAVEVIPMARSFVARQIVKLGGDPEYREGFVTDNGNIILDVFNLSFSTPMALEDSLNVIPGVVENGVFAKRLADKVLVASASGVNNLK

SEQ ID NO: 84561 - protein, 169 aa, Saccharomyces cerevisiae YJM789
MAVKGLGKPDQVYDGSKIRVGIIHARWNRVIIDALVKGAIERMASLGVEEKNIIIETVPGSYELPWGTKRFVDRQAKLGKPLDVVIPIGVLIKGSTMHFEYISDSTTHALMSLQEKVDMPVIFGLLTCMTEEQALARAGIDEAHSMHNHGEDWGAAAVEMAVKFGKNAF

SEQ ID NO: 84562 - protein, 463 aa, Marinobacter sp. ELB17
MPEHHYDVVVIGAGPSGEGAAMNATKNGKRVAIVEDKNTVGGNCTHWGTIPSKALRHSVKQIITFNTNQMFRDIGEPRWFSFPRVLQNAQKVIGTQVKQRTQFYSRNRIDLVNGSASFVDKNELEVRGSKGVETLHFKQAIIASGSRPYLPPDLNFRHHRIYNSDTVLSLSHTPRTLIIYGAGVIGSEYASIFAGLGVKVDLINPGSRLLTFLDDDISDALSYHLRNNGVLVRHNEEYESVDGDDHGVVLSLKSGKKIRADAFLWCNGRTGNTDKLALENIGLQANGRGQLAVDNHYRTEVENIYAVGDVIGWPSLASAAYDQGRSASSDIVQDDYFRFVSDVPTGIYTIPEISSVGKTERELTEAKVPYELGQAFFKDLARAQITGEPVGMLKILFHRETREILGIHCFGDQAAEIVHIGQAIMNQKGDANSLNYFINTTFNYPTMAEAYRVAALNGLNRIF

SEQ ID NO: 84563 - protein, 461 aa, Rhodococcus erythropolis
MRIAEHVVDLIGNTPLVKLTSVTGENFGTVAAKVEYLNPGGSSKDRIAVKMIDAAEASGELKPGGTIVEPTSGNTGIGLALVAQKRGYKCVFVCPDKVSEDKRNVLRAYGAEVVVCPTAVAPDNPNSYYSVSDRLTREIPGAWKPNQYSNPGGPESHYETTGPEIWADTDGKITHFVAGVGTGGTITGTGRYLKEVSGGKVKVIGADPEGSVYSGGTGRPYLVEGVGEDFWPSAYDPSIPDEIIAVSDADSFEMTRRLAREEGLLVGGSCGMAVVAALEVAKREGPDALIVVLLPDGGRGYLSKIFNDQWMASYGFLRTPLDGKTNVPTVGDVLRGKSGELPDLVHTHPSETLRDAIEILREYGVSQMPVVGAEPPVMAGEVAGSVSERDLLSAVFEGRAHLADSVEKHMSKPFPLIGSGEPVSAATKALGDTDALMVVDDGKPVGVITRHDLLGFLSSDS

SEQ ID NO: 84564 - protein, 351 aa, Aspergillus oryzae
MSFDPNNVDLDTADPAEIICYLNASENDYDGRLGARISAIFVILIVSTAVTFFPVLAKRAPRLHIPLYVYLFARYFGAGVIVATAFIHLLDPAYDEIGPASCVGMTGHWADYSWCPAIVLASLVGIFLLDFGAERYVEVKYGICREDPEPIMTSATDNSLRTTAVANQAPVEKEAQLESQSVNDSLSERSFKQQIAAFLILEFGVIFHSVIIGLNLGVTGEEFSTLYPVLVFHQSFEGLGIGARMSAIPFRKGSWLPWILCTLYGLTTPISIAIGLGVRTTYNSGSYTANVVSGVLDAISAGILIYTGLVELLARDFLFDPHRTQDNKRLTFMVISMLWGVGIMALLGKWA

SEQ ID NO: 84565 - protein, 423 aa, Saccharomyces cerevisiae YJM789
MFKRYLSSTSSRRFTSILEEKAFQVTTYSRPEDLCITRGKNAKLYDDVNGKEYIDFTAGIAVTALGHANPKVAEILHHQANKLIHSSNLYFTKECLDLSEKIVEKTKQFGGQHDASRVFLCNSGTEANEAALKFAKKHGIMKNPSKQGIVAFENSFHGRTMGALSVTWNSKYRTPFGDLVPHVSFLNLNDEMTKLQSYIETKKDEIAGLIVEPIQGEGGVFPVEVEKLTGLKKICQNNDVIVIHDEIQCGLGRSGKLWAHAYLPSEAHPDIFTSAKALGNGFPIAATIVNEKVNNALRVGDHGTTYGGNPLACSVSNYVLDTIADETFLKQVSKKSDILQKRLREIQAKYPNQIKTIRGKGLILGAEFVEPPTEVIKKARELGLLIITAGKSTVRFVPALTIEDELIEEGMDAFEKAIEAVYA

SEQ ID NO: 84566 - protein, 595 aa, Zea mays
MDEHKLGYKGSDVLQELEILTINAKTAQEVILSKILEKNRATEYLNKFMNGSIDISAFKCQVPVVTYDVVQPYIARIAAGERSSILCGEQIVELLRSSGTSQGEPRLMPSISEDIYRRMYLYSLIMPIMSKYIRGLGEGKAMYLLFVKAETLTNAGIPVRSVLTSYYKSPQFLQRKHDLYNSYTSPDEVILCPDSQQSMYCQLLCGLVERQNVVRLGAVFASAFLRSISFLEKHWHDLVTDIRTGRINPSITNAACRVATESFLAQPNPELADEVEAICSSESWKGVLGRLWPNVKYIEAVLTGTMAQYVPMLEFYSDGRIPLVCTMYASSESYFGVNLRPLCSPKDVSYTILPNMAYFEFVPLDDGLRLAEDGEAVEKEKLVGLVDVKVGCYYELVVTTFAGLYRYRVGDVLQVTGFYNRAPQFKFICRRNVILSVDADKTNEEDLHGSVSRAKKILEDRGHILLEYTSFTDTSTVPGHYVLFWEVKATPTSGSGGARLDAQVLESCCVAVEESLDCVYRRCRAHDRSVGPLEIRLVEAGAFDALMDLLVSQGGSINQYKTPRCIEPGGAALELLDSKATASFFSPRDPEATGV

SEQ ID NO: 84567 - protein, 343 aa, Zea mays
MANSAAPGGMRSFLQAVSTVTEEAPTPLRVVQMEGLAVLKIIKHCEEFAPALVTGQLLGLDVGSVLEVTNCFPFPIREEDDEADADGANYQLEMMRCLREVNVDNNTIGWYQSCLLGSFQTVELIETFMNYQESIRRCVCIVYDPSRSSQGVLALKALKLTDSSMDLYRNNGLTGEKLREKKLSWVDIFEEIPIKVSNSALVSAFMKELEPESPVTQCDLDRLKLSTAPFMERNLEFLIGCMDDLSSEQNKFQYYNRNLSRQQSQQQAWLQKRRQENMARKAAGEEPLPEEDPSNPIFKPIPEPSRLEGYLVTNQICSYCNHINGVAGQNFDRLYLMKALHED

SEQ ID NO: 84568 - protein, 76 aa, Helicobacter hepaticus ATCC 51449
MDTFESVKAVVVEQLSVDANEVKPESRFIEDLNADSLDVVELVMALEEKFSIEIPDEEAEKIKTVKDVVAYIEANK

SEQ ID NO: 84569 - protein, 317 aa, Chlamydomonas reinhardtii
RSCQLLRWPSCPPSPGRAARVVPSLPQHTAPFVRFKQVPRDAKQGLVGQVFSSVANSYDVMNDLMSGGLHRLWKDRLVESLRPFPGQEHLDVAGGTGDVGFRQQQQQQQQHQERQRRRRSGEEAGCGRERGCWAGGRAGAGGADAGGPVAPGRVVVCDINPDMLRVGQQKARSSTDLAGDTGLAFVEGNAEALPFASGSFDSYTVAFGIRNVTDRPAALREALRVLKPGGRLLVLEFSHVTQPGLRELYDAYSFAVIPRIGGLVAGDAASYQYLVESIRKFPDQETFARMIEDAGFRAVTYENMSGGIVSLHSGFKL

SEQ ID NO: 84570 - protein, 133 aa, Rhodococcus erythropolis
VNLEQIKAAQQLLAPVMRRTPVVASRVLSETTGFAVSLKCENLQRTGSFKPRGAYNRIANLSAEERAAGVVAASAGNHAQGVAWSATELGIKSTVFMPTGAPLPKLVATKAYGAQVHLHGSTVDEALVAAREF

SEQ ID NO: 84571 - protein, 382 aa, Yarrowia lipolytica CLIB122
MPRSLIIDTDPGVDDALAISLALNSPECDLKLISLCFGNCDTNASLRNVETLFSVFERERVWREQQGLPAKHHVNQKPIVAVGMDTALDGTRLDATYFHGDDGLGNVHTKMPEFTSTDKNGPGYTFSDKPSYQVILDLLREEPDKSVTIAAIGPLMNIARAAQIDPDTFSRVKEIVHMGGALKVPGNVTPRAEFNCYSDPLAAAVVYSFSATEQPCVTLPPRKEFHVTLPRPVPVTIFPLDITMEYNLYENQFFTAVSDRAAAGSPLTVWSSVWLQSTFDTFRRLNVDCSDVHINMHDPLATWYAICGDEHGAWESHDQDVRVETEGQWSRGVTIEDDRGRQKTDAEAEDDGKWLGRGGNHVKVVTKAPVEVGQLLVERIYV

SEQ ID NO: 84572 - protein, 226 aa, Arabidopsis lyrata subsp. lyrata
CKAAVAWEAGKPLVMEEVEVAPPQKHEVRIKILFTSLCHTDVYFWEAKGHTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQA

SEQ ID NO: 84573 - protein, 347 aa, Zea mays
MGNCSSSSGFFSLPKRGSKLLKLNNGMVSVDDEGGTHEGIKTIPVQRACEFTTNSVLCVCIVTWNMNSKMSAEDVAKLVSSDRKFDLLVVGLQEAPKPDVSRVLQEALAGTHVLLGQKSMQSLRMLLFGSRSSEKYIREMKVDKHAVGGCGGIIGRKKGAVAMYINFSGIRMVFVSCHLAAHEHKVEKRNAEFQHISQSLFARYGAPTPYAQSADITVWLGDLNYRLQGISSTPARKMIEENRQSKLRGRDQLLQEAEKGQVFSGYCEGTLSFKPTYKYDVGGSVYDTSYKVRVPSWTGRILFKVGQSSGLDAVLSSYESLDCVRSSDHKPVKAHLCLKVRSDGDAD

SEQ ID NO: 84574 - protein, 437 aa, Rhodococcus erythropolis
EFGRNTADLSDRENVQFHWIEVENVPEIWKRLEAVGLKTTEACGDCPRVVLGSPLAGESLDEVLDPTPAIDEIVRRYIGDPKYSNLPRKFKTAISGQQDVVHEINDIAFIGVNHPEHGPGLDLWVGGGLSTNPMLAQRVGAWIPLDEVPDVWEGVVSIFRDYGYRRLRAKARLKFLIKDWGIEKFREVLETEYLERPLIDGPAPEKPKRPIDHVGIQKTRNGHNAVGFAPIAGRVSGDILAQVADAAEKAGSDRIRFTPYQKLIILDVADETLEPLIADLDALGLPARPSHWRKNLMACSGIEFCKLSFAETRKRSQVLVPELEQRLADINSQLDVPITININGCPNSCARSQIADIGFKGQLVDDGEGNQVEGFQVHLGGSLGFDSAFGRKLRQHKVTSVEMGDYIDRVVRQFVKNRNEGERFAEWAVRADEGDLR

SEQ ID NO: 84575 - protein, 438 aa, Oryza sativa Indica Group
MGFPIVGETFQFFRTSPSIDMPIYYKRRLERYGPIFKTNIGGQHVVISLDPEVNQFIFQQEGKLFQSWFPETTLNIFGKKTLTTYNRTAHKLIRSFVCKLYGPENVKKSLLPELENSMRESLASWIGKPSVEVNDGVSNMIFGLAAKHLIGLDITNSGELKKNFQEIFQVMVSIPFPIYFPGTSFYRCMQGRRNVWTTLTNVMKKRLSAPGNKFGDLVDLIVEELRSENPTIDESFAIDTLSGLLFASFAPLSCTLTTTFKFLNDNPEVFDKLKEEHEMILKKREGANSGFTWEEYKSLKFSTQVVNEINRITTVIPGGFRKALTDVEVNGYTIPSGWLVMISPMGVHLNPKLFEDPLKFDPWRWTEEKRISMQRNFMPFGGGIRMCPAVEFNKLFITLFLHIVVTEYRWKDIDGGNVKRISEVLVAQEYHIQLVPQT

SEQ ID NO: 84576 - protein, 246 aa, Campylobacter lari RM2100
MSFKKILFGLFTTSMLFAYEQMPQNASHGNFIDKDKWKNLDKNWIYCESGLNQDFININSKKATSKNHPLEFNYSNDSFGLINDGYTIKMHFASNGSHIVLDDTSYNLSHFHFHSPSKISIDKKYYPLEIHFSHVSQNGNIAVVVLFLQEGAENPFIKKIIRAFPKKEGDKLYVQGLSANELLPNNLQSFYIFKNKLNKPCNQKITWIVLKDISYASKEQIQIIQNLMGKNENLKIQEINNLEQND

SEQ ID NO: 84577 - protein, 402 aa, Streptococcus pyogenes
MKIAVAGSGYVGLSLGVLLSLQNEVTIVDILPSKVDKINNGLSPIQDEYIEYYLKSKQLSIKATLDSKAAYKEAELVIIATPTNYNSRINYFDTQHVETVIKEVLSVNSHATLIIKSTIPIGFITEMRQKFQTDRIIFSPEFLRESKALYDNLYPSRIIVSCEENDSPKVKADAEKFALLLKSAAKKNNVPVLIMGASEAEAVKLFANTYLALRVAYFNELDTYAESRKLNSHMIIQGISYDDRIGMHYNNPSFGYGGYSLPKDTKQLLANYNNIPQTLIEAIVSSNNVRKSYIAKQIINVLKEQESPVKVVGVYRLIMKSNSDNFRESAIKDVIDILKSKDIKIIIYEPMLNKLESEDQSVLVNDLENFKKQANIIVTNRYDNELQDVKNKVYSRDIFGRD

SEQ ID NO: 84578 - protein, 290 aa, Escherichia coli
MISEHDSVLEKYPRIQKVLNSTVPALSLNSSTRYEGKIINIGGTIIKARLPKARIGAFYKIEPSQRLAEVIAIDEDEVFLLPFEHVSGMCCGQWLSYQGDEFKIRVGDALLGRLIDGIGRPMESNIVAPYLPFERSLYAEPPDPLLRQVIDQPFILGVRAIDGLLTCGIGQRIGIFAGSGVGKSTLLGMICNGASADIIVLALIGERGREVNEFLALLPQSTLSKCVLVVTTSDRPALERMKAAFTATTIAEYFRDQGKNVLLMMDSVTRYARAARDVGLASGEPDVRGG

SEQ ID NO: 84579 - protein, 817 aa, Pyrococcus furiosus DSM 3638
MAYRFIKWFEELSKNDVPLVGGKGANLGEMTNAGIPVPPGFCVTAEAYKYFVENVKVSKEDVKRILGEKVNKGTISEVLAQAPDEPRPLQDWIMDIISKTDVDDSKMLQENTEAIRTLIKSLDMPSEIAEEIKQAYKELSQRFGQEEVYVAVRSSATAEDLPEASFAGQQETYLDVLGADDVIDKVKRCWASLWTARATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGRGTVMVKVAEYLGPEWVEKQVLTDEQIIEVAKMGQKIEDHYGWPQDIEWAYDKDDGKLYIVQSRPITTLKEEATAEEAEEVEEAEVILKGLGASPGIGAGRVVVIFDASEIDKVKEGDILVTTMTNPDMVPAMKRAAAIVTDEGGRTSHAAIVSRELGIPCVVGTKEATKKLKTGMYVTVDGTRGLVYKGIVKSLVKKKEEAKAEGGQVVVAGAPLVTGTMVKVNVSMPEVAERAAATGADGVGLLRAEHMILSIGQHPIKFIKEGKEEELVEKLAEGIEKVAAAFYPRPVWYRTLDAPTNEFREMPGGEDEPEERNPMLGWRGIRRGLDQPELLRAEFKAIKKVVEKGYNNIGVMLPLVSHPEQIREAKRIAREVGLEPHKDVAWGVMIEVPAAAIIIEDLIKEGIDFVSFGTNDLTQYTLAIDRDNERVAKLYDETHPAVLKLIKHVIKVCKRYGVETSICGQAGSDPKMARILVRLGIDSISANPDAVQLIRQVVAQEERKLMLEAARKQLFEEEEEEELF

SEQ ID NO: 84580 - protein, 475 aa, Erythrobacter sp. NAP1
MVTQYKNLINGKMVDTGEWMDVVNPANEEVIGQVPACGEAQLDEAVAAARAAFKTWKKSTFEERQAACMAISGAIKENADELFRLLTSEQGKPHAQAKGEIFGAAGISAAQSTLQLEEEIIQDDDTRLHRHRRVPVGVVGGIVPWNFPVMMAIQKIVPALMAGCTIVLKPSPFTPLATLRIAELIADKVPAGTVNIITGEDSLGPLITGHPDIDKITFTGSTATGKKIMEGAAGDLKRITLELGGNDASIVLPDADPKKVAEQLFWSSFQNAGQVCIAAKRVYIHEDIYDELSAAIAEYAKSVVVGDGSEQGTGVGPIQNKKQYERVLELIQDAKDNGYKFLTGGDKDPSGSGYYVPITILDNPPEDARIVAEEQFGPVMPLMKFSSEDEVIERANNSDYGLAGAVWTADHDKGVEIAEQLETGTVWINEFMHLSPFAPFGGHKQSGFGAEYGKEGLKEFTYPQVITVKKDNVVA

SEQ ID NO: 84581 - protein, 556 aa, Streptococcus pyogenes MGAS10394
MYQALYRKYRSQTFDEMVGQSVISTTLKQAVESGKISHAYLFSGPRGTGKTSAAKIFAKAMNCPNQVDGEPCNQCDICRDITNGSLEDVIEIDAASNNGVDEIRDIRDKSTYAPSRATYKVYIIDEVHMLSTGAFNALLKTLEEPTENVVFILATTELHKIPATILSRVQRFEFKAIKQKAIREHLAWVLDKEGIAYEVDALNLIARRAEGGMRDALSILDQALSLSPDNQVTIAIAEEITGSISILALGDYVRYVSQEQATQALAALETIYDSGKSMSRFATDLLTYLRDLLVVKAGGDNQRQSAVFDTNLSLSIDRIFQMITVVTSHLPEIKKGTHPRIYAEMMTIQLAQKEQILSQANLSGELISEIETLKNELAQLKQQLSQLQSRPDSLARSDKTKPKTTSYRVDRVTILKIMEETVRNSQQSRQYLDALKNAWNEILDNISAQDRALLMGSEPVLANSENAILAFEAAFNAEQVMSRNNLNDMFGNIMSKAAGFSPNILAVPRTDFQHIRKEFAQQMKSQKDSVQEEQEVALDIPEGFDFLLDKINTIDD

SEQ ID NO: 84582 - protein, 451 aa, Shewanella sp. MR-7
MSLVVAKFGGTSVADYGAMNRCADIVLGNPDCRLVVVSASSGVTNLLVELTQESMNDDGRLQRLKQIAQIQYAILDKLGRPNDVAAALDKLLSRMAVLSEALASQRSKATMDELLSLGEQCSSALFAAVLREKGANSSAFDVRRVLRTDSHFGRAEPQVEQIALLSSEHLLPLLSEQVIVTQGFIGSDEAGQTTTLGRGGSDYSAALLAEALKASAVEIWTDVAGIYTTDPRLAPNAHPIAEISFNEAAEMATFGAKVLHPATILPAVRQQIQVFVGSSKEPEKGGTWIRHQVEDAPVFRAVALRRDQTLLNLHSLQMLHAQGFLAETFATLARHKISVDLITTSEVNVSLTLDKTGSDSSGQGLLSEALLQELSQHCRVRVEDSLALVAIIGNRIATTAGICRRVFEVLEPHNVRMICQGASPHNLCVLVAESEAAQVVKALHENLFEGA

SEQ ID NO: 84583 - protein, 364 aa, Zea mays
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDSRFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWAIEFIK

SEQ ID NO: 84584 - protein, 609 aa, Oryza sativa Japonica Group
MATQAIAPMHAAVVHRHHVLPPRRCVRRRGVFVRASAAAAAAAAETDTLSAAFWDYNLLFRSQRDECLDSIPLRVTEGAIPPDFPAGTYYLAGPGIFSDDHGSTVHPLDGHGYLRSFRFRPGDRTIHYSARFVETAAKREESRDGASWRFTHRGPFSVLQGGKKVGNVKVMKNVANTSVLRWGGRLLCLWEGGQPYEVDPRTLETVGPFDLLGLAAADDNKATNASAARRPWLQEAGLDAAARLLRPVLSGVFDMPGKRLLAHYKIDPRRGRLLMVACNAEDMLLPRSHFTFYEFDAHFDLVQKREFVVPDHLMIHDWAFTDTHYILLGNRIKLDIPGSLLALTGTHPMIAALAVDPRRQSTPVYLLPRSPETEAGGRDWSVPIEAPSQMWSVHVGNAFEEANRRGGLDVRLHMSSCSYQWFHFHRMFGYNWHHKKLDPSFMNAAKGKEWLPRLVQVAIELDRTGECRRCSVRRLSDQHARPADFPAINPSYANQRNRFVYAGAASGSRRFLPYFPFDSVVKVDVSDGSARWWSTDGRKFVGEPVFVPTGGGEDGGYVLLVEYAVSKHRCHLVVLDAKKIGTENALVAKLEVPKNLTFPMGFHGFWGDE

SEQ ID NO: 84585 - protein, 212 aa, Streptococcus pyogenes MGAS10394
MEFKMLKKPIIIGVTGGSGGGKTSVSRAILDSFPNARIAMIQHDSYYKDQSHMSFEERVKTNYDHPLAFDTDFMIQQLKELLAGRPVDIPIYDYKKHTRSNTTFRQDPQDVIIVEGILVLEDERLRDLMDIKLFVDTDDDIRIIRRIKRDMMERGRSLESIIDQYTSVVKPMYHQFIEPSKRYADIVIPEGVSNVVAIDVINSKIASILGEV

SEQ ID NO: 84586 - protein, 788 aa, Arabidopsis thaliana
MGVMENLMVHTEISKVKSQSNGEVEKRGVSVLENGGVCKLDRMSGLKFKRRKVFAVRDFPPGCGSRAMEVKIACENGNVVEDVKVVESLVKEEESLGQRDASENVSDIRMAEPVEVQPLRICLPGGDVVRDLSVTAGDECSNSEQIVAGSGVSSSSGTENIVRDIVVYADESSLGMDNLDQTQPLEIEMSDVAVAKPRLVAGRKKAKKGIACHSSLKVVSREFGEGSRKKKSKKNLYWRDRESLDSPEQLRILGVGTSSGSSSGDSSRNKVKETLRLFHGVCRKILQEDEAKPEDQRRKGKGLRIDFEASTILKRNGKFLNSGVHILGEVPGVEVGDEFQYRMELNILGIHKPSQAGIDYMKYGKAKVATSIVASGGYDDHLDNSDVLTYTGQGGNVMQVKKKGEELKEPEDQKLITGNLALATSIEKQTPVRVIRGKHKSTHDKSKGGNYVYDGLYLVEKYWQQVGSHGMNVFKFQLRRIPGQPELSWVEVKKSKSKYREGLCKLDISEGKEQSPISAVNEIDDEKPPLFTYTVKLIYPDWCRPVPPKSCCCTTRCTEAEARVCACVEKNGGEIPYNFDGAIVGAKPTIYECGPLCKCPSSCYLRVTQHGIKLPLEIFKTKSRGWGVRCLKSIPIGSFICEYVGELLEDSEAERRIGNDEYLFDIGNRYDNSLAQGMSELMLGTQAGRSMAEGDESSGFTIDAASKGNVGRFINHSCSPNLYAQNVLYDHEDSRIPHVMFFAQDNIPPLQELCYDYNYALDQVRDSKGNIKQKPCFCGAAVCRRRLY

SEQ ID NO: 84587 - protein, 489 aa, Dechloromonas aromatica RCB
MSQPQRIHHFINGEFTASPDPRYFDKRSPVDGRVIAHIAEAGQADVDAAVTAARAALKGEWGKLSTDQRVDLLYGVANEITRRFDDFVAAEMADTGQPSHVQTHVFIPRGAANFKVFADVIKNVAAESFRMATPDGKGALNYAIRNPKGVIGVISPWNAPFLLMTWKVGPALACGNTVVVKPSEETPLTATLLGEVMNSVGIPKGVYNVINGFGPDSAGAYLTQHPGVDAITFTGETRTGTAIMKAAAEGMRDVSFELGGKNAGIVFADCNFEAAVDGIFRSAFLNTGQVCLGTERVYVERPIFENFVQALKAKVEGVRYGRPEDHTSTYGPLISQEHRDKVLSYYKKAVDEGATVVTGGGVPDMPAELAGGSWVQPTIWTGLPETAAVVREEIFGPCCHIRPFDSEEEVIELANANDYGLATTIWTENLSRAHRVAERVEVGVTWVNSWFLRDLRTPFGGSKQSGIGREGGVHSLEFYTETRNVCIKL

SEQ ID NO: 84588 - protein, 475 aa, Streptococcus pyogenes MGAS10394
MAKQYKNLVNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVNFINFTGSTPIGEGIGKLAGMRPIMLELGGKDSAIVLEDADLALAAKIIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAIKISNESEYGLQASIFTTNFPKAFGIAEQLEVGTVHLNNKTQRGTDNFPFLGAKKSGAGVQGVKYSIEAMTTVKSVVFDIQ

SEQ ID NO: 84589 - protein, 498 aa, Coxiella burnetii RSA 493
MKKIYHYINGKFVDAKGETYQEVYNPATGEVSAQVAFGTAEEVEEAVESARNAFASWSSVTPLRRARVIFKFKALLDKNIDKLAELLTSEHGKILEDAKGEVLRAIELTEFSCGTPYLLKGSYSENVGTDVDSYTIRQPLGVCVGITPFNFPVMISAWMFVSAIACGNTFVLKPSEKDPSAALFLAELMQEAGLPAGVLNIINGNGATVDRLITHPKVAAVSAVGSTAAAEHIYQTAIAHGKRAHTFGGAKNHCVITPDADIDEAADAILGAAYGAAGERCMAVSVVVAITDTVGDALVQRLKEKIPQLQIAAGTESRADFGPLVTKEHLEKVKAYIHLGVEEGAELIVDGRDLETLKHKKGFFLGGCLFDHVKPSMRIYQEEIFGPVLCVTRVSNFEEALALINKNEYGNGVAIFTKSGEMARYFASKVSVGMVGINVPIPVPVAYHTFGGWKRSIFGDIHMHGAENVHFYTKQKTVTVRCWPREKTTESAYHMQSH

SEQ ID NO: 84590 - protein, 387 aa, Glycine max
MEDKLATTSEGQPIRCKAAICRKPGSPLSIEEIIVAPPMPREARIRVICTSLCHSDVTFWKMEVPPAICPRILGHEAVGVVESVGEDVTEVTKGDVVVPIFLPDCGECIDCKSSKSNLCSKFPFEVSPWMPRHATSRFTDLKGDIIHHFLFVSSFSEYTVVDIAHLTKIDPAIPPNRACLLSCGVSTGVGAAWRTAGVEPGSTVVIFGLGSIGLAVAEGARLCGATRIIGVDVNPEKYETGKKFGLTDFVHAGESENKSVSQVIIKMTGGGADYCFECVGMATLVQEAYASCRKGWGKAIVLGVEKPGSMLSLSCNEVLHSGKSLVGCLFGGLKPKSDVPILLKRYMDKELNLDEFVTHEVEFKDINKAFDLLIEGQCLRCVIWMDR

SEQ ID NO: 84591 - protein, 161 aa, Zea mays
  misc_feature (88)..(88): Xaa can be any naturally occurring amino acid
MATVNATTTTAGSGKQTDAAPSPPAAAAAACRSLSGADLALRVLLFAVTLSGLVVLATAKQTVRVPVPQIPGLVLSLPAKFKDSPALXFYAAIMASATSSAGGVAWIGLKGNSHTNWNKICNIYSKFCRHIGSSVFLGLIASVVLVLLTILNAHSLYRRSR

SEQ ID NO: 84592 - protein, 299 aa, Aspergillus oryzae
MASSTLCILGCGNLGGAILKSLIDGPKDKHGSAPFTRFIACVRSQESEQRLTTQFSHQSQSLTVTRDNIKAVQESDVVVLGVDPAVVEKVLSTPSLTEALSNKLLISVAAGWTRQKLETTLYGSPTTTSNAEGRAWVVRTLPNIAASVSQGLTAIEISEPEVPEHYQKITDAVFDNLGKTVHIPPTLMDATTAVAGSTPAFFAVIVDAMIDAAVAVGVPRDLARTMTVQAMTGTAALLQSGMHPAVLRDQGTSPEGCTIGGLMVMEEAGVRGHVGRALREAVTIARLMDGTRHLNDTRQ

SEQ ID NO: 84593 - protein, 202 aa, Escherichia coli
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVG

SEQ ID NO: 84594 - protein, 586 aa, Clostridium difficile 630
MLNNVKKTKIVCTLGPASQSEEVLTQLMQNGLNVCRFNFSHGSHEEHKERIDMAKKVREKLNKPVAILLDTKGPEIRTGNFEDPEVFLEEGQKFTITMKDIMGTKEMCTVSYKGLAEDVKSGDSILIDDGLVGLRVKEINGEDIVCVVENSGIVKNHKGVNVPGVKINLPAITPKDISDIEFGISQGIDYIAASFVRKASDVLAIREVLENNNATDIQIISKIENQEGVENLDEILKVSDGIMVARGDLGVEIPTEEMPIVQKMMIKKCNELAKPVVTATQMLDSMIRNPRPTRAEVTDVANAIYDGTDAIMLSGETAAGKYPVEAVKMMATIAKRTEETLDYDRLLKENGTNNVTVTDAISHATCTTAVDLNASAIITSTSSGYTARMVSKFRPKSPIIATTNNEKTMNKLALTWGVYPVKSSVAGNTDEVIEKAIEAARQADYIDNGELVVITAGVPVGVSGTTNLIKVHVISEEIVQGIGVGTQTVEGKVRIIKNGNACVDFNEGDILVSTATDAEMNNYIEKAGAVVTENGGMTSHTAIVGINLDIPVIVSAADITNLVKDGEVVTVDASRGVVYRGSTRVL

SEQ ID NO: 84595 - protein, 497 aa, Erythrobacter sp. NAP1
MRPFSPIAAALLEDNLIGSAQSGSLAARYPDILNRMTFADLGLSPELLKAVEDAGYTEPTAIQAEAIPAVLMMKDLIGIAQTGTGKTASFVLPMIDVMAAGRRRALMPRSLILEPTRELAAQVAENFEKYGANHDLKMALLIGGVQMGDQLKTLDEGVDVLIATPGRLMDLFERGKILLNGCELLVIDEADRMLDMGFIPDIEFICDKLPETRQTMLFSATMPAPIEKLAKKFLSNPKRIETTRAATTNKDITAFKVPVKARQKRDTLEWLLANDQVETAIIFANRKTTVRELNKHLQRQGFASGEIHGDMDQSSRLKELDRFKSGDVNILVASDVAARGLDIKGVSHVFNFDTPWHPDDYVHRIGRTGRAGAKGRAFTLVADEDAEAIANVEKLTGAKIKVFGKEDVRVELADGSAKNTGSDDEAKDEKPAEKKSRSRSRKRDDEGDAPRKPRRESAEDKPARKSRPRRRDDESDDPVPAGEWNGPKPGFLDVGAT

SEQ ID NO: 84596 - protein, 238 aa, Arabidopsis lyrata subsp. lyrata
CKAAVAWEAGKPLVMEEVEVAPPQKHEVRIKILFTSLCHTDVYFWEAKGHTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPR

SEQ ID NO: 84597 - protein, 283 aa, Arabidopsis thaliana
MRKRERENPCSICGHYHKYEEGEVCGVCGHCMPVSSDTVAPQQVHVSAFPSEILPEFLYLGSYDNASRSELLKTQGISRVLNTVPMCQNLYRNSFTYHGLDNEKVLQFDDAIKFLDQCEKDKARVLVHCMSGKSRSPAVVVAYLMKRKGWRLAESHQWVKQRRPSTDISPGKYLDFGLETYLLFLKLLLIAFSLYTEFYQQLQEFEQGIFGSEMMSAMNINDAPTFGFGFPKIDNQAQAPVFNNAPTSSIFSSPASSIPPQEFTFGATPPKPTTGGDIAMDGS

SEQ ID NO: 84598 - protein, 193 aa, Escherichia coli
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAM

SEQ ID NO: 84599 - protein, 357 aa, Arabidopsis lyrata subsp. lyrata
AVAWEAGKPLVMEEVEVAPPQKHEVRIKILFTSLCHTDVYFWEAKGHTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNLLNERTLKGTFFGNYKPKTDIPGVVEKYMNKELELEKFITHTLPFSEINKAFDYMLKGE

SEQ ID NO: 84600 - protein, 199 aa, Moorella thermoacetica ATCC 39073
MSVLVPMVVEQTSRGERAYDIYSRLLKDRIIFLGSAIDDHVANLVIAQMLFLEAEDPDKDIHLYINSPGGSISAGMAIFDTMQYIRPDVSTICVGLAASMGAFLLAAGAKGKRFALPNSEIMIHQPMGGTQGQAVDIEIHAKRILAIRDNLNRILSEITGKPLEQIARDTDRDHFMTAREAREYGLIDEVITKRELPAK

SEQ ID NO: 84601 - protein, 185 aa, Escherichia coli
HLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFA

SEQ ID NO: 84602 - protein, 255 aa, Picea sitchensis
MPYPFQRVAVGRADEAYHPDTLRAALAEFISAIIFVFAGEGSVIAFSKLSDDGSTTPAGLVAEALAHGIALFIAVAVASNISGGHVNPAVTFGALVGGHITLVRGIFYWIAQMLGATVACGLLKYTTNGMSIGVFSLSSGVGLGNALVFEIVMTFGLVYTVYATAIDPNRGTLGTIAPICIGFIVGANILAGGAFDGACMNPARAFGPALVSWTWKNHWIFWVGPLIGGGLAGAIFEVFFIEARPTHERLPTSEI

SEQ ID NO: 84603 - protein, 203 aa, Escherichia coli
KARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQG

SEQ ID NO: 84604 - protein, 538 aa, Streptomyces coelicolor A3(2)
MTTQSTLQSVPALGTHPASGSNPSRAETREQLSKASYDLLVIGGGILGISTAWHAAQSGLRVAVVDAGDFAGATSSASSKLLHGGLRYLQTGAVKLVAENHFERRAVSRQVAPHLANPLTFYLPVYKGGPHGAAKLGAGVFAYSALSAFGDGVGHLLSPAKAAQDVPELRTDNLKAVAVYGDDQMNDARMALMTVRAAVESGAVVLNHAEVTGLRFTGGRVTGAELKDRLSGDEFGVNARLVLNATGPWVDHLRRMEDPAAAPSIRLSKGAHLVLKRTAPWKAALATPIDKYRITFALPWEDMLLLGTTDEEFEGDPADVAVNDKDITQILDEAAFSIRDQQLDRDLITYSFAGLRVLPGGPGDTAKAKRETVVTEGRGGMLSVAGGKWTTFRHIGRTVMKKLEALPGHPLGDDFEPIASLPKKLPLPGVANPRAVAHRLLVDGSAPGPRMAADTARHLATHYGSLAFDIARLANESPELARRVHPDAPEIWAQVVWARDNEWAETADDVLRRRTTLTIRGLATDDVRAQVQDVLDKK

SEQ ID NO: 84605 - protein, 155 aa, Vitis vinifera
  misc_feature (48)..(48): Xaa can be any naturally occurring amino acid
MSRVVLLSSAHLHIVTLLQPEVRSDDEEMNYFFRLKCEQCGWISENEXCVNMAVQERAPGSSNRNNRVNLSLKCEGCERQGTITLVPEHGRPLRADDCTNVPLMVFDCNGIFPVYYSLNGGWSAVTFLHNQYETFGLGIAEVQDSNARELQWTIK

SEQ ID NO: 84606 - protein, 595 aa, Zea mays
  misc_feature (415)..(415): Xaa can be any naturally occurring amino acid
MEGGMATSTKPQQDNRHWSGLEKYRADPIYYRCIRPAGTILSGPTKDGATQPPTRDPSICRTPPNSQTITRSVDMDKAYIAALSAAALFLLHYLLGRRAGGEGKAKAKGSRRRLPPSPPAIPFLGHLHLVKAPFHGALARLAARHGPVFSMRLGTRRAVVVSSPDCARECFTEHDVNFANRPLFPSMRLASFDGAMLSVSSYGPYWRNLRRVAAVQLLSAHRVGCMAPAIEAQVRAMVRRMDRAAAAGGGGVARVQLKRRLFELSLSVLMETIAHTKTSRAEADADSDMSTEAHEFKQIVDELVPYIGTANRWDYLPVLRWFDVFGVRNKILDAVGRRDAFLGRLIDGERRRLDAGDESESKSMIAVLLTLQKSEPEVYTDTVITALCANLFGAGTETTSTTTEWAMSLLLNPPXALKKAQAEIDAAVGTSRLVTADDVPHLTYLQCIVDETLRLHPAAPLLLPHESAADCTVGGYDVPRGTMLLVNVHAVHRDPAVWEDPDRFVPERFEGAGGKAEGRLLMPFGMGRRKCPGETLALRTVGLVLATLLQCFDWDTVDGAQVDMKASGGLTMPRAVPLEAMCRPRTAMRGVLKRL

SEQ ID NO: 84607 - protein, 490 aa, Oryza sativa Indica Group
MERALDSLTYKGSIPDAILQSRRDNKLFVVYISDPQKAIPSISVIGQNGVMLWCHEGYISSKDLKENIEKAWATLHLQGTAAAFLTASLASRMTEPVNTTPTTLPTQGGSSAAENPSTSSNQSTGTSGASGFANPTDSVAQPPRSTSRDETPSISEKESSNLDSSPGNRTVQERPDSDSAQVKGSLPDHPRSSNIEGCANPVQSGNTASLKQKNKVDDGFTKVSSESVPTRVASRGKSSKVAVDQDKATTTSTPIEPAPVRSNDIQLVVRIPDGPSLQIKLTKDDNLRKVKNFVDENRANGAGSYDLAMLYPRKVFTEQDMEATLHELGIETRQALTIVPHHKTIRAAKRQSSSSPHEGDNNMDADSSGGSGYFGYLRTALSFVNPLSYLRANAAPSNPDQLANQGSPQYRPSTGPWNRPGEDTASESRIPDSASQQAARDTSSGSTLRRRPRQFGGNVHSLRSDDQGPSDDRNVYWNGNSTEFGGEDKK

SEQ ID NO: 84608 - protein, 330 aa, Shewanella sp. MR-7
MQTLAQHLTSKAVNESLSQLILTLADTSKAISHAVRHGALAGVLGATEQENVQGETQKKLDIITNDMLKDALKADGTVRGLASEEEDHVVEVSANGQYLVCFDPLDGSSNIDINSLVGTIFSVLPAPAGELTETSFLQSGRNQLAAGYVLYGPSTMLALTTGQGVQLFTLHPETNEFLLTNAAMSISPDTQEFAINMSNQRFWEAPMQTYIADLLLGKIGPREKSFNMRWIAAMVGDVHRVLSRGGIFTYPTDNKDPKKPYKLRLMYEANPMALLVEQAGGKASTGYETILDIQPTQIHQRVAVILGSANEVDACLSYHGIDYSEEPTLD

SEQ ID NO: 84609 - protein, 200 aa, Vitis vinifera
  misc_feature (14)..(14): Xaa can be any naturally occurring amino acid
  misc_feature (16)..(17): Xaa can be any naturally occurring amino acid
  misc_feature (22)..(23): Xaa can be any naturally occurring amino acid
  misc_feature (53)..(53): Xaa can be any naturally occurring amino acid
  misc_feature (55)..(55): Xaa can be any naturally occurring amino acid
  misc_feature (66)..(66): Xaa can be any naturally occurring amino acid
  misc_feature (132)..(132): Xaa can be any naturally occurring amino acid
  misc_feature (137)..(137): Xaa can be any naturally occurring amino acid
  misc_feature (144)..(144): Xaa can be any naturally occurring amino acid
  misc_feature (165)..(166): Xaa can be any naturally occurring amino acid
  misc_feature (170)..(170): Xaa can be any naturally occurring amino acid
MSRVVLLSSAHLHXVXXLQPEXXSDDEEMNYFFRLKCEQCGWISENEVCVNMXVXEHAPGSSRRNXRVNLSLKCEGCERQGTITLVLGNGCPLRVDDCTNVPLMVFDCNGTFPVYYSFNGGWSAVTESGRSXNLNLXEGKYNAXVDGEYIEIKELKTKFEPYNGXXYAWXFCLGVSVGSGCFCFSFYVFLSVYFPFRLHL

SEQ ID NO: 84610 - protein, 350 aa, Vitis vinifera
  misc_feature (74)..(74): Xaa can be any naturally occurring amino acid
  misc_feature (99)..(99): Xaa can be any naturally occurring amino acid
  misc_feature (105)..(105): Xaa can be any naturally occurring amino acid
  misc_feature (123)..(123): Xaa can be any naturally occurring amino acid
  misc_feature (145)..(145): Xaa can be any naturally occurring amino acid
  misc_feature (167)..(167): Xaa can be any naturally occurring amino acid
  misc_feature (169)..(169): Xaa can be any naturally occurring amino acid
  misc_feature (175)..(175): Xaa can be any naturally occurring amino acid
  misc_feature (214)..(214): Xaa can be any naturally occurring amino acid
  misc_feature (243)..(243): Xaa can be any naturally occurring amino acid
  misc_feature (276)..(276): Xaa can be any naturally occurring amino acid
  misc_feature (281)..(281): Xaa can be any naturally occurring amino acid
  misc_feature (293)..(293): Xaa can be any naturally occurring amino acid
MSRVVLLSSAHLHIVTLLQPEVRSDDEEMNYFFRLKCEQCGWISENEVCVNMPVQEHAPGSSRRNSRVNLSRKXEGCERQGTITLVPGHGRPLRVDDCXNVPLMXFDCNGTFPVYYSFNGGWXAVTLKCEQCGWISENEECVNMXVQERAPGSSRRNNRVNLSLKEXGXSINLNXVEGKYNVVVDGEYIEIKELKTKFEPRSSRLQCKRATVDXKIKTKTLKCEQCGWISENEVCVNMAVQEXAPGSSRRNNRVNLSLKCEGCERQGTITLVPGHXRPLRXDDCTNVPLMVFXCNGTFPVYYSFNGGWSAVTESGRSINLNLVEGKYNAVVBGEYIEIKELKTKFEPYNG

SEQ ID NO: 84611 - protein, 352 aa, Zea mays
MGLDAALFAGKGHGVWYGAALLPGMSPLAQVYSGHQFGVWAGQLGDGRGLLLGEQQLADGRKLDWHLKGAGLTPYSRMGDGRAVIRSSVREFLASEALHHLGIPTTRALALAIGDEPVQRETRERGAMLMRIADSHLRFGHFEHFYYGGEPEKVRQLADYAIHHHWPQLEQEADRYLLWFTDIVKRTASLIAQWQSVGFAHGVMNTDNMSILGLTLDYGPYGFLDDYDADFICNHSDYQGRYAFSNQPMIGLWNLNRLAHALSGLLSTEQLKQALSHYENELMRVWGEKMRAKLGLLTADAGDNAILTDLLALMTAEHSDYTLTFRLLSETQQAETRSPLRDEFIDRDAFDR

SEQ ID NO: 84612 - protein, 580 aa, Oryza sativa
MSEAIPSTRPALRHCVALLRLHLAAPSLAAAKQIHARALRAGVPTSHPLLAKHLLFHLAALRAPPLRYAVAVLSRLLPHGPLDPFPLNTVLRIAAGSPRPRVALELHRRRLALPDTHTYPPLIQACARLLALREGECLHAEAAKNGFVTLVFVQNSLVHLYGACGLFESAHKVFDEMPVRGRNLVSWNSMLNSFAANGRPNEVLTVFWEMLGVDFAPDGFTIVSVLTACAEFGALALGRRVHVYVEKVGLVENSHVSNALIDLYAKCGSVNDARRIFEEMGLGRTVVSWTSLIVGLAANGFGKEALELFSLMEREKLVPTEITMVGVLYACSHCGLVDDGFRYFDRMKEDYGISPRIEHLGCMVDLLGRAGRVEEAYDYIITMPLEPNAVVWRTLLGSCAMHKKLELGKVAWERLVELDPGHSGDYVLLSNLYAAVGMWADVHVLRKTMVKDRVRKNPGHSLVELRNSVYEFVMGDRSHPESEQIYEMLAEIAERLRREGYIPRTSNVLADIEEEEKETALNYHSERLAIAFALLKSLPGIPIRIIKNLRMCGDCHVAFNLISKVYDREIIVRDRSRFHQ

SEQ ID NO: 84613 - protein, 639 aa, uncultured bacterium
MSDTETRAGECLLKRIDAPRDLKALTVDELKVLAKEIRDLILANASEHGGHLAPHLGVVELTLAIHYVFDTDQDRLIWDVGHQSYTHKLVTGRREQFQSIRRKGGLSGYPRRDESPYDAFGVGHSSTSISAALGMAVARDRQKLKHKVIAVIGDGAMTAGMAFEGLAHAGHVGSDLLVILNDNKMSIAPNVGALSSYLSRLITAGVYNRAREDIGSFVKRMLGPQLTRAAHRLEHSVKGLITPGSFFQEFGFRYIGPADGHDLETLVGLLSNIKDFRGPVLFHCVTQKGKGYPFAEEDPLKYHGVKAFDIQTGQFRGSGGDSKKTRVRSFTEAFVETLIEEAHKDSRIVGITAAMPTGTGLSEFEKVFPERMFDVGICEQHAVTFAAGLAADGQKPVCAIYSTFFQRCYDQFVHDVCLQKLPVVFALDRSGAVGEDSPTQQGAYDLSFLRCIPETAILVPRDDLDLAAMLRWSLKQPFPVVLRYARGQAPTIGAPHDRDVTRGEVLREGKEATILAIGPIVSACLGAADKLAAAGISVGVADARSVKPLDAALLEHLADTPIITVEENAIEGGFGSAVLEFYEQRGRVQEVRLLRLGFPDRFMEHATREEQLEEVGLSADGIYRSVCAFLGVQAPEPVK

SEQ ID NO: 84614 - protein, 496 aa, Coxiella burnetii RSA 493
MEIDLLIIGGGINGAGVARDAAGRGLSVILCEKDDLANHTSSASSKLIHGGLRYLEQMKFKLVHEALKEREILLQTAPYLVYPLVFVLPHDAHLRPVWMIRTGLFLYASLARRQSLQGTKRLNLLNAPEGTPLKEKFTLRFTYADCQVDDARLVVTNALGAKAKGAIVLTRTLCQSAVRENGRWKVHLYSQLTKRETIVFAKAIVNAAGAWVSHVLHNIAKVKSTSRIRLVKGSHIVVPKWYKGNHAYILQNPDKRVIFAIPYKNDFTLIGTTDIPFEGDPNKIHISEEETNYLIDSINYYFTKPLTVNDIRSSYAGVRALFDDKSEKAQKITREYHLELNDDNGKMPILSIFGGKLTTYRSLAERVLSKLKPYFPKMGSAWTASTPLPGGDLRGDFNQFLSAMKEKYTWLPKELLFHYASHYGTLMNCLLESATSINDLGEHFGGGLYRKEVDYLIKNEWAKTTEDILWRRTKWGLILSDQEINQLEAFLNDAEQ

SEQ ID NO: 84615 - protein, 1488 aa, Ashbya gossypii ATCC 10895
MLSHHPSTCPDPQRYMIEATGPQWAKTEGHDSRTSLSGSSAPELVAYGSEAGAEERERLSRVMTLQSMGEARAALDPGMAQKVESLARTLSQHTVRDGRLVVDPADFDMKAILSGLVSASQRQDIPMRQTGVLVEGVTVQGVDSSCVEGHDYGDVLALPLTAVRAVRQAMRRRYRNILESVTLLARPGEMVLVLGRPGAGCTSLLKTVAGETDQFHSVEGAISYDGIPQREMMRRYRAEVVYNSEIDVHFPHLTVKQTLDFALACKTPHMRVNNVSRAEYITLMRELYATVFGLRHTYDTKVGNDYIRGVSGGERKRVSIAEALAANASVYCWDNATRGLDASTALEYAQAMRIMTNLLQSTSLVTLYQASENIYETFDKVLVLFEGRQIYFGDVMSAKAYFEEMGYTCPPRQSTTEFLTALTDTNGYHVVKPGHEATVPRLPEEFEQYWLNSKEYRSLLSEIEDYRREVDAHETRDQLEKFKLKGKSKYTHKRSPFMISFFEQVKLCTIRGFQRIYGDKSFTVINVVSAVVQALITGSLYFSSPSNTSGAFSRGGILYYAILYFSLMGLANINFSNRPILQKHKMYTLYHPSAEALASTISACVFRMIALTLFLIVLYFLSGLTVEAWRFFSIYLFLVLASEGINAMFEVITALSTSLSQANAVAGLVMFGISIYSTYMIQKPSMHPWFAWISYILPIRYAFESMLNAEFHGRHMDCADTYVPTGPGYEGVTPENRVCAFIGSKPSQSWVLGDDYLSVNYEYEYENQWRNLGILIAFWIGFLTLKCLATEYKRPMKGGGDSLVFKKGTLAKRKVQDDSESRNVSGAAESKMVASTVGTDDVFDGLKNDDVFIWRDISFSITHNGDKKKLLDQITGYCIPGTLTALMGESGAGKTTLLNTLAQRNVGVITGDMLVNGLPIDASFERRTGYVQQQDVHVKEMTVRESLQFSARLRRPESVSEAEKMNYVEKIIEILGMSDFADALVGDAGYGLNVEQRKKLSIGVELVAKPSLLLFLDEPTSGLDSQSSWAIVQLLKRLAQSGQAILCTIHQPSATLFEQFDRLLLLQKGGQTVYFGDIGEESRTLLDYFQRNGARPCTPSENPAEYILESIGAGATATTTEDWAELWRNSPECARENEIVNKLVNELSEKYLSNAPAPISKYATSYFYQFRYVVSRTMLIFYRDLDYLLSKQFLFLSAGLFIGFTFYDVGTSYTGLRNTMFAVFMSIITSAPAMNQIQARAIKMKDLYIVRESKSNLFHWSLLLITQYLAELPYQFLFSTIYFLCMFFPMKLGLSARENGIFFLNFCIVFQAYFVGLGLAVLYLAPNLESANVILGVFLSFLISFCGVVQPYYLMPGFWKFMYRLSPYTYFTQNFLGIMLHDRPVRCNSREFSFLDPPNGVTCGEYMQPFVNSVSGYVDNPDATSNCAYCIYRVGDEYLASIGAKYSYLWRNFGILWGYVAFNIIAMLSLYWLFRVKKVTIKNPFKRD

SEQ ID NO: 84616 - protein, 587 aa, Erythrobacter sp. NAP1
MAGELTMSPVMQDALVILGSAGIVIPVFARFRITPIIGFILIGILVGPYGLGSLVDQFEWLQYVSISDPDRLTPFADFGIILLLFAIGLELSFNRLWQLRRLVFGLGSLELLIIGSISAGFFGYASGMATEAALALGFALAFSSTAIVLPISGTKSPVGRAALSMLLFEDIMIVPIIFILGALAPTASGDSVSDLTNTLIQGGIVILVLLVAGRFALPSLFSQAARTKSPELFLAASMLVVIGASLATAATGLSPIVGALIAGLLIAETEYHGEVESIMEPFKGLALGVFLITIGMSIDLRVIWADLGTIMGAVVGVLVFKAVVTGALLRMMGARRSTAAETGVLMASPSETTLIVLAAATSALVVDTETAQFWQIVTAIGLTITPLLAKLGRAIARRVEAVPDLPDDDDGEPRTIIVGAGRVGRLIADMMTAHDQPHVLIDSDPDVVDAAKRKGYRVMFGDAARGDVLARVGIAEAPALVFTMDEPVLAQRLVARLRADHSELLIVVRARDTDHAAQLYRAGASHAVPENLESSLQLSEAVLVDIGVAMGPVIASIHEKRDEFREQLEVDGGLKSPPKLRTSTVEN

SEQ ID NO: 84617 - protein, 387 aa, Oryza sativa Japonica Group
MQRALAVVALLAAAAAIAAAQGESPELLPFAVGAAPEGCDVGEGEWVFDEAARPWYAEEECPYIQPDLTCQAHGRPDAAYQRWRWQPRDCSLPSFNATGMLEMLRGKRMLFVGDSLLRGQYTSLLCLLHRGAPGGGGGSRSFETVDSLSIFRAKDYDATIEFYWAPMLAESNSDGAAVPDDRLIRGAPMNKHSSFWKGADVLVFNSYLWWMTGDKIQILRGADEDMSKDIVEMEAAEAYRLVLHQVTRWLEGNVDPKSARVFFVTASPSHAGAGGECYDQTTPVGAADAASYCGSTSRRMVQVAGEVLGASRVPVGVVNVTRMSELRRDAHTQVYREQRWAKPTAEQLAADPRSYADCTHWCLPGVPDAWNELLYWKLFFPARDEAI

SEQ ID NO: 84618 - protein, 430 aa, Deinococcus radiodurans R1
MSNVFYRSSKPYPVAVRGEGVFLYDDAGRRYLDGSSGALVANIGHGRAEVGERMAAQAARLPFVHGSQFSSDVLEEYAGRLARFVGLPTFRFWAVSGGSEATESAVKLARQYHVERGEPGRFKVITRVPSYHGASLGSLAASGMGARRELYTPLMRPEAWPKLPKPDPARNGAEDAEGLRALLEREGPETVAAFMAEPVVGASDAALAPAPGYYERVRDICDEAGIIFIADEVMSGMGRCGSPLALSRWSGVTPDIAVLGKGLAAGYAPLAGLLAAPQVYETVMGGSGAFMHGFTYAGHPVSVAAGLSVLDIVEREDLTGAAKERGAQLLAGLQALQARFPQMMQVRGTGLLLGVVLGDLATGQAFETPGIASRIGAAALKRGLITYPGSGAEPNGRGDHLLLGPPLSITAAEVDELLALLAGALEDVLG

SEQ ID NO: 84619 - protein, 202 aa, Escherichia coli
ELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 84620 - protein, 540 aa, Arabidopsis thaliana
  misc_feature (128)..(128): Xaa can be any naturally occurring amino acid
MSKDKVSSPTADLIPQLAATLVAALGAQCYRLTLPPSPPPRILTPQVPPSSATMASSFNPTRILDHRASSHRNRRGAFPASKRRRLVDEPIDYPDLSNPAYQVLSTPLFASGIGSIRELLSSSPPPTXTSSQPPSVSIPPPSAPPLVLSDSKDAEPAGLTNPSAPPSPLAPKNITPVASPVADVPMPDPLISPTAETAEGASVPDAAVSYAARAAAHRQVFAERDELDRTLRRPLVPPHTKRFLSAAAAERYKHIAKRDFIFQKTLPLDPEVLTATKYFLEHSGMAQTVVAVEQFVPEVVREFYANLPEMEYRECGLDLVYVRGKMYEFSPALINHMFSIDDSALDPEAPVTLSTASRDDLALMMTGGTTRRWLRLQPADHLDTMKMLHKVCCGNWFPTTNTSTLRVDRLRLIDMGTHGKSFNLGKLVVTHTMSLARLGPLSSHRLAYPNLIYQLLTFQRDVRSRPRDTLSDEPGVFVNDPPPTQPTQAPPPMGHKLLLEDINDLLEIGKRIRRRLTGKLFSCFMWCFAYCVLALCFLEF

SEQ ID NO: 84621 - protein, 297 aa, Geobacillus stearothermophilus [sequence omitted]

SEQ ID NO: 84622 - protein, 495 aa, Deinococcus radiodurans R1
MTAEPQVSPAPTPPPAAPLLVRDRLFIGGEWVTPCGQGTLEVVNSATEEVMGTVPEGTPEDAERAILAARAAFDSWSQTPAEERAALLERISRGLNERQSEIAALVAQEVGMPFVLSNVIQVGLPAVTFMSMAEEIRQLPAEETLASSLLLREPVGVVAAITPWNYPLHQIAAKVAPALAAGCTVVLKPSEVAPLNAFVLAEIIEAAGAPAGVFNLVTGTGPVVGEVLAAHPEVDMVSFTGSTAAGKRVSELAARTVKRVALELGGKSPYLILDDADLSGEALVQAVMNGIQGCYLNSGQTCSALTRMLVPRSRLPEVEAVAQAVVSQVKVGSPFDAATTLGPLVSDVQRERVRGHIRQGVAEGARLIAGGAESPEGLERGYYVQPTIFSDVTPEMTIAREEIFGPVLVIQPYEDEEDAVRIANATHYGLAGGVWSSDRERAVRVARRLRTGQVSINGGAFNPVAPFGGYKQSGNGREFGRLGLEEFMEVKALQF

SEQ ID NO: 84623 - protein, 353 aa, Triticum aestivum
  misc_feature (287)..(287): Xaa can be any naturally occurring amino acid
MFEPLIFDLWYFGHFLNPARKAARIPPHPSLSAAGKLMEPNADKLRGLRITSLDDEDDDEIELPATVAAAASGYDDDDEDEDEEAEVMLGFLEKPKHPGLLRHLFPSKAGGIPAWLDPVNLPSGNSSCCGFCGEPLHFVLQIYAPIESNAAAFHRTLFMFMCPSMACLHRDQHEQWTRNQGNPRRSVRVFRCQLPRTNVFYSSKPPSHNNSDKPLCAGAALCHWCGTWKGDKICGGCKKSRYCSEKHQALHWRSGHKNDCLQIINSSEASSSVLPAVGKVPARTSWXPEYQIAMDDEVDWDSDGCDGNSPNLGDAKAGNQMNQAGMDGSLGVEVTQMLAFFKNVSKAQSSFEF

SEQ ID NO: 84624 - protein, 402 aa, Streptomyces anulatus
MEFRQSSKLSEVCYEIRGPVIEHANALEEAGHSVLRLNTGNPALFGFEAPEEIVQDMIRMLPQAHGYTDSRGVLSARRAVAQRYQALGLDEVSVDDVFLGNGVSELVTMAVQALLEDGDEILIPAPDFPLWTAVTTLSGGKAVHYVCDEAADWYPDLDDMASKITDQTKAVEIINPTGAVYPKEILEGILDLARRHGLMVFADEIYDQILYDDAVHHSVAALAPDLVVLTFCGLSKTYRVAGFRSGWLVITGPRQHARDYLEGLTMLASMRLCPNAPAQFAIQAALGGRQSIRELTAPGGALHEQRDRAWEKLNEIPGVSCVKPKGALYAFPRLDPKVHPIHDDEKFVLDLLLQEKIQVVQGTGFNWPRPDHFRILTLPHADDLDAAISRIGRFLSGYRQGR

SEQ ID NO: 84625 - protein, 157 aa, Pyrococcus furiosus DSM 3638
MKVRTFEGDYRGEGLRIAVVVSRFNDLLTEELLKGALDCFKRHGVEEVHIFRVPGSFEIPITVKKIAKRGYDAILALGVLIKGETRHFELVASQVSRGIAQVSLEEGIPVIFGIVPAEDEIQAISRSGIKSNRGFEYALTTIEMANLFRKLGENNER

SEQ ID NO: 84626 - protein, 390 aa, Pyrococcus furiosus DSM 3638
MRNMNIEEIRNSFLSGRPAVLIDEERENEADLVFPAEIATPKVVNFMLSAKGLLCLALDMEEGIKRGFFKLPNNGGETNFLIPVDYKDVFTGITAEERALTARKVAEGLGIENFRYPGHLPLLGGLGLNKRKGHTEASLELVEMAGFKRYALIIEILDDKGYSHNLDYAFHFAKEHDLPLIRIREIWKEFVRRKQLIHVYSKAKLPTKYGDFEIYSFKNDLDFKDHVALVKKPFKGTPLVRVHSKCLTGDTLGSLKCDCGSQLENALRTISQEGGVLIYLDQEGRGIGLREKIRAYEFQDRGLDTVEANKALGFAPDERTYEVAFQILRALGIEKIKLLTNNPSKVKALRELGIEIEDVIPLPGEINRYNFFYLKTKVEKLGHKIPGVEV

SEQ ID NO: 84627 - protein, 199 aa, Oryza sativa
  misc_feature (167)..(167): Xaa can be any naturally occurring amino acid
  misc_feature (180)..(180): Xaa can be any naturally occurring amino acid
MASAAVAVAPVVSDLVDFLNASPTAFHAVDEAKRRLKAAGFSQLSEREEWAGLQPGRKYFFTRNHSTIVAFAIGAKYAAGNGFHIIGAHTDSPSLKLKPVSKVTKGGYLEVGVQTYGGGLWYTWFDRDLTVAGRVIVREKKDGAVSYAHKLVRVQEPVMRIPTMDIXFDRTISSNCLKIXDQNHHVPDAGNCAKNRMRQ

SEQ ID NO: 84628 - protein, 389 aa, Blastopirellula marina DSM 3645
MNVEGQSRIYLDNAATSWPKPPGVIEAMRRHLEQIGAPAGRSGYHEAAVVERAVSETRRQLAYLLGVREAERVVFTFNGTDSLNTVMHGFLRAGDHVVTTTIEHNSVLRPLAYLASRRGIEVRHAAPDAQGVVSPQAIEEALNEKSRLIVISHASNVTGALQPIEAITEMAHRRGVRVLVDGAQTAGHTPIRLEESGVDFFACSGHKGLLGPLGVGVLYLAPGAEIETESFRQGGTGTLSQHPQQPDTLPDKYESGNPNVTAILGLQAAVEYLRDRTVTAIEREMRERTAQLLEGLAGIPSIDVFGPLSAADRIGVVSLNVPGFDPHELASYLDSAHHIQVRAGLHCAPLMHQQLGTTDRGGAVRFSVGAFTTAAEIEKVLSALSSLVH

SEQ ID NO: 84629 - protein, 259 aa, Arabidopsis thaliana
MTSNLFQPPSMAASRGAISRRTGNVKVLVSFTSSNGKTLSFSDNSFRLRPMFIGKVTEQSSCSSPNEQQQDEEQEQEQEEITVSHIKEELYEALKGINRGIFGVKSDKKTEIEGLVKLLECRNPTPEPTGELDKIGGCWKLIYSTITVLGSKRTKLGLRDFVSLGDLLQQIDIAQGKTVHVLKFDVRGLNLLDGEFRIVASFKISSKSSVEITYESSTIKPDQLMNIFRKNMDLLLGIFNPEGLFEISYPFLIKIQNRN

SEQ ID NO: 84630 - protein, 335 aa, Shewanella sp. MR-7
MRNRVLCFGEALIDFLTIGNSEDDGLKLPSFRQYPGGAPANAAVAVAKLGGDARFAGLVGNDKFGDFLAEALARYGVDISLLGRHDTAPTSLAFVHLDDTGERSFSFYRDGGADTLFDATTVDSNWFENTSILHLCSNTLTTTQCAETTLEIAERAVTTGVTLCVDVNLRHNLWSQGKACKETVMRLVSKAHVLKFAKEELEYLAGKEATQFIDMLLSLGCRLVLVTDGGNPISAYANQRSLTLTPPKVKVADTTAGGDGFIGGLLYRISSCGLDALLADETALKQALTFAIACGALAVSRPGAFPALPVLAEAEGFSTELGALFADKTFTDFIF

SEQ ID NO: 84631 - protein, 130 aa, uncultured archaeon
MQVVISDPKTGKAYKVEGKDTEAHALFIGKRIDDVVDADIIGLGGYVLEITGGSDKEGMPMRKDVSGTARRQILITSPPGYRPTENGKRRRKSVRGNEISTEISQINVKIKEYGSKPLEGLFGASEEGGS

SEQ ID NO: 84632 - protein, 224 aa, Zea mays
MSQDQENGGTNGQHAADVMEVEPKRRAPRLNERILSSLSRRSVAAHPWHDLEIGPEAPAVFNVVVEITKGSKVKYELDKKTGLIKVDRILYSSVVYPHNYGFVPRTLCEDNDPMDVLVLMQEPVLPGAFLRARAIGLMPMIDQGEKDDKIIAVCADDPEYRHYNDISELSPPPLQEIRRFFEDYKKNENKEGAVNDFLPAAAAREAIQYSMDLYGQYIMQTLRR

SEQ ID NO: 84633 - protein, 133 aa, Triticum aestivum
  misc_feature (68)..(68): Xaa can be any naturally occurring amino acid
  misc_feature (71)..(71): Xaa can be any naturally occurring amino acid
  misc_feature (83)..(83): Xaa can be any naturally occurring amino acid
  misc_feature (92)..(92): Xaa can be any naturally occurring amino acid
  misc_feature (101)..(101): Xaa can be any naturally occurring amino acid
  misc_feature (103)..(103): Xaa can be any naturally occurring amino acid
MAPTVMASSATSVAPFQGLKSTAGLPVSRRSSSAGLGSVSNGGRIRCMQVWPIEGIKNSETLSYLPPXLQXEASLKQVDYLIXRSNWVPCLXFNKLVPFPXRXHSPGYMAILAWNCYFGSTKVSVRRYLSVTA

SEQ ID NO: 84634 - protein, 187 aa, Glycine max
  misc_feature (50)..(50): Xaa can be any naturally occurring amino acid
  misc_feature (78)..(78): Xaa can be any naturally occurring amino acid
  misc_feature (98)..(98): Xaa can be any naturally occurring amino acid
  misc_feature (119)..(119): Xaa can be any naturally occurring amino acid
  misc_feature (142)..(142): Xaa can be any naturally occurring amino acid
  misc_feature (151)..(151): Xaa can be any naturally occurring amino acid
ASQWHDSSRKTLWYGEETDVILSPWPIYLGRIAMSRYARSILSDLCDRHXDKSIILVQNILKLVPLWSISEVFSTPFXIIHHTVHHHLGWPLYLLGVXTECFIAVNAFMIPMFPVLKPXWGSIGAVIVKAFPWYSDGVERAXLCVIGPAFXSAQCVWASMTRIMSGFHQFLEREAFCPRLGEFSPQS

SEQ ID NO: 84635 - protein, 72 aa, Oryza sativa Japonica Group
MIASVSPGTKFFAVCETGAQNIETLLKVIYELYTDFVLKNPFYEMEMPIRCELFDLNLAQVIQKDRVTLLGR

SEQ ID NO: 84636 - protein, 88 aa, Oryza sativa Japonica Group
MASAAIYSLFIINKSGGLIYYKDYGSAGRTDTNDSLRLASLWHSMHAISQQLSPTHGCEGIDLLQAHNFDLHCFQSLTVSSHFSAARS

SEQ ID NO: 84637 - protein, 224 aa, Arabidopsis thaliana
MDSSMSTKKKTKLSVRNQTCFKKSSLSSSSTAKKTTNLSMREETMFKKALELSTLCDIEVCVIYYGRDGELIKTWPEDQSKVRDMAERFSKLHERERRKKRTNLSLFLRKKILDDNKLSEKVLEMKDSLESGLRVLQDKLLLLQPENQTELGQSRAVSSTTNPLSSPEDHHHQQWTEPLVTGVSNTEQDLSTSPLSNHQSKYSVFVYNHDSGSFYQVPDSICFG

SEQ ID NO: 84638 - protein, 496 aa, Arabidopsis thaliana
MGLPGKNKGAVLSKIATNNQHGENSEYFDGWKAYDKDPFHLSRNPHGIIQMGLAENQLCLDLIKDWVKENPEASICTLEGIHQFSDIANFQDYHGLKKFRQAIAHFMGKARGGRVTFDPERVVMSGGATGANETIIFCLADPGDVFLIPSPYYAAFDRDLRWRTGVEIIPVPCSSSDNFKLTVDAAEWAYKKAQESNKKVKGLILTNPSNPLGTMLDKDTLTNLVRFVTRKNIHLVVDEIYAATVFAGGDFVSVAEVVNDVDISEVNVDLIHIVYSLSKDMGLPGFRVGIVYSFNDSVVSCARKMSSFGLVSSQTQLMLASMLSDDQFVDNFLMESSRRLGIRHKVFTTGIKKADIACLTSNAGLFAWMDLRHLLRDRNSFESEIELWHIIIDRVKLNVSPGSSFRCTEPGWFRICFANMDDDTLHVALGRIQDFVSKNKNKIVEKASENDQVIQNKSAKKLKWTQTNLRLSFRRLYEDGLSSPGIMSPHSPLLRA

SEQ ID NO: 84639 - protein, 461 aa, Streptococcus pneumoniae R6
MEFSKKTRELSIKKMQERTLDLLIIGGGITGAGVALQAAASGLETGLIEMQDFAEGTSSRSTKLVHGGLRYLKQFDVEVVSDTVSERAVVQQIAPHIPKPDPMLLPVYDEDGATFSLFRLKVAMDLYDLLAGVSNTPTANKVLSKDQVLERQPNLKKEGLVGGGVYLDFRNNDARLVIENIKRANQDGALIANHVKAEGFLFDESGKITGVVARDLLTDQVFEIKARLVINTTGPWSDKVRNLSNKGTQFSQMRPTKGVHLVVDSSKIKVSQPVYFDTGLGDGRMVFVLPRENKTYFGTTDTDYTGDLEHPKVTQEDVDYLLGIVNNRFPESNITIDDIESSWAGLRPLIAGNSASDYNGGNNGTISDESFDNLIATVESYLSKEKTREDVESAVSKLESSTSEKHLDPSAVSRGSSLDRDDNGLLTLAGGKITDYRKMGDEALWSAWLTSSKQNLTVALN

SEQ ID NO: 84640 - protein, 348 aa, Zea mays
MSSHAVGTSNGGSGDAAAGGAARRNTRMPKYSKFTQQELPACKPILTPKWVVSVFFIVGVIFVPIGVVSLLAARDVVEIIDRYDEACVPGNMTENKLAYIQNDTLSKECIRNLTVTKDMKQPIFVYYELGNFYQNHRRYVKSRNDAQLRDASKANQTSACEPEKTTANGQPIVPCGLIAWSLFNDTYNFTRGNENLTVDKKDISWKSDREHKFGKDVYPSNFQNGALKGGATLNPKIPLSEQEDLIVWMRTAALPTFRKLYGRIYFDLKENDTITVRLNNNYNTYSFGGKKKLVLSTATWLGGKNDFLGFAYLIVGGLCIFLAFAFTLLYFVKPRKLGDHNYLSWNRR

SEQ ID NO: 84641 - protein, 473 aa, Aspergillus oryzae
MSSICRKGHIDAAIYEHHLSRRAAENFKYRDVWGPREKSMANPWSPETPMGRSIILRLAENSLLHDEMGQFIKEQINVLPLSHLTYSTGPRGSCRLRRAAAAFLNEEFHSLQTIAQDNIFVTPGLASAIDALIWAICNDGDGILVPQPYYNGFDFDTLNRSNGRVIGVKYEGIEGFSELDDLFRPDVNKRALEVALREAKKNGITIRALLISNPHNPLGRCYPPKTLLEFASFCGKNQLHVISDEIYAKSVFLNAALSSPTPFVSILALDIHKVIELNLTHVLYGASKDFCANGLRLGLVCTNNEGLIGALSSISMFSWSPHVLQDVWAAMLEDRQQTIISQRPSSGNVVLATTRCKYTSTCNRPHGLIASTNAGLFIWVDLRHLLIPESSRDQTGYRELRVTSPDASVYKQREQRFADICAQNGLMIAPGSIYAAEEFGWFRLTFTVGKNALEEGLKRLDKSLKAAETDLRI

SEQ ID NO: 84642 - protein, 701 aa, Streptococcus pneumoniae R6
MFASKSERKVHYSIRKFSIGVASVAVASLVMGSVVHATENEGSTQAATSSNMAKTEHRKAAKQVVDEYIEKMLREIQLDRRKHTQNVALNIKLSAIKTKYLRELNVLEEKSKDELPSEIKAKLDAAFEKFKKDTLKPGEKVAEAKKKVEEAKKKAEDQKEEDRRNYPTNTYKTLELEIAEFDVKVKEAELELVKEEAKESRNEGTIKQAKEKVESKKAEATRLENIKTDRKKAEEEAKRKADAKLKEANVATSDQGKPKGRAKRGVPGELATPDKKENDAKSSDSSVGEETLPSSSLKSGKKVAEAEKKVEEAEKKAKDQKEEDRRNYPTNTYKTLDLEIAESDVKVKEAELELVKEEAKEPRDEEKIKQAKAKVESKKAEATRLENIKTDRKKAEEEAKRKAAEEDKVKEKPAEQPQPAPATQPEKPAPKPEKPAEQPKAEKTDDQQAEEDYARRSEEEYNRLTQQQPPKTEKPAQPSTPKTGWKQENGMWYFYNTDGSMATGWLQNNGSWYYLNANGAMATGWLQNNGSWYYLNANGSMATGWLQNNGSWYYLNANGAMATGWLQYNGSWYYLNSNGAMATGWLQYNGSWYYLNANGDMATGWLQNNGSWYYLNANGDMATGWLQYNGSWYYLNANGDMATGWVKDGDTWYYLEASGAMKASQWFKVSDKWYYVNGSGALAVNTTVDGYGVNANGEWVN

SEQ ID NO: 84643 - protein, 1750 aa, Haemophilus influenzae
MLNKKFKLNFIALTVAYALAPYTEAALVRDDVDYQIFRDFAENKGRFSVGATNVEVRDKKNNNLGSVLPKDIPMIDFSVVDVDKRIATLINPQYVVGVKHVSNGVNELHFGNLNGNMNNGNAKAHRDVSSEENRYFSVEKNEYPTKLNGKAVTTEDQTQKRREDYYMPRLDKFVTEVAPIEASTASSDAGTYNDQNKYPAFVRLGSGSQFIYKKGSRYQSILTEKDKEGNLLKSWDVGGDNLELVGNAYTYGIAGTPYKVNHENNGLIGFGNSKEEHSDPKGILSQDPLTNYAVLGDSGSPLFVYDREKGKWLFLGSYDFWAGYNKKSWQEWNIYKSQFTKDVLNKDSAGSLTGSNTQYNWNPTGKTSVISNGSESLNVDLFDSSQDTDSKKNNHGKSVILRGSGTLTLNNNIDQGAGGLFFEGDYEVKGTSDSTTWKGAGVSVAEGKTVTWKVHNPQSDRLAKIGKGTLIVEGKGENKGLLKVGDGTVILKQQADANNKVKAFSQVGIVSGRSTVVLNDDKQVDPNSIYFGFRGGRLDANGNNLTFEHIRNIDDGARIVNYNTSKTSTVTITGDNLITSTSQISLVYNIPLRDEENPYVRRQIKYGGQLYFNEENRTYYSLKRGASVYSELPYNDKVSNENWLYMGKTSDEAKRNVMNHINNERMNGFNGYFGEEEGKNNGNLNVTFKGKTDQNRFLLTGGTNLNGDLKVEKGTLFLSGRPTPHARDIAGISSTKKDPHFAENNEVVVEDDWINRNFKATNINVTNNATLYSGRNVANITSNITASNEAKVHIGYKTGDTVCVRSDYTGYVTCHNGNLSEKALNSFNATKVSGNVNLTESANFTLGKANLFGTIHSTENSQVRLTENSHWHLTGNSNVNQLNLDKGHIHLNNVSDATKATKYHTLNISNLSGNGSFYYLTDLSKKQGDKVVVTKSATGNFTLQVADKTGEPNHNELTLFDASNATRNNLNVSLVGNTVDLGAWKYKLRNVNGRYDLYNPEVEKRNQTVDTTNITTANNIQADVPSVPSNNEEIARVEAPVPPPAPATPSETTKTVAENNPQESETVEKNEQDATETTAQNGEITKEAKPSVKANTQTNEVAQSGSETEETQTTETKETAKVETEKTQEAPQMASQASPKQAEPAPEKVSTDTKVEETQVQAQLQTQPTTVVAVEATSPNSKLAAETQPSEKANAEPVTPVVSKNQTENKVSQPTETEKTQEVPQVASQASPKQEQSETVQPQTALESENVPTVKNAEEVQAQLQTQTSATVSTEQPAKETSSNVEQPVTESTTVNTGNSVVENPENTTQPAVNSESSEPKSRRRRSISQPQETSTDETTAADNSESSETKRRSRRSVSQPQETSAEETTVTSTDETTVADNSKSSETKRRSRRSVSQPQETSAEETTVTSTNETTVADNSENNKTNTRRRSRRSVRSVPHNVEPATTSSNDRSAMPLRDLTSTTTNAVLSDAMAKAQFVALNVGKAVSQHISQLEMNNEGQYNVWVSNTSMNENYSSSQYRRFSSKSTQTQLGGDQTISNNVQLGGVFTYVRNSNNFDKATSKNTLAQVNFYSKYYADNHWYLAVDLGYGNFQSKLQTNHNAKFARHTAQFGLTAGKAFNLGNFGITPIVGVRYSYLSNANFALDQARIKVNPISVKTAFAQVDLSYTYHLGELSVTPILSARYDANQGSGKINVTRYDFAYNVENQQQYNAGLKLKYHNVKLSLIGGLTKAKQAEKQKTAELKLSFSF

SEQ ID NO: 84644 - protein, 1852 aa, Haemophilus influenzae
MLNKKFKLNFIALTVAYALTPYTEAALVRNDVDYQIFRDFAENKGKFSVGATNVEVRDKNNHSLGNVLPNGIPMIDFSVVDVDKRIATLVNPQYVVGVKHVGNGVSELHFGNLNGNMNNGNAKAHRDVSSEENRYFSVEKNDFPSTVNPQNEQKRREDYYMPRLDKFVTEVAPIEPSTDSSKKGTYNNKEKYPAFVRLGSGTQFIYEKNGSYDDRWVISGREQPVHYSNLKLVGKAYTYGIAGTPYTVNHVTDGLVGFGDSTQKHIDPKEILSQDPLTNYAVLGDSGSPLFVYDKEKGKWLFLGSYDYWAGYDKKSWQEWNIYKPEFATEVLNKYNAGSLTGANTQYNWNSTDNTSIISSDSKSLNVDLFDSSQDTDSKKNNHGKSVTLRGSGTLILNSNINQGAGGLFFEGDYEVKGTSENTTWKGAGISVAEGKTVKWKVHNPQSDRLAKIGEGTLVVQGKGENKGQLKVGDGKVILKQEADSSGKVKAFSMLGIVSGRSTVVLNDDKQVDPNSIYFGFRGGRLDANGNNLTFEHIRNIDDGARVVNHNMTNTSNITITGTGLITNPSQVTLGYIQARDEDNPYAPRRIKDGYQLYFDEENRNYYTLRKGAKFNSQLPYNDNESNETWLYMGKNSDEAKKKTMEYINNSRMNGFNGYFGEEETKATQNGKLNVTFNGKSEQNRFLLTGGTNLNGDLNVQQGTLFLSGRPTPHARDIAGISSTKKDKHFSENNEVVVEDDWINRNFKATNINVTNNATLYSGRNVESITSNITASSTAQVHIGYKAGDTVCVRSDYTGYVTCHNGTLSTKALNSFNATNVSGNVNLSDNANFVLGKANLFGTIQSTGTSQVNLKENSHWHLTGNSDVHQLDLANGHIHLNSADNSNNVTKYNTLTVNSLSGNGSFYYWVDFTNNKSDKVVVTQSAKGNFTLQVADKTGEPNHNELTLFDASNATRSNLDVTLANGKVDRGAWKYELRNVNGRYDLYNPEVERRNQIVDTTNIATTNDIQADAPSVSSNNEEIARVDEAPVPLPAPPAPATGSAMANEQPETRPAETTQPAMEEANTANSTETVPKSDTATQSDTSNSESVPSETTEKVAENNPQENETVARNEQEAAETTPQNGEVGEVAKEAKPTVEANTQTTETARQPEINSTEETAVKNDLTRSEPKSRPRRSISSSSNNINPAGTEETAKVETEETQKAPQMASQVSPKQAEPVPEKVPTDTNAKEAQPQTQPTTVAAAEATLPNSKPAEETQPNEKTNDEPVTSVSQNQPEKAVSQSTKDKVVVEREEKATVEKEKTQEAPQMASQASPKQEQSETVQPQAELESEKVPTVNNAEAQPQTQTSATVSTEQPAPENSINTGSATAMTETAEKSDKPQTETVASTEDASQHKANTVADNSVANNSASVKPTENSSTKAEQPVTESTTVNTRNSAVENPENTTQPAVNSESSKPKSRHRRSISQPQETSTEETTVTSTEKTTVANNSESSKPNRRSRRSVSQPQETSTEETTVTSTEKTTVADNSESNKTNSRRRSRRSVRSEPTVTSGSNRSAVALRYLTSTNTNAVLSDAMAKAQFVALNVGKAVSQHISQLEMNNEGQYNVWVSNTSMNENYSSSQYRRFSSKSTQTQLGWDQTISNNVQLGGVFTYVRNSNNFDKASSKNTLAQANLYSKYYADNHWYLGIDLGYGKFQSNLQTNHNAKFARHTAQFGLTAGKAFNLGNFGITPIVGVRYSYLSNADFALDQDRIKVNPISVKTAFAQVDLNYTYHLGEFSVTPILSARYDANQGSGKINVNQYDFAYNVENQQQYNAGLKLKYHNVKLSLIGGLTKAKQAEKQKTAELKLSFSF

SEQ ID NO: 84645 - protein, 456 aa, Bacillus licheniformis ATCC 14580
MANKELKRGLGARHIQMIALGGTIGVGLFMGSSSTIKWTGPSVLLAYAICGIFIFFIMRAMGEMLYVEPSTGSFATFGHQYIHPLAGYMTAWSNWFQWVIVGMSEIIAVGEYMKYWFPDLPAWIPGIIAMAILGGANLVSVKSFGEFEFWFAMIKIVTIVLMIAAGFGIIFFGFGNGGQAIGFSNLWSHGGFFTGGFSGFFFALSLVIAAYQGVELIGITAGEAKDPQNTLRHAIQSIIWRILIFYIGAIFVIVTVYPWDELNAIGSPFVSTFAKVGITAAAGIINFVVMTAAMSGCNSGIFSAGRMLYTLGVNGQAPKFFTKISRNGVPLYGTIAVLIGLAIGVVLNYIAPPNIFVYVYSASVLPGMIPWFVILLSHIGFRKAKGAEIDKHPFKMPFAPVTNYLTIGFLLMVLVGMWFNNDTRVSLIVGVIFLAVVAASYYVFGIGKRASADGNK

SEQ ID NO: 84646 - protein, 376 aa, Triticum aestivum
  misc_feature (218)..(218): Xaa can be any naturally occurring amino acid
  misc_feature (301)..(301): Xaa can be any naturally occurring amino acid
  misc_feature (313)..(313): Xaa can be any naturally occurring amino acid
AYLGDTPEQVCTKKQAATGPEFPGYRRPTRPPRRSNSHPAARLRLRCCCSAGDPAAMVKAIRVHELGGPEALRWEEVEVGEPGDGEIRIRNTAIGVNFIDVYFRKGVYPAPLPFTPGMEAVGVVTAVGPGLTGRKVGDVVAYAGKPMGSYAEEQIIPADVAVPVPPKVDHKTAAAIMLKGMTVHMLVRRIFKVETGHTVLVHAAAGGVGSLLCQWANXPLGATVIGTVSNEEKAPHAHFDGCHHVIMYTKEDVATRVKEITGGKGVNVVYDSVGKDTYRASLGRAWRPRGSWVSFGQSSGXPDPISMGDLGGXSLCSLTRPSVMHYTGTPRKSCFKAGGQGFWANGAQGGWFNTPGESNTYPGGPEGGPGAPRRNL

SEQ ID NO: 84647 - protein, 372 aa, Campylobacter lari RM2100
MKPFFEENYGNPNSLHQWGSATHPALKEAMDKLYAGLGASDLDDIIITSCATESINWVLKGVYFDRILNSDRNEVIISSVEHPAVAASAMFLKSLGVKVIELGVDHEGVSSVKDLKEAISDKTALVSIMWANNETGMIFPIEEMAQITHEYGALFHTDATQAVGKIKVNFAKAGVDFASFSAHKFHGPKGVGGLYIKKDIELTPLLHGGEHMGGRRSGTLNVPYIIAMAEALRIANTMLDFENSHIRRLRDKLEDLILAMPDTSVVGDRSRRVPNTILASIKGVEGEAMLWDLNKNGIAASTGSACASEALESNPIMEAIGAENDLAHTALRLSLSRFNTEDEIDYAAEQIKKATQRLRAISSTYAYKPDNI

SEQ ID NO: 84648 - protein, 253 aa, Streptomyces coelicolor A3(2)
MTAHPLFDIGGRTALVTGSSRGIGLALARGLAEAGCRVILNGRDGDRLAKAAAGLPGEVHTAVFDVTDGPSVTAGIAEAEERVGPLDILVNNAGMQLRAPLLEFADADWHRILDTNLTTAFLVGREAARRMTERGHGKIVNICSLQSEVVRPGIAPYAATKGALKMLTKGMCADWGPYGVQVNGLGPGYIETELTRPLVEDEEFSTWVRGRTPAGRWGRTEDLVGGLLFLASPAADFVGGQILYVDGGMTSVL

SEQ ID NO: 84649 - protein, 238 aa, Coccidioides immitis RS
MAETKSRCSRPWEDMSIIGIAGSSGSGKSSVAAEIIKSLNLPGAVILVMDHFYKSLTPEQNAIAHQDEYDFDSPDAIDFDVLVQTLQNLKQGLKVEIPIYSFTKHQREEATVSLYPPRVLILEGILAFTDPRIVDMLDIKIFVEADMDVCLGRRIARDVRERGRTLESVLKQWFKFVKPSYNRFVEPQRQISDIIVPRGIENKTAIDMVVKHIHRIITGAAQRHNPETRPNYQRRLSH

SEQ ID NO: 84650 - protein, 381 aa, Campylobacter lari RM2100
MAMVVEVDENLSYLSPFGFVEGFKIGDRAFINDAGMQIGVSDELLGRVVDPFMRPKDGKGPIEASKFMPIMRAPIDAMKRGLIEEVFPVGVKTIDALLTCGVGQKLGIFAGSGVGKSTLMGMIVKNSKAPIKVIALIGERGREIPEFIQKNLGGKLDDTVIIVATSDDSALMRKYGAFCAMSVAEYFKEQGKDVLFIMDSVTRFAMAQREIGLALGEPPTTKGYPPSVLSLLPQLMERTGKEEGKGTITAFFTVLVDGDDMSDPIADQSRSILDGHIVLSRELTDFGIYPPINIQNSASRVMGDIISDEHKLAARKFKRLNSLLKENEVLLRIGAYQKGTDKELDQAIAKKDFMQQFLSQNPEESFEFEDTINMLKMIDTL

SEQ ID NO: 84651 - protein, 1820 aa, Coccidioides immitis RS
MHGWVHDKFDKRNWLKWVGKGPAPEPREYGVATDYEKYTPKGITRKYYLEITNGTVNFDGVPFTKAKLFNGTYPGPWIQACWGDDLEITITNKLEYNGTAIHWHGLRMLNANLYDGVPGATQCPIAPGDSFTYKFQATQYGTSWYHSHYSLQYSDGLAGPLTIHGPSSADYNFSLDPLLMTDHLHNSAFEEYYQEQAGRPPRMSSILLNGKGSYTGLGDKAPKRKYSTVVKKGKKYLLRLINASTDTTFIFSVDYHNLTVIGADFVPITPYDTDHIAVGIGQRYHVILNTLPKARSGDAYWMRVIPTERCGRFESEHPPDERLGVLYYDRKTRKFPTTMREQFSLKCRDEPFERLKPILSWQVPDPLLYPGIFTNTTRSDVELGKWRMPGRPPSSGEVTYWTIGPSPMWVNYSNPLVKNLDKTRFDDTLVVYPSEDHTRNGWVYLLITDTFSRPNKTAVAHPMHLHGHDYVLLQQSTKPFTPEKLNLTLDNPPRRDVVLLSARGFLVIAFKADNPGSWVLHCHIAWHSSAGLALQILERRDDFKASLMNKQDEVAEVERVCKNWDTWFSNPKNHWEPDGFFQDDSGYVGVVLVQAAGSCRSIILLQQQTTNTMLGPHSSGRPRKDQLLGVAGDMVWGRFWGQGCKTPEIPHPCCISRSEGLGQKTVLHVRHFGAMARCRGHWESQGLVTVAYWRNPFDDTAIVVVVVVVGSAVVSAKKQTQPHGSGEETLARRSPWRLDESSLIFIRTVPATFSPVPETARRFCSVVCHGCQDPTPELRLRISDRQPPAIRKPTSFANIDGRSSACDNGPLTGTRVSPLAHVPSTMTAPHAVETTNTPSALISLRAADLLALGKPFVEFPRYSILDLQRAIGVSNAVGGRGSAYPNRTGNHVSANDRPTGFADWLSEKLQAGHPFVIQDFEKLPQWDRRIFSIEGLIEHSTKKSMALEALDLFFSVPWRFWSLLACNDSQTASRKGDSSVPRCHIPIRNCSTGRDLNFTLRKFADAARQSYREFKNLYARDLPCPEAWLELCRKLLPPEVQWAGRLDLFQWLPPCARSEVMMAYIGSEGSSLVAFIPELQFSTANIPDRSGFHRCFSSTVALNLLIEGSNRPVLCFGTDFESQTKYDTFMASRGASPHVDWLNLDPEELKHADFPLYVHEQKAGDLVVFPPATAHQVWNLGSVATKIVWNILHPLSLEAGLVYVQPPFNRLCHPDVAQSNLSLACAMLSLLGDDPKAPIPPDLHLLTRLFRQMVQEEMITDEPVTSITLVRVPKTAIVTCDFCSTAIWNRHLRCSECEDFDLCLLCFLNGRSCEHIRSYSWAEIVPEETCARVLDRAQQILGYKLDDSQASDRRKPLGTAVNDLMRAKQNTLSRLCHLCRIDHLEWKGRRCDRCAAFFCFRGLYRHFDMNSADVMRHAGLWICPKCLENCNCRCCHFPSAYVKAEKPASKRRVKPADARGKIMGFTDNVFDQKRRNMPSTPGNSNTSVPPKGQKRPLSTPSAMHNLLQDTSEYPITNLNNMPPLNRSSKRSSVTRTNENDIPRQADSEQGRAKIPRQLHGNSRVNQQIRDDGKTLHGIDYITRMPTPASHHVSLPPLKSGCSSEVMVDAASSPTMKRHSTDIATFGNDSCSRNGAYTTPHGRNIDGDDKHDVNHDAPAPLTPITLNPLQPQPLSYTATNPNPIPLSGHPPFSQTTTAVPPTQLRPTTTSTVTSTSTSTSTNALQTPLTSVSTSTSPSSPSLPFLESQLHRLRQYAEELLALSMHDSHRLLQQEIRQLEETLLLAKRERSERLIRSLETEFPNLVNVREGVRREGARLGYF

SEQ ID NO: 84652 - protein, 268 aa, Saccharothrix mutabilis subsp. capreolus
MTGPAPDPTLTAPPPDLALALELADLSDAVTRSRFRARDLRVDRKPDRTPVTDADLAVEQAVRTAWRARPRDRIAGEEGGGAITDRRTWVVDPIDGTKNFLRGVPVWATSLALVEDGRPTVGVVSAPALRRRWWAAAGHGAWAREDRGTARLHVSGVDRLEAAYLSTTSLSTWDLFHSRAAYLRLADACWEDRGFGDFLQHCLVAEGLIDIAAEPVVSPWDVAAVQVIVEEAGGRCTGLRGENVLGAGGGALSANPHLHGQAVALLNP

SEQ ID NO: 84653 - protein, 725 aa, Candida glabrata CBS 138
MSKQQRLKPADDFSYGSIDINIQQMDPRTGRMSSPTPRKYNKDLSPNNGIRVRKVDLNTIDQRPKYQELLPYYLPCMSWIPHYSWEIFFGDLVAGISLASFQIPLALSYATSIAHVEPLCGLYSLAITPLIYAIFGSVPQMIVGPESAISLVVGQATEKFSAHDSEISTVTITMMITFISGVVLFFLGSVRLGFLGNILSKALLRGFISSVGLVMIINSLIIELKLNHKLADVAGHYHTPVGKIMFLFRYASEYYHKPTAILSLICFLVLISTRIAKKKLMNRYRFLIFVPEILLVVSVTILLSLKYDFKHSYGISTIGEFNADGFGSIGNPLSNENRALYSSLWNEGLAVAMLGFFESTTASKSLGSDYNLTYSSNRELIALGFMNIVGSLFGALPSFGGYGRSKVNVFSGGKTVMSGAMVGLITLLTAKLLLPMIHYTPTCVLSVITTVIGISLLEEVPSDIKFHIHCSGYSELTVFTLTFIATLSQSVELGVTVGCIYSLILIVKHSALSRIQILAKLEGSDEFVNVDDYIKNYNGRDFENITLEQFEHCYIVKIPEPLTFTNGEDLRSRLSRLERFGSTNVHPGSTSIVSQDDMEYIIFDLEGMTSMDSGSAQILLEIIRSYVHRDVRVYLTRVSLDREIRIRLKSAGILDLVETVQVNNAVTARYHMNDMIEKTPFFTCIEEALLIIERRAIDGDTNGNDLMHVRSGSVISNTLFNSNLV

SEQ ID NO: 84654 - protein, 251 aa, Pyrococcus furiosus DSM 3638
MSKNYKKHQAYIAGRDKMKVAVITGASRGIGEAIAKALAEDGYSLALGARSVDRLEKIAKELSEKHGVEVFYDYLDVSKPESVEEFARKTLAHFGDVDVVVANAGLGYFGRLEELTEEQFHEMIEVNLLGVWRTIKAFLNSLKRTGGVAIVVTSDVSARLLPYGGGYVATKWAARALVRTFQIENPDVRFFELRPGAVDTYFGGSKAGKPKEQGYLKPEEVAEAVKYLLRLPKDVRVEELMLRSIYQKPEY

SEQ ID NO: 84655 - protein, 396 aa, Blastopirellula marina DSM 3645
MFQNVQTAPPDSILGLNEAFRKDSNPEKINLSVGVFKDSSGVTPVLDCVKEAERRLISDEKTKSYLPIDGRPEYCRLVRELMLGADHEIVTSARGVTVQTPGGTGGLRVAADFLAKNFPGRKVWLSQPTWPNHPNIFAAAGIETAGYPYFDKAANGLAFAEMMTALENIPTGDIVLLHGCCHNPSGIDPTAEQWRAIAELVHRRELLPLVDFAYQGFGDGLCEDAVGLAALSQPGKELLVCSSFSKNFGLYNERVGALTAVATDAEAAQAVLSQLKNTIRANYSNPPTHGGAIVETVLADPKLRAQWEAELTTMRDRINGVRTLLVETMKATGVDRDFSFIADQKGMFSFSGLTPVQVDELRNKFAIYIVGSGRINVAGISESNVGKLCAAIKAVL

SEQ ID NO: 84656 - protein, 291 aa, Mycobacterium tuberculosis
HHHHHHMPSRTALSPGVLSPTRPVPNWIARPEYVGKPAAQEGSEPWVQTPEVIEKMRVAGRIAAGALAEAGKAVAPGVTTDELDRIAHEYLVDNGAYPSTLGYKGFPKSCCTSLNEVICHGIPDSTVITDGDIVNIDVTAYIGGVHGDTNATFPAGDVADEHRLLVDRTREATMRAINTVKPGRALSVIGRVIESYANRFGYNVVRDFTGHGIGTTFHNGLVVLHYDQPAVETIMQPGMTFTIEPMINLGALDYEIWDDGWTVVTKDRKWTAQFEHTLLVTDTGVEILTCL

SEQ ID NO: 84657 - protein, 287 aa, Zea mays
MEGKEEDVRLGANKFSERQPIGTAAQGAGAGDDDKDYKEPPPAPLFEPGELKSWSFYRAGIAEFVATFLFLYITVLTVMGVSKSTSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWSDHVSGNCSRFLSHQLSVSNSVVPLALAV

SEQ ID NO: 84658 - protein, 500 aa, Coprinopsis cinerea okayama7#130
MGAINWLVLLLTHPLEFRTLVQFWLYHEQKRDIKAIKEHPTSGWDRESMRRCWHFLDLTSRSFAAVIKELDGDLARTICMFYLVLRGLDTIEDDMTIPDDVKQPILRRFHEYTVTPGWKYEGCGPNEKDRQLLVEYDTIVEEVNRLAPHYKTVIIDICRKMETGMADYAHKAATTGSIYLSTIAEYDLYCHYVAGLVGEGLSRIFSASGKEAPWLGEQLELSNSMGLLLQKTNIIRDYREDTDEQRYFWPKEIWGSFGFKEMKEMYEEGNKERAQWAQSAMILDALRHCEDSLDYLKMLKNQSVFNFCAIPATMAIATLELCFMNPAMFQRNIKIRKAEAARLIMRSTNPKEVALIFRDYARKIHQKALPSDPSFLKLSVACGKIEQWYEHNYPSFVKLVDSPQGPRPEIDSSDVLAKKRKESGGGAVGGGGVSGANGESSDFPQVTTTEMSVKEVAMYVAAAFGVVLAVSGGIVWVILKLSGPGSPLGGQASGSGFGEL

SEQ ID NO: 84659 - protein, 437 aa, Coxiella burnetii RSA 493
MHSRFQKGKIPNSVLKRDLGLIGATMMGLGSIVGTGIFVSIGVAAGVTGPSVVLAIVLAALVATCNALSSAQLAASHPVSGGTHEYGYRYLHPALGFTAGWMFLCAKIASAATAALGFAGYLLHLLGITSISMIPIAVSIAILLTLLVLSGLKKSNLANLIIVSIILISLITFVLSGLPHLFSMGLPHFKPFFPTAAPSGLRNFLYATALMFVAYTGYARIATLGEEVKNPKRFIPQAIILTLIISAVLYIAVAVVAISIVGADHLSQAAQNRATPLETAARALNRRGLDIILAFGACTAMLGVLLNLMLGLSRMALAMGRKRDLPSMFGTLSKKQRTPSAAILGVGLAIIGLSLIGNVEITWAFSAFTVLIYYFITNLAALQLPKADRLYPRIFPVGGLIACLFLAFWVPLMIWSIGIGLIAVGLAWKYFMARLWI

SEQ ID NO: 84660 - protein, 461 aa, Xylella fastidiosa 9a5c
MGPELFCESRYRDDNPMVLWYCSLLWLLTGPMTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKVSLPVPMMNIINGGAHADNNVDFQEFMVLPVGFASFSEALRAGTEIFHALKSVLKGQGLSTAVGDEGGFAPDLRSNVEALDAILEAIGRAGYIAGEDVLLGLDVASSEFRDNGKYNLVGENKRLTSEQFVDFLDDWVTQYPIISIEDGLAEDDWAGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 84661 - protein, 200 aa, Legionella pneumophila subsp. pneumophila str. Philadelphia 1
MPINLYSKAVFLKSAARVNQLPEDSGYEVAFAGRSNAGKSSALNCLTNNKNLARTSKTPGRTQLINLFSLDEQRRLVDLPGYGYAKVAMEVKLEWQKNLAHYLEARQCLRGLILLMDVRHPLKDLDQILVNWALHRELPVHILLTKADKLSRSEVKNAVLKVRQYYELAEHLVSVQAFSSVKKDGVEELISLLDRWYEWN

SEQ ID NO: 84662 - protein, 478 aa, Pyrococcus horikoshii OT3
MRRMKLPSHKTKIVATIGPATNSKKMIKKLIEAGMNVARINFSHGTFEEHAKIIEMVREQSQKLDRRVAILADLPGLKIRVGEIKGGYVELERGEKVTLTTKDIEGDETTIPVEYKDFPKLVSKGDVIYLSDGYIVLRVEDVKENEVEAVVISGGKLFSRKGINIPKAYLPVEAITPRDIEIMKFAIEHGVDAIGLSFVGNVYDVLKAKSFLERNGAGDTFVIAKIERPDAVRNFNEILNAADGIMIARGDLGVEMPIEQLPILQKRLIRKANMEGKPVITATQMLVSMTMEKVPTRAEVTDVANAILDGTDAVMLSEETAVGKFPIEAVEMMARIAKVTEEYRESFGITRMREFLEGTKRGTIKEAITRSIIDAICTIGIKFILTPTKTGRTARLISRFKPKQWILAFSTREKVCNNLMFSYGVYPFCMEEGFNENDIVRLIKGLGLVGSDDIVLMTEGKPIEKTVGTNSIKIFQIA

SEQ ID NO: 84663 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGDCRHCQSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 84664 - protein, 458 aa, Ashbya gossypii ATCC 10895
MDSTKLSCDKVSLLQLASIRRSVWDSKASHPRLIHMEMVAHQSACQEYSIEILKHLIDLENQTRSSWTSFQSQPELTVEMRTLIFDFIMSCHTRLGLSSSTLFLCYNIIDRYCSKIIVKSPTYQLLGLTALWLASKFADKKPRIPSLQSLCCHQHTKQQFKEMELHILKSLNWSVCSAPSHDSFVDILLKTKIANLSFKRLNLNDLKYGATILCELSCFDPALNYNYNSSAIALASVTVITCALRLAELSEFIDCRRCTTDKNLIVICNQLLCLLACEDNFPSSFNLKYASEGGTLHSNPIMARLFAYYRRLADEKKRSWRDAGTRVGSPCAGSAPASAAGGSPDIRIGGDTPPGSVPPSALGPLAPHMPTIKTFVPPTPTTPSNSSRTQLSLCAKPHTLPAPVSVAASARAKGTAHQHTPPVQNPAHLLHTAQSKRAASAMDLEFFDMDHALVKKLR

SEQ ID NO: 84665 - protein, 305 aa, Miscanthus sinensis subsp. condensatus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 84666 - protein, 508 aa, Legionella pneumophila subsp. pneumophila str. Philadelphia 1
MPFNTRSLKMGYNVPHYIGGQLINETDTEAQAIYNPALGEIIGQVHFASKATCDRAVAIAKAAGNEWSQTPAIKRARVLFRFRELLEKYQMDLARIVTREHGKTLDDAKGSVARGIEVVELHCGLVNELKGDFSAEVASHIDCHTFRQPLGVCAGVSPFNFPVMVPIWMMIPAIACGNTFILKPSEQDPSAPVRLLELLSDAGLPPGVANCIQGNKTTVEHLLAHPDIAAFTAVASTPVAEYIYTTAAAYGKRAHTFGGAKNHCVVMPDADLDQAANAIVGAAYGSAGERCMALSVVVTVGQHTADALINKISPLIRAIRVDAGDVEGTDMGPLVSQAHRQRVLAAIEKGVNEGARLIIDGRTFQHPQYPQGFYLGPCLFDEVTEEMSVYQNEIFGPVLVIVRVNHFEEALALVNKHQYGNGTAIFTRDGFTAREYSQRVQAGLVGINIPIPVPIANHPFGGWKRSVFGDTNMHGEESIHFYTRRKTVTSKWPITELKDSSFAMPTHD

SEQ ID NO: 84667 - protein, 305 aa, Miscanthus sinensis subsp. condensatus
IESVGEGVTDVAPGDHVLPVFTGECKECAHCRSAESNMCDLLRINTDRGVMIGDGKSRFSINGKPIYHLVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 84668 - protein, 598 aa, Vitis vinifera
MSTFLIRCLVPLPFYLLLLYILMNQSKALSPDGEALLSFRNSIVSSDGVLRQWRPEDPDPCGWKGVTCDLETKRVIYLNLPHHKLSGSISPDIGKLELLKLLALQNNNFYGTIPSELGNCTELQALFYLGVLFMSHGLIPSELGSLLELKDLDISSNSLSGYIPPSLGKLDKLSTFNVSTNFLVGPIPSDGVLTNFSGNSFVGNRGLCGKQINITCKDDSGGAGTKSQPPILDQNQVGKKKYSGRLLISASATVGALLLVALMCFWGCFLYKKCGKNDGRSLAMDVSGGASIVMFHGDLPYSSKDIIKKLETLNEEHIIGSGGFGTVYKLAMDDGNVFALKRIVKMNECFDRFFERELEILGSIKHRYLVNLRGYCNSPTSKLLIYDYLPGGSLDEALHERSEQLDWDARLNIIMGAAKGLAYLHHDCSPRIIHRDIKSSNILLDGNLEARVSDFGLAKLLEDEESHITTIVAGTFGYLAPEYMQSGRATEKTDIYSFGVLMLEVLAGKRPTDASFIEKGLNIVGWLNFLVTENRQREIVDPQCEGVQSESLDALLSVAIQCVSPGPEDRPTMHRVVQILESEVMTPCPSDFYDSNSD

SEQ ID NO: 84669 - protein, 198 aa, Escherichia coli
RHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 84670 - protein, 196 aa, Campylobacter lari RM2100
MSSYIPYVVEKTSRGERSYDIYSRLLKDRIIMLSGEINDDLAASIVAQLLFLEAEDPQKDIYLYINSPGGVVTSGFSIYDTMNYIKADVSTICIGQAASMGAFLLSCGAPGKRFALPNSRIMIHQPLGGARGQATDIEIQAKEILRLKAILNDILAKNTKQKLSKIEKDTDRDFFMSAIEAKEYGLIDKVLEKSFK

SEQ ID NO: 84671 - protein, 343 aa, Glycine max
  misc_feature (104)..(104): Xaa can be any naturally occurring amino acid
MSPFRPLLLFAAVFFLLRPLAATDGDADPLYIGCVEQCKKTGCVGDRCFQHCKFSSDGKPIDGPWYMHEPLYLRWKQWDCCTDCRYYCMLAREEERTKLGDKPXVKYHGKWPFRRVYGIQEPVAVALSAVNLAMQFHGWVSFFILVYYKLTLRPDKKTYYEYTGLWHIYGILSMNAWLWSAVFHSRAVELTEKLDFSSAVALLGFSLILAILRAFNVRDEATRVMISAPLIAFVTTHIMYLNFYELAYGLNRIVCTGMVVVQLLIWAIWAGASNHPARWKLWAVVVGGGLAMVLETYDFPPYMGYVDAHALWHATSIPLTFFWWGFIRDDAEFRTTAMLKKVK

SEQ ID NO: 84672 - protein, 154 aa, Oryza sativa
NLVYICECNGLPEVANYWKQVIKINDYQKSRFVNRVVSSMFNTVSGKKIAVLGFAFKKDTGDTRETPAIDVCHGLLGDKAQISIYDPQVTEDQIQRDEFKTLDYQKIYDNMQKPAFVFDGRNVVDPEKLREIGFIVYSIGKPLDAWLKDMPAVA

SEQ ID NO: 84673 - protein, 762 aa, Oryza sativa Indica Group
MGGARAQVNKPHKTRFASKASRHAHKIDKVRTGKPEGSHRAAVKGARAARVQRSKAIRDQKRAALLKEKRSSVGSSSAPRVVVLFGLSSSANVRSLAKDLLTIASGDEEKPTSSTVASPTYKLRTTVLEAPYGDLTSCMELAKVADLLAFVLSANSLYDCDSSSPIDDFGSQCLSVFRAMGLPSTAVFIRDLPSENKSRQESKKTAISFVSPELPEDCKFYAADTKDDLHKFMWLFKEQHLSCPHWRNQRPYVMSEEACIKPDDSSGLCTLLVSGYLRAHNLSVNQLVGVGDFQLGQIDILKDPFPINERKNSNAMDSEDSGIQIVDTFVPDPSSQEPLLVENTPDPLEGEQTWPTEAEMEEAYLNNKQRKLKRKLPRGTSEYQAAWIVDDTDDEDGDSENDNQDGAGMVIDEQDHSDNGGDGSDMDVVSHFTEKFDEETIGGTEMADDENLTKEQIEAEIKKIKEANAEDEEFPDEVETPLDVPAKRRFAKYRGLKSFRTSSWDPKESLPQDYARIFAFDNFTRTQKHVLAKMAERDEGTLKDCAQRGSFVRLHLKNVPTEIASKLVHPSRRLPVVVSGLLQHESKISVLHFSIKKHDSYEAPIKSKDSLIFNVGFRQFTARPLFSTDNINCNKHKMERFLHHGRFSVASVYAPICFPPLPLIVLKSRDGEQPAIAAVGSLKSVDPDRIILKKIVLTGYPQRVSKLKAVVRYMFHNPEDVKWFKASAMKCIFNSSVQQHDTVCMSLYKRAYPKWPEQLYQI

SEQ ID NO: 84674 - protein, 150 aa, Chlamydomonas reinhardtii
MLSTIGRSARSGQYLLRTLNAATTVTQTCSAGFATAGAPDRVVEVTSDQDFSAKLADVAGSGSLMICDFTAKWCGPCRMIAPVFSSLSNKYTDVTFVKIDIDNTALGNTVNDHSITGVPTFVYYKGGRRVESFSGARADMLESLIQKHAK

SEQ ID NO: 84675 - protein, 199 aa, Shigella flexneri
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVG

SEQ ID NO: 84676 - protein, 334 aa, Dehalococcoides sp. VS
MVTRIGINGFGRIGRITLRTINQYHRGELEVVAVNDLADNKSNAHLLKWDSTYGKYPGTVESDDCSIIVDGKPIKVFSERDPMQIPWETAGVDLVIESTGLFTDAAKASAHLRGSIKTVVISAPAKGEDITVVMGVNEDKYNCNTHRVISNASCTTNCVAPLIKVLHDKFGVKKGFMTTCHAYTNDQKIQDMFHKDIRRARAAAVNVIPTTTGAAKAVALVLPELKGKLDGISFRIPSASVSLVDFVGELGRNVTVEEVNAAFKEAAQGKLAGILEYCEEELVSSDFKGNPASSIIDAPSTMVLGGNMVKVLSWYDNEWGYSTRLGDLIAYISK

SEQ ID NO: 84677 - protein, 450 aa, Erythrobacter sp. NAP1
MLDTMALELARFRGAAIERGPVPSGRVVACDGGLIEVSGLSVPIGSLGAIESDSGDEPLAEVIGFRRGHSLMMLLGDAQLLQPRASVRAIGSPGSVRVGDALLGRAVDGLGQPIDGGPAIHASETWPLLGKRESALARSGVSESFDCGVRAVNALATMGVGQRMGIIAGSGVGKSVLIDTVAANAKADLAVIALIGERAREVSDFVTRHMSGAERGRMVVVAVPADHAPNLRLRAAQYASAIAEHFRAKGRKVLLVLDSLTRVAHAARELALVLGEPGAARGYPPSALSTITRLVERAGNCATSGGAVTGIYSVLADGDDTSDPVVDTARAILDGHLVLSRELAQRGHYPAIDIPASLSRVMHDIASAEQLEAARRLRALIAAREHNRDLVMMGAYRAGSDPDLDCALAHSNAIDAFLQQPRNACVNMTQSRAQLMDMLAKIDAPLVANA

SEQ ID NO: 84678 - protein, 311 aa, Zea mays
MSHSPLPPPVFQNISLRFSESFSLQGTETTGAFTPPAFPSPPGTTGLLAIIHPSMAKLVNKLVDSFDHDEAPAPDVGCVRAVLAELVLTFLFVFTGVSASMAAGAGGKPGEAMPMATLAAVAIAHALAAGVLVTAGFHVSGGHLNPAVTVGILVRGHITKLRALLYVAAQLLASSLACILLRYLSGGMVTPVHALGAGIRPMQGLVMEVILTFSLLFVTYAMILDPRSQVRTIGPLLTGLIVGANSLAGGNFTGASMNPARSFGPAMATGVWTNHWVYWIGPLLGGSLAGFVYESLFMVNKTHEPLLNGDI

SEQ ID NO: 84679 - protein, 477 aa, Acidobacteria bacterium Ellin345
MKANAVDALKQAARSVIAVICAFLLVPGDAVIWASPAPQDQQAQAPAQDDAAAKLPPDQLESLVAPIALYPDPLLSQMLVASTYPLEIIQLQQWLAKNKGLKDKALSDAAMKQPWDASVQAMAVLPDAVKQLSENIQWTTDLGNAFLAQQEDVMNAVQRMRSKAKDKGALNSNEQMKVETQTVENKQVIVIQPSSPDVVYVPSYNPTVVYGAPAYPYPPMYYPPAPAGAYLATAAISFGVGLAVGAAWGGGGWGWGAGWGHGDVNVNVNNNFNRNTNVQGGNRTNVGNGNRTNAGNGNRGGGANGGKWQHNPSHRGGAPYGDRGTANKFGGSSRGDSRGQGAGNRGGANAGNRGGAGAGDRGGNRGGNNAGNRGGASAGTSDRGGNRGGGGGPSAGTSDRGGNRGGSSAGGGSRGGSSPSRSGGSSSAFGGGGGSRSSGSSARASSSRGSSSMGGGGGSRGGGGSRGGGGGGGGRRR

SEQ ID NO: 84680 - protein, 428 aa, Dehalococcoides sp. VS
MSAVVKSIKAREILDSRGNPTVEADVVLSDGSFGRAVVPSGASTGSHEAVELRDGDKSRYNGLGVQKAVTNVNTTIAKAISGFKASDQQRLDNLLIELDGTPNKAKLGANAMLATSLAVAHAAAASCHMPLYRYLNNCDEYILPVPMFNILNGGKHASNSTDFQEFMVMPTGAKSFAEALRMGTEVYHSLKKVLKGMNQNTTVGDEGGFAPSLPTNKDAVEVILKAIEKAGYRPGEDIFIALDPASSELYHEGKYTLATENKTLSSAEMVDYWCGWVGKYPIISIEDGLFEDDWDGWKMLTKKIGSKVQLVGDDFYVTNIKRLERGIQEKASNSILIKLNQIGTLSETIAAIKMANNSAWTAVVSHRSGETEDTTIADLAVAMNAGQIKTGAPCRAERTAKYNRLLRIEEELGGKAKYPGKEAFFNLK

SEQ ID NO: 84681 - protein, 639 aa, Salinibacter ruber DSM 13855
MGVIPYIGSPSTRRLPGSPPRILTARHTTEIMAQVDVEMPKMGESITEGTVIAWHKQPGDEVEQDEILLEIGTDKVDTEVPSPKGGVLTETLVEEGDTVEVGTIIATLDTDTAAAEVDADDEPPAEAPSDDEAAADEAKEAAPDADAEDEAEATPPETDSEEAASPAPSGDEVEVVMPKMGESITEGTVVAWYKDIGEAVAIDETILEIGTDKVDTEVPSPAEGVLTEKLVEEGETVEVGTVVALLASEAEAGSVEPPASDEPDTTQETAPEADEAELPSTPPSGDGAVPDADEPQRAPEETITRRGDDGRFYSPLVRSIAKEEGLRMSELESLEGSGRGGRVTKEDVLAYLDEREEAPAAPASAPERPPRPGRSDEAPPARGDYTVDEGPSDEELRQQYGDRIEVQPMDRMRKMTAEHMVRSKATSAHVTSFAEADVTGLVQLREANKEAFREREGVKLTYTPFFVKAAVEALREHPLLNASVEGDKIVIKHDFHVGIAVAIGNKGLLAPVIRNAGDYNVSGLARKAANVAERARNKELQPDELQGGTFTVTNIGSLGSLMGTPIINQPQVGILATGAIQKRPVVVENDGLGDAISVRHMMYLSLSYDHRIIDGAMGSSFLQRVVTELESFSADADLF

SEQ ID NO: 84682 - protein, 468 aa, Pseudomonas fluorescens PfO-1
MNSLNSKDLNGQLAQGFKPRHVTMLSIAGIIGAGLFVGSGHAIAAAGPAVLLAYLFSGLLVVLVMRMLGEMAVAHPDTGSFSTYADQAIGRWAGFTIGWLYWWFWVLVIPIEALAAGHVLNQWFPQVDAWLFALLSIILLVVTNLFSVSKYGEFEFWFAMAKVVAIIGFIGLGFAVLMGWIPGREASGLSRLMEEHGGFAPNGLSAVVGAFITIMFSFIGTEAVTIAAAESSNPAQNIAKATRSVIWRIGVFYLLSIFVVISVVPWNDPLLASVGSYQRALELMNIPNAKFLVDVVVLIAVASCMNSSIYISSRMLFSLGRRGDAPQPLKVTSAAGVPRAAVIASTVIGAGVTLFSYFMPGGLFQFLLASSGAIALLVYLVIAISQLRMRRMLRRQNVELTFRMWLFPWLTWLVIAFICAALAVMMVTPEHRLEVTSTIGLALTISFIGLVTTRQHGQMRAVVSAGKA

SEQ ID NO: 84683 - protein, 414 aa, Psammosilene tunicoides
MGSLGAILKYPDEFYPLLKLKMAIKEAEKQIPQEHHWGFCYSMLHKVSRSFALVIQQLGTELRNAVCVFYLVLRALDTVEDDTSIATEVKVPILRAFHQHIYDRDWHFSCGTKHYKVLMDEFHHVSTAFLELDRGYQEAIEDITKRMGAGMAKFICKEVETVDDYDEYCHYVAGLVGLGLSKLFHNSGLEDMATDALSNSMGLFLQKTNIIRDYLEDINEIPKSRMFWPREIWSKYVDKLEELKYEQNSEKAVQCLNDMVTNALLHVEDSLTYMSALRDHAIFRFCAIPQIMAIGTLALCYNNIQVFRGVVKMRRGLTAIVIEQTNSMADVYGAFFDFACMLKPKVDKRDPNATKTLSRIEAIQKICRDSGTLNKRKLYVVKSKPGLTPAVIFVIFVILAIILPRIFPKRQNNY

SEQ ID NO: 84684 - protein, 134 aa, Pyrococcus furiosus DSM 3638
MKAPIKVYMTKKLIGVTPDTTVQEASKLMMEFEIGSLVVIDEKGNVIGFFTKSDILRRVVVPGLPYDTPVKDIMTKELITVNSNTPLGEVLRKMARHRIKHILIEEEGKIVGIFTLSDLLEASRRKLETAISTE

SEQ ID NO: 84685 - protein, 333 aa, Oryza sativa Indica Group
MGLLHDAPSRGGAGGGKLSLLASVGLAGAGGGGSGGVGGGGGGGGGGGYKELLVMALPKDDDLDAGKVADVLGFRLPDVEGAVRAFFRSREVREFASGALAGAMSKAVLAPLETIRTRMVVGVGSRHIGGSFVEIIEQNGWQGLWAVAVAGAAAGIAGTLVCHPLEVIKDRLTINREVYPSISVAFSKIYRTDGIRGLYAGLCPTLIGMLPYSTCYYFMYDTIKTSYCRLHKKTSLTRPELLVIGALSGLTASTISFPLEVARKRLMVGALQGKCPPHMIAALAEVIQEEGLPGLYRGWGASCLKVMPNSGITWMFYEACKDILLADKDKRKA

SEQ ID NO: 84686 - protein, 305 aa, Miscanthus sinensis subsp. condensatus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMSFLNERTLKGTFFGNFKPRTDLPNVVELYMKKELEVEKFITHSVPFAEINKAFDLMAKGEGIRCIIRMEN

SEQ ID NO: 84687 - protein, 481 aa, Pseudomonas putida GB-1
MTLEESPMQTQMLINGQLVAGQGPAWTVLDPAQGTALAQINEATEAQVDSAVRAADLAFDSWSQTSPKERSQALLALADAIEAHGDELARLESQNCGKPLSAALNDEIPAIADVFRYFAGAARCLGGLAAGEYLPGHTSMIRRDPLGVVASIAPWNYPLMMLAWKIAPALAAGNTVVIKPSEMTPLTALRLGELAQDLLPPGVLNILFGRGQTVGNPLVNHPKVRMVSLTGSIPTGAHIISATADSVKRMHMELGGKAPVLVFDDADIDAAIDGIRTFGFYNAGQDCTAACRLYVQDGIYERFVERLGEAVASLKPGLQEAEDTELGPLISAQHRDKVAGLVQRAIAQPHIRLVTGGKAIDGNGFFFEPTVLADALQDDEIVRNEVFGPVVSVTRFTDEAQALEWANDSNYGLASSVWTRDTGRAHRLAARLQYGCTWVNTHFMLVSEMPHGGQKHSGYGKDMSMYGLEDYTCVRHVMIKH

SEQ ID NO: 84688 - protein, 305 aa, Miscanthus sinensis subsp. condensatus
IESVGEGVTDVAPGDHVLPVFTGECKECAHCRSAESNMCDLLRINTDRGVTIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYVKKELEVEKFITHSVPFAEINKAFDLMAKGEGIRCIIRMEN

SEQ ID NO: 84689 - protein, 474 aa, Legionella pneumophila subsp. pneumophila str. Philadelphia 1
MLRRTKIVATLGPASKEPEILRSMLAAGVNVVRINFSHADSSALQLIALVRKIADELNHPVAVMADLQGPKIRVGRFQNKSITLIDGQNFTLDCMAPDTLGDINGVSVAYPNLANELSIGDHLLINDGLIELEVIEISGSKIHCKVVEGGVLTDLKGLNRKGGGLAARTLTEKDRNDLRTAIEAEVDYISLSFVKDAEDIRQARALMKDYGAQITPIIAKIERMEALDHLTDIIREADAIMVARGDLGVEVGAAEVPAIQKHIIEQTRLLDKVVITATQMMESMISNPQPTRAEVSDVANAILDGTDAVMLSAETASGLFPVKVITMVNKICLSAEKHASFFYHSDPETCHYQRADQAIAMATMHTANHFPIQAIITLTESGDTALWVSRHHSTVPIFAISANKRTIGRLSLVNNVFPIYIDFHQFNPEGLNQQILHELIKSGHLEKRGYVLLTRGTQIGMPGGTNCMEIIPVV

SEQ ID NO: 84690 - protein, 396 aa, Legionella pneumophila subsp. pneumophila str. Philadelphia 1
MNLIKMSDIDLSGKRVLIREDLNVPIKDGMITSDQRLQAALPTIKSALDSGAAVIVLSHLGRPEEGKYEKKFSLEPVADYLRENLEYPVRFVKDYLSGVGVNPGELVVCENVRFNPGEKANDEALAKKLASLCDVFVMDAFGTAHRAQASTYGVAQYAPVAVAGPLLIRELEALNQVLKAPKKPIVAIVGGAKVSSKLSLLKQLVGMVDVLIPGGGIANTFLKAQGFEIGISLYEPDLLDEARHILILAKEKGCQIPLPTDVVVGKTFSETCPAFNKSLSNVAADDMILDIGPETIRDYVDLIHDANTIIWNGPVGVFEFPQFAYGTRAIAIAIAESDAFSIAGGGDTLAAVDLYDLNQQISYISTGGGAFLECLEGKTLPAVAILQERAKHVKTN

SEQ ID NO: 84691 - protein, 305 aa, Miscanthus sinensis subsp. condensatus
IESVGEGVTDVAPGDHVLPVFTGECKECAHCRSAESNMCDLLRINTDRGVKIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMSFLNERTLKGTFFGNFKPRTDLPNVVELYMKKELEVEKFITHSVPFAEINKAFDLMAKGEGIRCIIRMEN

SEQ ID NO: 84692 - protein, 342 aa, Legionella pneumophila subsp. pneumophila str. Philadelphia 1
MSMEVTLTRRSSMTIRVAINGYGRIGRCILRSIFEYNRQNEFEVVAINDLSGIDVTAHLTRYDSTHGPFRSDVSIEGNMLIVDGHGIQVIAERDPAKLPWKQLDIDIVFECTGFFTSRDAAMGHINAGAKKVLISAPAKGVDTTVVYGVNHSVIKASDVIVSNASCTTNCLAPVVKVLNDAIGIESGLVNTVHAYTKDQMLLDGSHKDLRRARSATQSIIPTKTGAAAAVGLVLPELAGKLDGFAMRVPVLNVSVVDLTFQAKRATSVEEINDIMRKAKNRILQINEDPLVSCDFNHNPASAIFDTTETKVIGNLVKVVAWYDNEWGFSNRMIDTAHQMMNC

SEQ ID NO: 84693 - protein, 305 aa, Miscanthus sinensis subsp. condensatus
IESVGEGVTDVAPGDHVLPVFTGECKECAHCRSAESIMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNLLNERTLKGTFFGNFKPRTDLPNVVELYMKKELEVEKFITHSVPFAEINKAFDLMAKGEGIRCIIRMEN

SEQ ID NO: 84694 - protein, 351 aa, Vitis vinifera
MSDSSSSAKRLKLFCTDLRRRHRCWRCTQPLLPGLPDHIAHLCLSRLHPSILFAVSCAWREFIYSSAFPPHLSIYTVLSSSIDSGGDAVHFFSFDPIQSRWLQLPPPPPSDPPLRVLLTHPSFLSRRLPVQSLAVAGQLVVLAATAHGLVPALHRPLIFDPMSRTWRFGPRLLAPRRWCAAGTLGGAVYVAGGMGGSYSLEVAKTVERWEVRNDVVERMGGLRDVRMSREAIEAVGWRGKLWMVNVKGVATKEGAVYDVASDVWEEMPEGMLGGWRGPAAAMAMAGGAEEMYVVDEGKGILRKYDGERDAWEEVVEAEVLRGADHMAAGGGRDEPLYGLINFLSYPVLKNL

SEQ ID NO: 84695 - protein, 305 aa, Miscanthus sinensis subsp. condensatus
IESVGEGVTDVAPGDHVLPVFTGECKECAHCRSAESNMCDLLRTNTDRGVMIGDGKSRFSINGKPIYHFVGTSTFSEYTVMHVGCVAKINPEAPLDKVCVLSWGISTGLGASINVAKPPKGSTVAIFGLGAVGLAAAEGARIAGASRIIGVDLNPSGFEEARKFGCTEFLNPKDHKKPVQEVLAEMTNGGVDRSVECTGNINAMIQAFECVHDGWGVAVLVGVPHKDAEFKTHPMNLLNERTLKGTFFGNFKPRTDLPNVVELYMKKELEVEKFITHSVPFAEINKAFDLMAKGEGIRCIIRMEN

SEQ ID NO: 84696 - protein, 372 aa, Nicotiana plumbaginifolia
MRCVVLENMGLLCSRNKGYNQADDEENTQTADIERRIEQETKADKHIQKLLLLGAGDSGKSTIFKQIKLLFQTGFDEAELKNYIPVIHANVYQTIKVLHDGSKELAQSELEASKYLLSAENKDIGEKLSEIGGRLDYPHLTKDLVQDIEALWRDPAIQETILRGNELQVPDCAHYFMENLQRFSDVNYVPSKEDVLFARIRTTGVVEIQFSPVGENKKSGEVYRLFDVGGQRNERRKWIHLFEDERKNRMMETKELFEWVLKQPCFEKTSFMLFLNKFDIFEQKALKVPLNVCEWFKDYQPVSTGKQEIEHAYEFVKKKFEESYFQCTAPDRVDRVFKIYRTTALDQKLVKKTFKLVDETLRRRNLFEAGLL

SEQ ID NO: 84697 - protein, 547 aa, Glycine max
MASHLLNHSSKMRNASKLLHHERALLVRWFSGDAHSSLNRNRDVWKTQFHESSARSSVFEPASCFNKHSFGMQKRNIFMATIKRGSIIGSEFNGEISRSSQVLSRRCYASASDLPPHQEIGMPSLSPTMTEGNIARWLKKEGDKISPGEVLCEVETDKATVEMECMEEGYLAKIIRGDGAKEIKVGEVIAVTVEDEGDIAKFKDYQPSASEPSAVPAKEISAPPTPKKEEEVEEPGREPEPKVSKPSAPPSSGDRTFASPLARKLGEEKNVPLSSIKGTGPEGLIVKADIDDYLASGAKEVSASSKAKVATDAALDYTDIPVSQIRKVTASRLLLSKQTIPHYYLTVDTCVDKLTSLRTQLNSLQEASGGSRISVNDLVIKAAALALRKVPQCNSSWANDYIRQYNNVNINVAVQTDNGLFVPVIRDADKKGLSTIGEEVKQLAKKAKENSLKPQDYEGGTFTVSNLGGPFGVRQFCAIINPPQAGILAVGSSERRVVPGSGAEEFKFASFMSVTLSCDHRVIDGAIGAEWLKAFKGYIENPETMLL

SEQ ID NO: 84698 - protein, 497 aa, Banksia ilicifolia
MRINPTTSGPGVSALEEKNLGRVAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLK

SEQ ID NO: 84699 - protein, 306 aa, Streptococcus pneumoniae R6
MSIYNNITELIGQTPIVKLNNIVPEGAADVYIKLEAFNPGSSVKDRIALSMIEKAEQDGILKLGSTIVEATSGNTGIGLSWVGAAKGYKVVIVMPETMSVERRKIIQAYGAELVLTPGSEGMKGAIAKAQEIAAERDGFLPLQFDNPANPEVHERTTGAEILAAFGKDGLDAFVAGVGTGGTISGVSHALKSENSNIQVFAVEADESAILSGEKPGPHKIQGISAGFIPDTLDTKAYDGIVRVTSDDALALGREIGGKEGFLVGISSAAAIYGAIEVAKKLGTGKKVLALAPDNGERYLSTALYEL

SEQ ID NO: 84700 - protein, 200 aa, Shigella flexneri
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGF

SEQ ID NO: 84701 - protein, 200 aa, Shigella flexneri
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIV

SEQ ID NO: 84702 - protein, 197 aa, Shigella flexneri
ELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAM

SEQ ID NO: 84703 - protein, 482 aa, Oryza sativa Japonica Group
MEKSELLLGSYSYAALCGVTLIIGWLAHWVYKWMNPPCIGRLPPGSMGFPIIGETFQFFRASPSIDMPSYYKQRLERYGPLFKTSLVGRPVIISLDPEVNRFIFQQEGKLFQSWYPETAINIFGKKSLTTYNGTIHKFIRGVAAKLFGLENLKESLLPELENSMRESFASWTGKPSVEVQDGVSDMIFDLVAKKLIGLDVTNSRELRKNFQDFFQGMVSFPIYFPGTSFYRSMQGRRNVRNTLTDIMKERLSAPGKKYGDLVDLIVEELQSEKPMIDENFAIDALAALLFTSFATLSSTLTVAFKYLTDNPKVVEELKEEHGTILKKREGVNSGFTWEEYRSLKFSTQVMNEITRISNVTPGVFRKTLTDVQVKGYTIPSGWLVMISPMAVHLNPKLFEDPLKFDPWRWREEKRSSMLKNYMPFGGGVRLCLGAEFSKLFIALFLHILVTEYSWTEIEGGEVLRISEIMFPQGYHIQLVPQT

SEQ ID NO: 84704 - protein, 143 aa, Glycine max
CEKRSDFCKKVGVKVLGVVENMSGLCQPITDFKFMKLTDNGEQKDVTQWVWEYMREKAPEMLNLLACTEVFDSSGGGAVKMSNDMGVPFLGNVPLDPQLCKAAEEGSSCFAKKDCVVSAPALNKIIEQLIETNGWSMLVSNGV

SEQ ID NO: 84705 - protein, 362 aa, Dehalococcoides sp. VS
MQNLRIPGPTPCPEEVLTAMGQQMINHRGPEMAAIMKEVAEKLKYFFQTKNDVLVLTGSGTGGLEAAAVNFLSPGETVLSVSIGVFGERFAKIASIFGAKIIALNFEHGKAADPALVKKALAEHPEIKAVLVTHNETSTGITNDLKSLASVVKGAGKLLMVDAISSLSSIDLPVDEWGCDVVVSGSQKGWMVPPGLAFISVSPDAWKAHAESKMPRFYWDLAKHKASIEKGQTPWTPCVSVIVALHKALIMMEKEGMQNIFKRHQKIADFTRKGVKELGLTLLAEEKYASNTVTAVLATEGLDPKKLLKVMREEYNTVLAGGQGPLEGKIFRIGHLGWVTENDIKVTLDNLKLALPKAGFRS

SEQ ID NO: 84706 - protein, 192 aa, Shigella flexneri
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMI

SEQ ID NO: 84707 - protein, 485 aa, Acidobacteria bacterium Ellin345
MQVRDHKTKIVGTIGPASESPEMLERLIRTGLDVARLNFSHGDFSGHRERIANLRAASDRAGRAVAVLADLPGPKMRLGTIQNEPIHLRAGDPFTLTTDSIVGDNRRCSMSFAALPQVVKPGDRLYLNDGLVHLLVERIEGTDVHCVVAVGGELRSRKGLNLPGINLGISAFTEHDRDCLKFALENGVDAVSQSFVQNAHDIELVRTAAESLGHHPFIFAKIERAEAVQNYDEILRASDGIMVARGDLGIEVPMEEIAVIQKQLISGANAAGKPVITATQMLESMITNRLPTRAECTDVANAIFDGTDCVMLSGECAVGQFPEEAVAMLGKIAAATEPHRHRAHPSNVHGAGWTPSTAAQAMGILVERALETAPSAAVFVPTLSGDTARMISRFKPSVWIVALSANENVCRNLKFSYGVEPVFVGEEADDWRPIIYDWLHQQHIRGKIALLVAAASTKHPDASHRIEFLRIPESVASATSSRTTS

SEQ ID NO: 84708 - protein, 69 aa, Zea mays
MESTFIMIKPDGVQRGLIGVIISRFEKKGCYLKALKLDHAQRSVAEKHYADLACKPFFQGLADYMISVP

SEQ ID NO: 84709 - protein, 156 aa, Desulfovibrio vulgaris subsp. vulgaris str. Hildenborough
MLHIKTIEGQLDAKGLKFAIVATRFNDFIVDRLIGGACDYLQRHGCDRENLTIVRIPGAFEMPLVAKKLAHSGKYDGIIALGAVIRGATPHFDFVSNEASKGLAQACLESGVPLGFGLLTTDNIEQAIERAGSKAGNKGAEAAAAVLETVRVMEQL

SEQ ID NO: 84710 - protein, 640 aa, Caulobacter crescentus CB15
MSSKTPLLDTIASPADTRGLSLAELKQLAAEVRAETIDAVSVTGGHLGAGLGVVELTVALHHVFETPKDIVIWDVGHQAYPHKILTGRRDRIRTLRQGGGLSGFTKRAESEYDPFGAAHAATSISAALGFCAARDAKGEDNSVIAVIGDGSLGAGMAYEAMNAATDTTKRLIVILNDNDMSIAPPVGGMSAYLANLVSGGAYRSVRKLGKTVVEKLPTPMREAARKAEEYARGMVTGGTFFEELGFYYIGPIDGHDMDALVSVLKNAKAFGDKPVLVHCVTQKGKGYAPAEGAADKLHAVVKFDVVTGQQQKAAGGPPSYTKVFAQELIKQAEKDDKIVAITAAMPSGTGLDLFGKAFPERTFDVGIAEQHAVTFAAGMAADGMKPFAAIYSTFLQRGYDQVVHDVAIQGLPVRFAMDRAGLVGADGPTHAGSFDIGFMGALPGMVLMAAADEVELARMVATAAEIDDRPSAFRYPRGEGLGLDMPAIAEPLEIGKGRIVREGTSVAIVSFGTRLSESLKAADLLAARGLSATVCDARFAKPLDLDLLLRLAREHEAIITVEEGSMGGFGAFVLQALAQHGALDRGLKIRTLCLPDVFQDQDKPDAMYAQAGLDAEGILRGALSAMGMDNVSAAGAGRRA

SEQ ID NO: 84711 - protein, 510 aa, Campylobacter lari RM2100
MLQALAIKYRPKTFDELVGQSTVSISLKYALENNRLAHAYLFSGLRGSGKTSSARIFSRALVCENGPNANPCGKCSQCVSSLNGSNIDIIEMDAASHRSLEDIQELIEQVKYAPSMARFKIFIIDEVHMLTPQAANALLKTLEEPPSYVKFILATTDPLKLPATVLSRTQHFRFKQISQQEILKHLEWILEQEKISYEKEALKLIARSGNGSLRDTLTLLDQAIVYCQNHIQTQKITAMLGFLDPAKIEEFYQAILANEKDKVFEFLKEFEDYEASNVIDEMIFFLKEAFFAKNNLFSMLIYERFFRILSRAKTMLNSSDDDSFVLCVMAFMLIEATYLKSIDEAIKGSKQDSTPSPKQQEIPSIQQTLKEEKLSPYENLLKAIYKRDYDLAEVFKKTTQFVSFEDDILSISSHAKDDDRMVLNNGFKLIKTLLHELFGEKTQIKIQKIETIDTQKLQDIFKTPIKQEVKNTPNLNEYFENFKKDAKKYDPKDETKEALNKLFGSPTIQS

SEQ ID NO: 84712 - protein, 294 aa, Caulobacter crescentus CB15
MSDLAKRIVQAADIVTVALDELLPRADGPESRLTEAMRYAALGPGKRLRPFFALETGKMFDLPERPVLRAACALECIHAYSLVHDDLPAMDDDDVRRGRPTVHKQYDEATAILAGDALQTAAFEIMAHPDTHDDGHVRSELVRKLAIASGARGMCGGQMIDLLGVRDDLGAVARMQRLKTGALIAFAFEIPLIIARAKESERSALMAFAQDLGLAYQIVDDILDAEGDEETLGKAAGGKDAAKGKANYVTLLGLDAAKERVTLLAEQTRSHLEIFGERAEHLRASVDFVLDRRN

SEQ ID NO: 84713 - protein, 630 aa, Listeria monocytogenes str. 4b F2365
MKQLKVENLTKTYGEKSLFENISLTITEGERIGLIGVNGTGKSTLLQIISGSESGDKGTVTKAKDYTIGYLAQDPEFNEEDTVLSAVFDGDTAALRAMRKYEEVLLAMSLDAENTKLHDAYTAASQEMDASAAWDMNTEAKTILERLGITDLTAKISELSGGQRKRVGLAQVLIETPDLLILDEPTNHLDFQSIRWLEEYLNRFKGAVLLVTHDRYFLDRVTNHMVELDRGSAYRYVGNYEKFMESKAIRMENEVRESEKNKNLYRKELAWMRRGPQGRATKQNARQDRFHDLEKKVKTKTDDSELAIDFVTSRLGKDVFELKNLEKHFDEKQVLQDFSLIIQPGERLGITGNNGTGKSTLLNMLAGKLAPDAGEVVTGQTVQIGYYTQQNEEMDPDMRMIAYLQEAGEQVTTSGGEVISVSAMLERFLFPPNSHGKKIGSLSGGEKRRLFLLRILMERPNVLLLDEPTNDLDTQTLTVLEDYLESFNGTVITVSHDRYFLDKVVNKLLVFRAIGEVEIFYGEYSDYLKELEAKAKPAKSMKKMANTSVEKAAPEKKEKVKLTYQEQLEWDGIEDAISELEQTIESLNETLEQTGADFTKAAEISELITAKETELEQMMERWEFLSQYAE

SEQ ID NO: 84714 - protein, 294 aa, uncultured archaeon
MGKMAEKRIRKAVIPAAGLGTRFLPATKSMPKEMLPIIDTPIIQFVVEEAIAAGIDDIIIITGRGKKAIEDYFDTSPELEIHLFKNKKYALLREIKDISTLVDIHYIRQKEPKGLGDAVLKAEKHVGNEPFAILLGDDIIKAEIPCIKQLTNLFGHYNKSIIAVEEVPKEKVSIYGIIKGREIDEFIYRIEEIIEKPSIEEAPSNIGTVGRYVLTPAIFDCIKETKPGSGNEIQLTDAIKLLMEKEEVFAYSFKGKRYDAGDKTGYVKAIIDFALEKEDLKAEIVQYLQERGYK

SEQ ID NO: 84715 - protein, 852 aa, Pyrococcus furiosus DSM 3638
MSEEIREVKVLEKPWVEKYRPQRLDDIVGQEHIVKRLKHYVKTGSMPHLLFAGPPGVGKCLTGDTKVIANGQLFELGELVEKLSGGRFGPTPVKGLKVLGIDEDGKLREFEVQYVYKDRTDRLIKIKTQLGRELKVTPYHPLLVNRENGEIKWIKAEELKPGDKLAIPSFLPLITGENPLAEWLGYFMGSGYAYPSNSVITFTNEDPLIRQRFMELTEKLFPDAKIRERIHADGTPEVYVVSRKAWSLVNSISLTLIPREGWKGIRSFLRAYSDCNGRIESDAIVLSTDNNDMAQQIAYALASFGIIAKMDGEDVIISGSDNIERFLNEIGFSTQSKLKEAQKLIRKTNVRSDGLKINYELISYVKDRLRLNVNDKRNLSYRNAKELSWELMKEIYYRLEELERLKKVLSEPILIDWNEVAKKSDEVIEKAKIRAEKLLEYIKGERKPSFKEYIEIAKVLGINVERTIEAMKIFAKRYSSYAEIGRKLGTWNFNVKTILESDTVDNVEILEKIRKIELELIEEILSDGKLKEGIAYLIFLFQNELYWDEITEVKELRGDFIIYDLHVPGYHNFIAGNMPTVVHNTTAALALARELFGENWRHNFLELNASDERGINVIREKVKEFARTKPIGGASFKIIFLDEADALTQDAQQALRRTMEMFSSNVRFILSCNYSSKIIEPIQSRCAIFRFRPLRDEDIAKRLRYIAENEGLELTEEGLQAILYIAEGDMRRAINILQAAAALDKKITDENVFMVASRARPEDIREMMLLALKGNFLKAREKLREILLKQGLSGEDVLVQMHKEVFNLPIEEPKKVLLADKIGEYNFRLVEGANEIIQLEALLAQFTLIGKK

SEQ ID NO: 84716 - protein, 350 aa, Glycine max
MSKYGTSLLVPSVHELVKQPITKVPDQYLHPNQDPPDISNTTLPQVPVIDLSKLLSEDVTELEKLDDACKEWGFFQLINHGVNPSMVENVKRDVQEFLNLPMEKKKQFWQIPDELEGFGQLFVVSEDQKLEWADMFFIHTLPINARNLRLFPNFPQPLRDNIENYSSQLKKLCLTIIERMAMALKIESNELLDYVFEDVFQTMRWTYYPPCPQPENVIGINPHSDACALTILLQANETEGLQIKKDGNWIPVKPLPNAFVINVGDILEILTNGIYRSIEHRATINKEKERISVATFHRPLMNKVIGPTPSLVTSERAAVFKRIAVEDYYKAYFSRGLKGKSCLDLIRVQK

SEQ ID NO: 84717 - protein, 486 aa, Salinibacter ruber DSM 13855
MCLSTGSMRFYAVGLNHECTSLEQTETFALSAEEQEALYANLSLSADAEVVVLSTCNRTEAYLYGTEADLRQVKALIGQGGGTRWPEETAFQERDEAAVRHLLQVTSGLRSVVLGERQIFAQVKAAYERAVDAGGIHSVMHRLFHTAFRAAKRVSSETGLGRGAASVSTAAVEMARQDLSEAGGEGLRNTEIVLVGAGKMGRLALEALADESLASLTVVNRSPDRAREVASPFGGDTEPWADRHRAVATADLALVATGASDPVLHAPALPAPDEATLVVDVAMPRNVDPAVDERPGYRLYDLDDLEAWTAEVRERRADAVPEAESICEELLEDFVTWVFHQQALQPAIQAIRSTFDTIREQEVDRHAHRTGMDREEVDRLTESIMQKLLAVPIVRLKNVDPESIDFVQGIELLHALFAPSDESDAGRSLAEAPDADTPDLGEAPSRCPYMTHDPGGDGTETEEVQKALRLSAAHQAASHSEEVRGG

SEQ ID NO: 84718 - protein, 272 aa, Zea mays
MGGEAEPDNAVLFVGVSLVLGIASRHLLRGTRVPYTVALLVLGVALGSLEYGTQHGLGKLGAGIRIWANINPDLLLAVFLPALLFESSFSMEVHQIKRCMAQMVLLAGPGVLISTVLLGAAVKLTFPYNWSWKTSLLLGGLLSATDPVAVVALLKELGASKKLSTIIEGESLMNDGTAIVAYQLFYRMVLGRTFDAGSIIKFLSEVSLGAVALGLAFWIMSILWLGFIFNDTIIEIALTLAVSYIAFFTAQDSLEVSGVLTVMTLGMFYAAF

SEQ ID NO: 84719 - protein, 536 aa, Aspergillus niger
MPSFSQATELSAWKELQEHHNSVGRNIVLKDCFQKDPQRFEKFSRTFKNTVDNSEVLFDFSKNFLTEETLALLVKLAKEANVEELRDAMFKGEHINFTEDRAVYHAALRNVSNEPMQVNGKSVVEDVNAVLEHMKEFTEQVRSGEWKGYTGKKIDTVINIGIGGSDLGPVMVTEALKPYGAPDMKLHFVSNIDGTHIAEALKNSNPETTLFLIASWFLETAKEDSHIAKHFVALSTNEEEVTKFGIDKKNMFGFESWVGGRYSVWSAIGLSVALYIGYDNFHQFLAGAHAMDKHFREAPLEQNIPVLGGLLSVWYSDFFGAQTHLVAPFDQYLHRFPAYLQQLSMESNGKAITRTGEYVKYTTGPILFGEPATNAQHSFFQLLHQGTKLIPSDFIMAAESHNPVEGGKHQRMLASNFLAQSEALMVGKTPEQVKAEGAPENLVSHKTFLGNRPTTSILAQKITPSTLGALITYYEHLTFTEGAIWNINSFDQWGVELGKVLAKKIQKELETADAGSDHDASTSGLLLAFKKKANLA

SEQ ID NO: 84720 - protein, 535 aa, Coxiella burnetii RSA 493
MPKIISKIKTANEEFEANKAAMTSQINALENLLAKIKNGGPEKSRQRQREQGKLLARERIDHLLDPGSPFLELSSLAGYQLYKDEVPAGGVVTGIGQIAGQECLIVANDATVKGGTYYPISVKKHLRAQDIAEENHLPCVYLVDSGGAYLPKQDEVFPDRDHFGRIFYNQARLSAKNIPQIAIVMGSCTAGGAYVPAMADEAVMVKNQATIFLGGPPLVKAAVGETVTAEELGGADVHCRHSGVADYFAENDEHALKIARQIVSHLNRKKHLSLSIQPAEEPAYDPEEILGIINADPRKSYDVREIIARLVDGSRFEEFKALYGTTLVCGFAHIHGYPVGIIANNGILFSESALKGAHFIELCSQRRIPLVFLQNITGFMVGKKYENTGIAKHGAKMVHAVACSEVPKFTVIIGNSYGAGNYAMCGRGYGPRFLFMWPNARIAVMGGEQAANVLAQVKRDQMERQGEKWDDNEEKQFKDNIRTNYEAQANPYYSSARLWDDGVINPLDTRRVLGLCISASLNAPISETRFGVLRM

SEQ ID NO: 84721 - protein, 543 aa, Pseudomonas fluorescens PfO-1
MSGQGKFKKQLSLIDLTFIGLGAIFGSGWLFAASHVSAIAGPAGIFSWLLGGFAVLLLGIVYCELGAALPRAGGVVRYPVYSHGPLLGYLMGFITLIAFSSLVAIEVVASRQYAAAWFPSLTKAGSGDPTLLGWLVQFGLLCVFFLLNYRSVKTFAKANNLVSVFKFIVPLLVIGVLFTFFKPENFQIQGFAPFGLSGIEMAVSAGGVIFAYLGLTPIISVASEVKNPQRTIPIALILSVLLSTAIYVLLQTAFLGGIPTELLANGWAGVSKEFALPYRDIALALGVGWLAYLVVADAVISPSGCGNIYMNATPRVIYGWAQTGTFFKVFTHIDAKSGIPRPALWLTFALSVFWTLPFPSWEALINVVSAALVLSYAVAPVTVAALRRNAPDMPRPFRVKCMGVLGPVSFIIAALIVYWSGWNTVSWLLGLQILMFVVYLLCGRFVPTAQLSLSRQVRSSAWLIAFYAVTIVLSKLGTFGGLGILTHPFDTLVVAACAMGIYYWGAATGVPAHLLRLESEEDESEVASPSPASTANPRAAGAY

SEQ ID NO: 84722 - protein, 305 aa, Miscanthus sinensis subsp. condensatus
IESVGEGVTDVAPGDHVLPVFTGECKECAHCRSAESNMCDLLRINTDRGVMIGDGKSRFSINGKPIYHFVGTSTFSEYTVMHVGCVAKIDPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 84723 - protein, 491 aa, Aspergillus niger
MADQAVADFGLIGLAVMGQNLILNAADHGFTVCAYNRTTSKVDRFLENEAKGKPIVGAHSVEEFCAKLKRPRRIMLLVMAGKPVDQFIESLLPHLEKGDIIIDGGNSHFPDSNRRTKYLAEKGIRFVGSGVSGGEEGARYGPSLMPGGNEEAWPYIKDVFQSISAKSDGEACCDWVGDEGAGHFVKMVHNGIEYGDMQLICEAYDILKRGLGLPAKEIADVFAKWNKGVLDSFLIEITRDVLYFNDNDGTPLVEKILDKAGQKGTGKWTAINALDLGMPVTLIGEAVFSRCLSALKDERIRASSLLDGPTPEFTGDKQAFIDDLEQALYASKIISYAQGFMLIQEAAREYGWKLNKPSIALMWRGGCIIRSVFLKDITNAYRKNPDLENLLFDEFFNTAIKKAQSGWRNVVSKGALWGIPTPAFSTALSFYDGYRTRDLPANLLQAQRDYFGAHTFRIKPEHANETYPEGKDIHVNWTGRGGNVSASTYIA

SEQ ID NO: 84724 - protein, 305 aa, Miscanthus sinensis subsp. condensatus
IESVGEGVTDVAPGDHVLPVFTGECKECAHCRSAESNMCDLLRINTDRGVMIGDGKSRFSINGKPIYHFVGTSTFSEYTVMHVGCVAKIDPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPRKDAEFKTHPMNFLNERTLKGTFFGNFKPRTDLPNVVELYMKKELEVEKFITHSVPFAEINKAFDLMAKGEGIRCIIRMEN

SEQ ID NO: 84725 - protein, 157 aa, Salinibacter ruber DSM 13855
MRIGFGYDVHRLVEGRPLILGGVQVPHDRGLAGHSDADVLLHAVADALLGAAALGDLGAHFPDTDAKWKDADSQALLRRVVERVQHAGYAPHNVDATVLLERPKLRPHVDEMRTNIARALSFPRDAVSVKATTTEGIGFVGREEGVAAQAACTIQSA

SEQ ID NO: 84726 - protein, 82 aa, Zea mays
  misc_feature (23)..(23): Xaa can be any naturally occurring amino acid
TVQIQFGAAVEATVSFLDKAVKXKLVMVAGPKIRVAKAVDAFVELAEASGYTVAAMLSPNELANTNNLVVALFLLPFPVNLM

SEQ ID NO: 84727 - protein, 559 aa, Dechloromonas aromatica RCB
MIILKNVTLRRSSKVLLDKASVTINPGEKVGLVGRNGAGKSTLFALLNGTLHEDGGDYSIPKQWQMGQVAQDMPETEQSATDFVIDGDTKLLAARNEVHDAEASDDGMRMAEAYMALNDAGEHDAEARAQSLILGLGFKVSELHNPVNSFSGGWRMRLQLARALMCPSDILLLDEPTNHLDLDALVWLEAWLKRYQGTLVMISHDREFLDAITQVTLHIDNAKLVRYGGNYSKFEDMRAEQMLLQQATMAKQAEKIAHLQSFINRFKAKASKAKQAQSRVKALDRMEKIAPVLADAEFTFEFQEPQNLPNPMLSMMDVTIGYPPAEEAPAGTPPTVIVRGINRSVMAGQRIGILGANGQGKSTLVKTIARDLQAISGDVTEGKGLNIGYFAQQELDVLRPQDTPLEHMVRLAKEAIAAGRSNVPGREQELRNFLGTFNFGGEMVKQAVGTMSGGEKARLVLCMLVWQRPNLLLLDEPTNHLDLNTREALAVALNEFEGTVMLVSHDRALLRSVCDEFWLVSKGGVAPFDGDLEDYQRYLLDEAKRVREEASAAQKKLAA

SEQ ID NO: 84728 - protein, 670 aa, Arabidopsis thaliana
MPLGERGGWERTESRYCGVETDFSNDVTHLLNFNISTGGFDYVLAPLVDPSYRPSLVEGNGVDTQVLPVCGSDLVLSPSQWSSHVVGKISSWIDLDSEDEVLRMDSETTLKQEIAWATHLSLQMCEPDLTRPHYLAGGLRVSCCRSSFISDETFLYKITFNQALTFCGSSLFCLNVISALKLWLRVPLVKSEGDSMDDTSEGLNDSWELWNSFRLLCEHDSKLSVALDVLSTLPSETSLGRWMGESVRAAILSTDAFLTNARGYPCLSKRHQKLIAGFFDHAAQVVICGKPVHNLQKPLDSSSEGTEKNPLRIYLDYVAYLFQKMESLSEQERIELGYRDFLQAPLQPLMDNLEAQTYETFERDSVKYIQYQRAVEKALVDRVPDEKASELTTVLMVVGAGRGPLVRASLQAAEETDRKLKVYAVEKNPNAVVTLHNLVKMEGWEDVVTIISCDMRFWNAPEQADILVSELLGSFGDNELSPECLDGAQRFLKPDGISIPSSYTSFIQPITASKLYNDVKAHKDLAHFETAYVVKLHSVAKLAPSQSVFTFTHPNFSTKVNNQRYKKLQFSLPSDAGSALVHGFAGYFDSVLYKDVHLGIEPTTATPNMFSWFPIFFPLRKPVEVHPDTPLEVHFWRCCGSSKVWYEWSVSSPTPSPMHNTNGRSYWVGL

SEQ ID NO: 84729 - protein, 601 aa, Pseudomonas putida GB-1
MSEQQILLSVGGIGAAALACQWLAWRLKLPAILFLLLAGIIAGPALGWLDPEALFGPLLMPLVSLAVALILFEGSLTLHLSQWREIGSVVHRLVTVGALLTWLVIALATHWLLGFDWPLSILFGTLTLVTGPTVIVPMLRVVRPKSTIANILRWEGIMIDPIGALLAVVVYSFIIASADGNALSQSLTTFAGVIFCGTALGAAGGWLLGQIMREQWLPEYLHNLASLAAVLGIFIAANQIMHESGLLAVTVMGMWLANMRGVDVRQILHFKENLSVLLISGLFILLAARLDLHALLGLGPAVLALLLVIQLVARPLNVWLSTLGSTLSWRERALLAWIAPRGIVAAAVSAIFAIRLHQAGHQDALLLVPLTFAVIIGTVVLQSATARPLARLLKVAEPAPSGFLIVGANEPARAIAKALQQLGCRVLLTDSSWENIRAARMDGLPTYFGNPASQHADAHLDLVGLGHLLGLSPAGEINALACARFRHDFGHGRLFVLASGLEKQRSDKHRAAEEHRGHLLGANPMTYLQLANRLHQGAELYSTNLTEGFGWDAYQALHGERAHLLFARDGHGWVHVASPDNPLQPQPGWTLVALIEPAPEP

SEQ ID NO: 84730 - protein, 71 aa, Triticum aestivum
LSAAAMAVDLTPRQPAKAYGGEGGAYYEWSPAELPMLGVASIGAAKLALAAGGMSLPSYFESAKVAYVLQG

SEQ ID NO: 84731 - protein, 1446 aa, Coprinopsis cinerea okayama7#130
MTLAHDYFNTRNLQQFQRLLDGGLNDRKQQAGNGASAQPSTSGAKSWNKPSPLATMTPPVDVNARDWLGRTVLHLACSAVENVEYVRALLKHPNINVNVPDTESHWTPLHRALYHANLPAAQMLLQRSDIDISLKDWEGYTAFDLYNSTINGTNPDSRQLNAELFTWGANRNAALGLGDGNDRSHPDQVIIPGKGNPEDLKDNKLTERFIPISIRQIQMSKLHTAIVTSEESGNLRVCGFGSGGRLGPGQHTQFSLKPLPQFSYTITQVALGQDHTLALTKNGEVLSWGLNHFSQLGYPLELTGGKLEEPIQPTPRKIPGPLKKETVIGIAASKKASACWTLDEVFTWGTNAGQLGYDKNAQPVQVIPRKVTKFSQPVIALALSDNAMAGLLQTQQVECIWNDRHYRINFPIHAFPSEIQPFRPRQAIKDFHIAKVTCCGDLFAALSSNGEVFTFSPPTDGGDGVDGYHHKGSPFKPQRVWALRKKFSSVRDVAMGAEGSIIICTESGHTYVRIRTGKGGGKNFKFQRIPHLQRVTHVCANSTGAFGALRVDFRPKKIDIQGPSIAEDLSRVQPYRLPFPAEAVPSGHRFHPTVVDALDEAGRSKTSINVPALSLDDDNYIDEDGDDADIEKDIRTLQGFMNIIQREERKVKAAKGSLKYGGVALPHGADTLISIGTIHVPAHSVILAARSTVLDDILSKRTTATSSSISIVVTRRLPGPGNGVSNLTSLAFSGIHPLSLLIILHYLYSDEVLAIWDRRVYSSLTDHALSTLKVDVAEIKSDLRTLAATLELPHLSQVLQAPVKRPPAPSLSTDLSALFEKAQGSKQRRSLPCSPDVVLELRDKEVWTYSVILRARSEFFSCLLDEDTWTRKRWGQDGVLRVDLKHMRWHVMEFVLKFLLCGKDKELFDVLPFTESVDDVLEFMFDVMAAASELLLDRLILICSSVILTFLDIHNCCYILSEASYYHAYQLINSVQEYMAANMESLLEMGMLDDLPYSLVKQLSKFIKERQLEKSSFSRTDVYLDGLLAKHWDWLEGQDIPVPYVRSGKQHPSRELAKTRLSPPVPPKEVPSTPSKQLKIPTSAVQRRPSGDDLFAMDLGEPATQPSQSSTPWKVPDAPRVDMRALMAEAQESNRSIAPPISASPSRGQTPRTTSGPSTINGPGWKTPGPSTTPLTPSRSSASQGPSWRQHASPQLPPPASATPPSATPGAGPLAPKAAPPSPSPLRSKASKPTTPLAPLPGMGPTFTPTKQAVSKSSGIRNVSGGKAWTAPPPEPVVVTTNSKAVSFAAIQEAQQTQHAPVKDRRSLKEIQEEEEALQAEADFLKWWEAEENRVKEEMAALEKINQGGLTKGERGSGGGRGGRGKGRGKSEHHRPRSGNKPPATGGSGGAPADAGEGGPSRGEGETQGKGKPTKSSNPDDGQPRRHRRPPKKQAQGQQAGQVPSS

SEQ ID NO: 84732 - protein, 305 aa, Miscanthus sinensis subsp. condensatus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 84733 - protein, 470 aa, Mycobacterium sp. JLS
MTHPDTVREQPELRRVMGPGLLLLFVVGDILGTGVYALTGDVAAEVGGAAWLPFLVAFLIATITAFSYLELVTKYPQAAGAALYAHKAFGLQFVTFLVAFVVMCSGITSASTASRFFGANLIEGFGLEWGTAGVAAVALGFMALLAAVNFRGVGESIKLNVVLTIIEATGLMLVLFVGLWAFTRGGDVDFSRVVAFDTAGDKNAFMAVTAATSLAFFAMVGFEDSVNMAEETKDPVKTFPKVLLSGLTIAGIVYMLVAVVAVALVPVGRLEESDTPLVEVVKAGAPNLPIDTLFPFISMFAVSNTALINMLMASRLIYGMARQHVLPPVFGTVHPRRLTPWVAILFTTLIAFGLIFYVSVFASSSAISVLGGTTSLLLLAVFAVVNVAVLRLRRDVQAGGAHFKTPTVMPVVGFIASLYLVLPFSGRPAQQYYVALILVAIGIVLFFINRLINRRLGVRDTEITDPTHLA

SEQ ID NO: 84734 - protein, 371 aa, Bacteroides fragilis YCH46
MGIMVGLPTSGGTEKDLQLNFGLTVNDQVEMLAPFLPAEWFLQSGIQLTWPHAGTDWAYMLAEVQECFINIAREIAKRELLLIVTPYPEEVRKQIIGTVNMDNVRFLKCDTNDTWARDHGAITLMDTGGASLLDFTFNGWGEKFEARLDNQITRRAVEAGALKGQYKDCLNFVLEGGSIESDGVGTLLTTSECLLSPHRNSPMNRVDIEEYLCRVFHLQRVLWLDHGYLSGDDTDSHIDTLARFCSPDTIAYVKCTDSEDEHYEALCKMEEQLKTFRTTSGAPYRLLALPMADKIEVEGERLPATYANFLIMNDVVLYPTYNQPENDKLAKEVLCEAFPTYEVVGIDCRALIKQHGSLHCVTMQYPTGVIK

SEQ ID NO: 84735 - protein, 305 aa, Miscanthus floridulus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARTAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFELMAKGEGIRCIIRMEN

SEQ ID NO: 84736 - protein, 493 aa, Arabidopsis thaliana
MDYPMKKVKIFFNYLMAHRFKLCFLPLMVAIAVEASRLSTQDLQNFYLYLQNNHTSLTMFFLYLALGSTLYLMTRPKPVYLVDFSCYLPPSHLKASTQRIMQHVRLVREAGAWKQESDYLMDFCEKILERSGLGQETYVPEGLQTLPLQQNLAVSRIETEEVIIGAVDNLFRNTGISPSDIGILVVNSSTFNPTPSLSSILVNKFKLRDNIKSLNLGGMGCSAGVIAIDAAKSLLQVHRNTYALVVSTENITQNLYMGNNKSMLVTNCLFRIGGAAILLSNRSIDRKRAKYELVHTVRVHTGADDRSYECATQEEDEDGIVGVSLSKNLPMVAARTLKINIATLGPLVLPISEKFHFFVRFVKKKFLNPKLKHYIPDFKLAFEHFCIHAGGRALIDEMEKNLHLTPLDVEASRMTLHRFGNTSSSSIWYELAYTEAKGRMTKGDRIWQIALGSGFKCNSSVWVALRNVKPSTNNPWEQCLHKYPVEIDIDLKE

SEQ ID NO: 84737 - protein, 308 aa, Sinorhizobium meliloti 1021
MIVCCGEALIDMLPRETTAGESAFAPYAGGAIFNTAVALGRLGVPTGFFTGLSDDMFGDILRATLKAANVDFAPCATLPLHTTLAFVKLVDGHASYAFFDENTAGRMITAEHLPALGDFCEALHFGAISLIPEPCGSTYEALMAREHEKRVISFDPNIRPGFIKDREAHVGRMNRMAAMSDIVKFSDEDLAWFGMEGSHDALAAEWLKRGPKLVLITRGADGAVGYTNGHKVEVASERVEVVDTVGAGDTFDAGVLASLKFNNLLTKERVASLTDEAIRQALTLAAKAAAVTVSRAGANPPWRHELGL

SEQ ID NO: 84738 - protein, 541 aa, Sinorhizobium meliloti 1021
MKALVENLKATARETDATDIRAAFAADPNRFSRFSTAFDDLLFDYSKCAVNDRIIDGLEALAKAAKVEEKRDAMFRGDIINITEERAVLHTALRNRSNRPVLVDGKDVMPDVNAVLEAMGKFADDIRSGALKGATGKKITDVVNIGIGGSDLGPVMATLALAPFHDGPRLHFVSNVDGAHIADTLTLLDPETSLFIVASKTFTTIETMTNAATARAFIAGKLGEAAVGHHFAAVSTALDKVGAFGIDAARVFGFWDWVGGRYSIWSAIGLPLMIAIGKENFGRFLDGGHAIDEHFRSAPLRQNIPMLLGLIGFYNRNVLGYPSRAILPYDQRLTRFPAYLQQLDMESNGKGVTLDSQPVEFSTGPVVWGEPGTNGQHAFYQLIHQGTDVIPAEFMIAANGHEKDLRHQHQLLMANCLAQSEALMKGRTLAEAKAQLTSKGMDDAKADKIAPHRVFTGNRPSLTIVYDQLDPFALGRLIALYEHRVFVEGALFNINSFDQWGVELGKELATGLLPVIEGKESAEGHDSSTAGLVAALLKAAR

SEQ ID NO: 84739 - protein, 195 aa, Shigella flexneri
TMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 84740 - protein, 409 aa, Desulfovibrio vulgaris subsp. vulgaris str. Hildenborough
MSICKAEEAIDAIRKGEMIILVDDEDRENEGDLTIAAQHVTPEVINFMATHGRGLICLALSPEWVDKLQLPLMARRNESKFGTNFTVSIEARRGVTTGISAADRATTILTAVADDVKAEDIVTPGHIFPLRAQKGGVMVRAGQTEGSVDLAKLANLKPAAVICEIMREDGEMARMPDLIEFAEKHNMKIATIKDLIRYRMQSGLLSVKRVGEAKMPTRYGDFQIIAYENELHDETHIALVKGDISPSEPVLVRVHSECLTGDVLGSLRCDCGGQLAAALCQIAAKGSGVLLYMRQEGRGIGLGNKIKAYGLQDQGYDTVEANHKLGFKADLRDYGIGAQILVDLGVRKMRMMTNNPKKIVGLEGYGIEVVERVPIELESCAFNEEYLRTKKEKMGHLLELKHHENGGDA

SEQ ID NO: 84741 - protein, 295 aa, Acinetobacter baylyi
MNKKLEALFRENVKGKVALITGASSGIGLTIAKRIAAAGAHVLLVARTQETLEEVKAAIEQQGGQASIFPCDLTDMNAIDQLSQQIMASVDHVDFLINNAGRSIRRAVHESFDRFHDFERTMQLNYFGAVRLVLNLLPHMIKRKNGQIINISSIGVLANATRFSAYVASKAALDAFSRCLSAEVLKHKISITSIYMPLVRTPMIAPTKIYKYVPTLSPEEAADLIVYAIVKRPTRIATHLGRLASITYAIAPDINNILMSIGFNLFPSSTAALGEQEKLNLLQRAYARLFPGEHW

SEQ ID NO: 84742 - protein, 416 aa, unidentified eubacterium SCB49
MQLQLFKIKQNNISFNKLLPDIQPQILAVKLTNKGERSVKSRHPWLFSDSLDKINKEGASGDVSVIFNRTTNKPMGVGLYDPDSPIRIKMLHFDGGAKLDSSYFSAKIDTAFSLRSDLLDTNTNSYRLLFGENDGFPGLIADVYASVLVVKIYNAIWFPFIKMIFPKLLEVSGCDTLVLRLSRSLQTNKANLEDGDVLFGTLKSEVVQFVEHGVAFSAHVIKGHKTGYFLDHRENRRRVGRLSKGKTMLDVFSYAGGFSVHALAKGATEVTSLDISAQALEVAKENGKLNKHKGKHFTIIGDAFLELERLVVEKKQFDVVVIDPPSFAKSKREIVVAKKKYAQLARLGAQLVSKNGLLVLASCSSRVTADEFFQINTETLKRSGKYFEFIDKTFHDTDHPIGFPEGAYLKCGYYRF

SEQ ID NO: 84743 - protein, 196 aa, Shigella boydii
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAM

SEQ ID NO: 84744 - protein, 427 aa, Oceanicola granulosus HTCC2516
MTIQESAKTSAGPFSRVCVIGLGYIGLPTAAMFASRRISVTGVDVDRSVVERVNKGQIHIVEPDLDIVVQAVVSQGHLRASLTPEPAEAFLVAVPTPFKGDNYEPDLSFIKAAADAIAPVLSQGNLVVLESTSPVGATEQLAGWLAAARPDLTFPQAHGEDSDIRVAHCPERVLPGKVMQELISNDRLIGGLTPKCSELAAQLYKLFVTGDCVLTNARTAEMSKLTENSFRDVNIAFANELSLICDSLQINVWEVIALANRHPRVRILRPGPGVGGHCIAVDPWFIVASSPENSRLIRAARHVNSSKPSWVLGKIDEAVATFLRQYPKLDEEDVTIACYGIAFKPDIDDMRESPALQIAHKLSRTHAGPLLVVEPNCTEVPSGLGEAELVTMQEAFQRADIHVYLVAHREFQASPRPPRYVIDTVGL

SEQ ID NO: 84745 - protein, 373 aa, Solanum lycopersicum
MVDANMGAAQFPDFPKIVTHAGQYVQYDIFGNLFEITNKYQPPIMPIGRGAYGIVCSVFNAELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSAHVIHRDLKPSNLLLNANCDLKICDFGLARPNVENENMTEYVVTRWYRAPELLLNSSDYTAAIDVWSVGCIFMELMNRKPLFAGKDHVHQIRLLTELLGTPTESDLSFLRNEDAKRYVRQLPQHPRQQLATVFPHVNPLAIDLVDKMLTLDPTRRITVEEALAHPYLAKLHDAADEPVCPIPFSFDFEQQGIGEEQIKDMIYQEALALNPEYA

SEQ ID NO: 84746 - protein, 817 aa, Aspergillus nidulans FGSC A4
MAGGTSLWVSKEARTDPREIFNLRHLYLMVTLAWAGCFYGFDTGNIGGILTLPSFETAFGLIDLPQKEYDDRKGTIAAMVAAGGAGGSLLAAPTSDVLGRKWSVFLWGLVFMLGAALQMVPNYDILLAGRFIGGLGVGASSMLSPQFLAENSPKSVRGSMTATYNLMIVTSLMLAFWWRTAMSIQLIPGGLMVLMIPFVPETPRYLINHGKAEQGVKNLCQLRKLPPDHPYIQLEFHEIQAQVQFEQETFQGHSYWVVLKDIFGNRSNLQRFVLALLLFIFHKLTGTDSLNYYAPQIFELIGVKDNSSLLTTGVYGAVKVAATIFYVTYLVDRVGRRLPLLMGATIQATAMLYLALYLRFAGTDNTDMGGTPAGGIVGIIWIYLYAFGWSFGHSVACYIVAAEIFPTRIRSACMGFCFFTNWIIDYGITRATPNMLTNMGYGAFLLYALLTYLGVVFIFFCLPELKGRSIESMDDLFQRPLWTLWRHAYPTAEETIIMQFLGFEHLSWYQPQEYPGKPRKMATDSFILNTGARIPAVGFGTWKAGPGEAAAAVQAAFDAGYRHFDCAPLYGNEAEIGQVFKNTKVPREGYFVTTKLWSSDHRRVEFALDKSLRDLNLMHWPVTLDPSPGDVNYGKEDRTVHATGWDFRDTWREMEKLLDTGKVKTIGVANFSTVNLRKLLETSRITPAVNQTEIQPLLPQEKLHAFCKEKGIHQTAFGPLGGSVSTLHQHPVINAIARKRGCETGNVMLSWGIQKGWSVIPKSTNPVRIKKNLSQNFVLDEQEMKDMDGLAKPKGKRFNRPNWGTVIFHDDVDVDLE

SEQ ID NO: 84747 - protein, 290 aa, Nitrobacter vulgaris
MLRKHPIISITGSSGAGTTSVKRTFEQIFRRENVVAAYIEGDAFHRYNRAEMRTRMAEESDKGNKHFSHFSPETNLFAELEGVFRSYGETGTGNTRYYVHDDAESALHGVPPGTFTDWQPLPDASDLLFYEGLHGAVVTDKVNVAQYADLKIGVVPVINLEWIQKLHRDRNARGYSTEAVTDTILRRMPDYVNYICPQFAETDINFQRVPTVDTSNPFISRWIPTPDESMVVIRLKNPRGIDFPYLLSMIPSSFMSRANSIVIHGSKLDLAMQLILTPLILQLIERKKRA

SEQ ID NO: 84748 - protein, 255 aa, Oryza sativa Japonica Group
MAAAGSIGVYRAVFAALGALMLGTLVYTCVTDGSPFRLELLTPWLVATLIDFYVNVTAISTWVIYKEVNWISSFFWVVLLYCFGSIATCAYVVVKLFEIKTSGPSQDPLDLLFLRQGDLSERKSSFVIIGRIIFSILGAMMAAVVIYTVITDGLPFRKDLLTPWMAATLIDFYINVFAISVWVAHKESNWISTAIWICLLICFGSITTCGYIVIQLFQVSYRDPIYHVLLNSHNKSLNAEQGRLPSIIPPSSAKV

SEQ ID NO: 84749 - protein, 111 aa, Picea sitchensis
MEIKKAVHACILLVMLFGLLNLVVCSVEDEINGFSLGQPQTLHKDRHLLALNCGSACGKRCALASVKDRCLKYCGICCSSCQCVPPGTYGNKNACPCYRDMKNAKGKPKCP

SEQ ID NO: 84750 - protein, 483 aa, Campylobacter lari RM2100
MLKKTKIVATIGPASENEATIRQMIINGVNVFRLNFSHGTHEYHSQNLATIRKVAAELNARIGILQDISGPKIRTLKIPETFELKNGDRLDFYKDTFEGEKLSSEHYKVCINHPEILSMLKVGEYIYLCDGSIKTKVVQVEKDFIQTQVENSGVLSSNKGINFPNTKINIDVITQKDKDDLAWGIKNDVDFLAISFVQNAHDIDEVKKILDENDAKIAIFAKIEKFDAVENIDEIINCSDGIMVARGDLGIEVPYYRVPNIQKLIIKKANEANKPVITATQMLFSLAKSKTATRAEISDVANAVLDGTDAVMLSEESAVGIDPANAVDIMTQTIIETEKNYPYEKFETFKCFNETDIIAKSSTQLATDLNANAIFTITSSGASAVKTARYRPKMDIIAITHSKKALNFLSIVWGVQPAILIEKHENLTELLSNSVKLGVEKGLMKKDGVYTLTAGFPVGVAGSTNLIRILQKDQIEYYLSLGK

SEQ ID NO: 84751 - protein, 178 aa, Acidobacteria bacterium Ellin345
MLGVGQKFPAFNLKATVSLEKGKEFADIKDNDYAGKWKIYFFWPKDFTFVCPTEIAAFGKMNKEFAERDTQVLGGSTDSEFVHHAWRTHHDDLRNLPFPMLADVKRELTSDLGILDPEAGVAQRATYIVDPQGIIRFAYVTDLSVGRSPSEVLRVLDALQTDELCPCNWQKGQETLHV

SEQ ID NO: 84752 - protein, 588 aa, Arabidopsis thaliana
MSYDEHTSSSFTYISQMGVWWIVLVVAVLTHTASAAVREYHWEVEYKYWSPDCKEGAVMTVNGEFPGPTIKAFAGDTIVVNLTNKLTTEGLVIHWHGIRQFGSPWADGAAGVTQCAINPGETFTYNFTVEKPGTHFYHGHYGMQRSAGLYGSLIVDVAKGKSERLRYDGEFNLLLSDWWHEAIPSQELGLSSKPMRWIGEAQSILINGRGQFNCSLAAQFSNNTSLPMCTFKEGDQCAPQILHVEPNKTYRIRLSSTTALASLNLAVQGHKLVVVEADGNYITPFTTDDIDIYSGESYSVLLTTDQDPSQNYYISVGVRGRKPNTTQALTILNYVTAPASKLPSSPPPVTPRWDDFERSKNFSKKIFSAMGSPSPPKKYRKRLILLNTQNLIDGYTKWAINNVSLVTPATPYLGSVKYNLKLGFNRKSPPRSYRMDYDIMNPPPFPNTTTGNGIYVFPFNVTVDVIIQNANVLKGIVSEIHPWHLHGHDFWVLGYGDGKFKPGIDEKTYNLKNPPLRNTAILYPYGWTAIRFVTDNPGVWFFHCHIEPHLHMGMGVVFAEGLNRIGKVPDEALGCGLTKQFLMNRNRN

SEQ ID NO: 84753 - protein, 403 aa, Photorhabdus luminescens subsp. laumondii TTO1
MKEHIAVDRNTYDQVMLPIYSPAQFIPVRGQGSRVWDQHGKEYIDFAGGIAVVALGHCHPTLVDVLKQQGEKLWHISNIFTNEPALILAQKLIDATFAERVFFANSGAEANEAAFKLARHYAIARHNPYKTKIIAFHQGFHGRTLFTVSVGGQPKYADGFGPKPADIIHVPFNDLDAVKAVIDDHTCAVVLEPVQGEGGVTAAAPAFIHGVRELCDKHQVLLVFDEVQSGMGRTGKLFSYMHYDVTPDIITTAKALGNGFPISAMLTTVNIASVMTPGAHGTTYGGNPLACAVANVAFDIINTPAVLAGVEKRHNLMVNFLNDINQKYSIFGEIRGKGLLIGAELKAPHQGKAKDILQLAAENGLMLLSAGGDVLRFTPSLIISEEEIAQGMERLEQVINQLV

SEQ ID NO: 84754 - protein, 422 aa, Pseudomonas fluorescens PfO-1
MKNSYREYVLQCLVCDRSYQPHEVSYFCPHCKVDGALDALYDYPTLRREWPKESLAHHQARGMWRYDRLMPLSSTQFIPPLLVGNTPLYAPTDLLGKGSRIKVLIKDESRQPTGSLKDRASALAVAHAMQSGARTVAVASTGNAASALAGMSASLGLHNVIYLPRSAPREKRAQMQGYGAEIVLVDGQYDEAFEQCLNACERYGWYNRTTGINSYMSEGKKTVAFEICEQLHWQVPDLVFVPVGNGCILGSVYKGFFDLLQLGWIERIPRLIGVQAEHSNFMYRAWRSDRPMQQTERIAPTSLASSINVALPRDRLKAMRAVTASEGEFMCVSDASIVAAASKLAASTGVFPEAGAASAFAGLLKYAEQHPDTAQTAVILITGSGLKDTSIFLSDTAASPSRVFPHHVPTTLTETLAQGITA

SEQ ID NO: 84755 - protein, 289 aa, Photorhabdus luminescens subsp. laumondii TTO1
MSVKHPIIAITGSSGAGTTTTSLAFRKIFQQLNISAAQIEGDSFHRYTRPEMDAAIRKAKEQGRHISYFGPEANDFGMLEKTMIDYGETGEGRRRKYLHTYDDAVPYNQLPGTFTPWESLPKQTDVLFYEGLHGGVVTPQHNVASHVDLLVGVVPIVNLEWIQKLVRDTGERGHSQEAVMDSVVRSMDDYINYITPQFSRTHINFQRVPTVDTSNPFSAKTIPSLDESFIVIRFRDLTQIDFPYLLAMLQGSFVSSINTIVVPGGKMGLAMELIMTPLVQRLLEGEKIC

SEQ ID NO: 84756 - protein, 240 aa, Salinibacter ruber DSM 13855
MRHATRTPEYSARRTASTPHPSSLMSNEEPLTRQQIRRKQKFGEPLLPEEEDETEQEHRHIIAVTLENTIGALNRVTNLFSARGFNLESVAVGETDEPSVARLTLVTVGNDRIVAQITRQLDNLVNTYDVTDLTDAEHVERELCLLKVQYTTETRSEVLDIKDIFRGRVVNVTPETMILEVTGPTKKINALVGMMEEHGIEEVARSGQVAMHRALEYEAPNPLASADAEPSANGASSDND

SEQ ID NO: 84757 - protein, 305 aa, Miscanthus sinensis var. formosanus
IESVGEGVTDVAPGDHVLPVSTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 84758 - protein, 630 aa, Coprinopsis cinerea okayama7#130
MDAIKSLLSPLGMNTGALQDTLKLVVIGGTVETARRASVSAWNGFVDSFFLTAHFSQEDYPYDCREFDITTRAVGRNSLAQSTAGDLEEDEDEDDGLVHGRRKRKVQFMPSVDTTHTIYYRGHWLRITRTKRYPDSYGHGASLKISVVARNNDILKKLVLEAKREYEKDSEHRVHIFLADTSYACWRFNGSRQKRPMSSIVLQPGVKDMLLADCKDFLNSEEWYAERGIPFRRGYLLHGVPGSGKTSLIHSLAGELGLDIYVVSLSSKGMSDNTLTTLMSHVPSRCILLLEDLDAAFTRGVSRDSTSTGAPPPASSSSSTTSTTTTKETEASDGSTLSLSGLLNSLDGVAAAEGRLLFATTNHIERLDPALSRPGRMDVWINFTHATKWQAEGIFKCFFPSKPSGATESKAEEDSKEKDASQKNLPGSKRKSHKHAIPLLSEEEISELAKRFADAIPENELSVASLQGYLLKNKTRPRECVDEVAAWVQQERETREKIKQEKEKAEREAQEKKKAEEKEKEEKEKKEKEEKEAKEKQDRKGKKKARSEPKVDPSVSSDSADSSKSTSSSEGETTGADADTESVTSEEESDKEKATPSEDKKDKWVSVKGQSTSTSSAQTDSEANTSDSAT

SEQ ID NO: 84759 - protein, 305 aa, Miscanthus sinensis var. formosanus
IESVGEGVTDVAPGDHVLPVFTGECKECAHCRSAESNMCDLLMINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFVCVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 84760 - protein, 363 aa, Arabidopsis thaliana
MEDIENIEEDEYGFSRNYFLAKELGGASKRSAHKLSDIHIVDEQELRETASTIEMKHSKEISELMSDYKTMYSKWVFELRCGFGLLMYGFGSKKALVEDFASASLTDYSVVVINGYLPSVNLKQVLLALAELLSELLKCKRKSSGSLSKGQETFPSRSMDDILSFLHGPQSGDKDCFICVVVHNIDGPALRDPESQQTLARLSSCSHIRLVASIDHVNAPLLWDKKMVHKQFNWLWHHVPTFAPYNVEGVFFPLVLAQGSTAQTAKTAAIVLQSLTPNGQNVFKILAEYQLSHPDEDGMPTDDLYSASRERFFVSSQVTLNSHLTEFKDHELVKTKRNSDGQECLNIPLTSDAIRQLLLDLNQ

SEQ ID NO: 84761 - protein, 494 aa, Oryza sativa Japonica Group
MPGAAGYSGSVKLKYVKLGYQYLVNHFLTLLLVPVMAATALELARMGPGELLSLWRSLQLDLVHILCSVFLVVFVGTVYFMSRPRPVYLVDYSCYKPPPSCRVPFATFMEHTRLITDDEKSVRFQTRILERSGLGEETCLPPANHYIPPNPSMEASRAEAQLVIFSAIDDLVRRTGLKPKDIDILVVNCSLFSPTPSLSAMIINKYKLRSNIRSFNLSGMGCSAGLISLDLARDMLQVHPNSNALVVSTEIITPNFYWGTRRDMMLPNCLFRMGAAAILLSNRRREARRAKYRLMHVVRTHKGADDRAYRCVYEEEDEQGHSGISLSKELMAIAGDALKSNITTIGPLVLPMSEQLLFFFRLVGRKLINKKWKPYIPDFKLAFEHFCIHAGGRAVIDELQKNLDLSAQHVEASRMTLHRFGNTSSSSLWYELAYIEAKGRMRRGDRVWQIGFGSGFKCNSAVWKCLRTVKTPADGPWDDCIHRYPVDIPEVVKL

SEQ ID NO: 84762 - protein, 305 aa, Miscanthus sinensis var. formosanus
IESVGEGVTDVAPGDHVLPVFTGECKECPHCKSAESNMYDLLRINTDRGVMIGDGKSRFSINGKPIYHFVGTSTFSEYTVMHVGCVAKINPQAPLDKVCVLSCGISTGLGASINVAKPPKGSTVAIFGLGAAGLAAAEGARIAGASRIIGVDLNPSRFEEARKFGCTEFVNPKDHKKPVQEVLAEMTNGGVDRNVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 84763 - protein, 504 aa, Zea mays
  misc_feature (142)..(142): Xaa can be any naturally occurring amino acid
YIRRYGLLGLNGCGKSTLLTAIGCRELPIPEHMDIYHLSHEIEASDMSALQAIVSCDEERVKLEKEAEILAAQDDGGGEALERVYERLDAMDAGTAEKRAAEILFGLGFDKQMQAKKTKDFSGGWRMRIALARALFMNPTIXLLLDEPTNHLDLEACVWLEETLKKFDRILVVISHSQDFLNGVCTNIIHMQSKKLKLYTGNYDQYVQTRSELEENQMKQYKWEQEQIASMKEYIARFGHGSAKLARQAQSKEKTLAKMERGGLTEKVVRDRVLVFRFTDVGKLPPPVLQFVEVKFGYTPDNLIYKSLDFGVDLDSRIALDGPNGAGKSTLLKLMTGDLATLDGMDRRHNHLRIAQYHQHLADKLDLDMPALAYMMKEYPGTEEEKMRAAVGRFGLSGKAQVMPMRNLSDGQRSRVIFAWLAYRQPQLLLLDEPTNHLDIETIDSLAEALNEWDGGLVLVSHDFRLINQVAQEIWVCENQAVTRWEGDIMDFKAHLKSKAGLSD

SEQ ID NO: 84764 - protein, 305 aa, Miscanthus sinensis var. formosanus
IESVGEGVTDVAPGDHVLPVFTGECKECAHCRLAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTGFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 84765 - protein, 77 aa, Brassica napus
  misc_feature (37)..(37): Xaa can be any naturally occurring amino acid
  misc_feature (50)..(50): Xaa can be any naturally occurring amino acid
MDESAGSSSSWAAISSSNIGFQLLKKQGWKEGTGLGXAEHGILVPVQAEXKNNKRGLGAPAEKPTKRKSRESYGFWK

SEQ ID NO: 84766 - protein, 305 aa, Miscanthus sinensis var. formosanus
IESVGEGVTDVAPGDHVLPVFTGECKECAHCRSAESNMCDLPRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRGVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 84767 - protein, 127 aa, Glycine max
MADQGLEGSQPVDLQKHPSGIVPTLQNIVSTVNLDCKLDLKTIALQARNAEYNPKRFAAVIMRIRDPKTTALIFASGKMVCTGAKSEQQSKLAARKYARIIQKLGFPAKFKDFKIQNIGRSCDVKFP

SEQ ID NO: 84768 - protein, 204 aa, Shigella boydii
RRELKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGFS

SEQ ID NO: 84769 - protein, 311 aa, Helicobacter hepaticus ATCC 51449
MSKVSVFGGGAWGRALAFALAEKNEVRIISRRDISSLLEPLNQKLKTLNCTSIIQVSHKEALDAQYFVMAIATSALREWLAVADLPQKIKILCASKGIESGSGAFVSDIMEERIAHKSIAYLCGPSFASEVVHSLPCALVIHSRNLELSREFGTLMPHFIKTYASPDVVGGEVAGAYKNVIAIAGGICDGLAFGMNAKASLLARGLVEMSRFGEHFGAKMETFLGLSGAGDLFLTSNSTMSRNYRVGLGLAKGKAINEILKELGEVAEGVITAKAITEIGQRENIYTPIAREINLIINGKNVRESSKALMA

SEQ ID NO: 84770 - protein, 398 aa, Myxococcus xanthus DK 1622
MAVEIKVPPLGESITEAVVGKWNKKPGDAVTADEPLVVLETDKVTIDVPAPSAGSLSSIAFKEGDKVRVGEVLGLLEAGAGAPAARPAAAPAPAAAPAPAAEVPAASDARSTPTARKVAEENRLDISQVKGSGAGGRVHKDDVLGQLNRPATPAAPAQPAGPRPNAAREERVRMTPLRKRVAERLIQAQSTAAMLTTFNEVDMGEVMALRKKYNDKFQQKHGVKLGFMSFFIRASVEALKAFPQINAEIDGEDVIFKHYYDIGVAVSGSRGLVVPVVRNADKQGLAELEKSVGELGTKARNDKLALADLQGGTFTITNGGIFGSMLSTPILNPPQTGILGMHNIVERPVARDGQVVIRPIMYIALTYDHRLVDGREAVQFLVRVKECIEDPERLLLDV

SEQ ID NO: 84771 - protein, 188 aa, Shigella dysenteriae
IGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIV

SEQ ID NO: 84772 - protein, 273 aa, Picea sitchensis
MVKLESHNLIDALNVTVNGSGERILVLSHGFGGDQSMWKHILPYLLPDFKVIVFDMVFSGSVDPKHFDFDRYTDSLSAYADDLLAILDELKADKCVYVGHSVSAMVGCLASIKRPGLFERLILLCASPRYLNNESYEGGFERGDIDGIFSAIKSNYSAWVSGFVPLLIGVDEPSLVKEFSKKLMNMKPEIALVVAKAIFQSDVRNILCDVKTPCSIIQTRKDIAVPLSVPYYMQRNLGGEKNSVHILDTDGHIPQLTSPSMFAKLLTQILAGS

SEQ ID NO: 84773 - protein, 195 aa, Shigella dysenteriae
HLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVG

SEQ ID NO: 84774 - protein, 587 aa, Geobacillus stearothermophilus
MKRKTKIVCTIGPASESVDKLVQLMEAGMNVARLNFSHGDHEEHGRRIANIREAAKRTGRTVAILLDTKGPEIRTHNMENGAIELKEGSKLVISMSEVLGTPEKISVTYPSLIDDVSVGAKILLDDGLISLEVNAVDKQAGEIVTTVLNGGVLKNKKGVNVPGVKVNLPGITEKDRADILFGIRQGIDFIAASFVRRASDVLEIRELLEAHDALHIQIIAKIENEEGVANIDEILEAADGLMVARGDLGVEIPAEEVPLIQKLLIKKCNMLGKPVITATQMLDSMQRNPRPTRAEASDVANAIFDGTDAVMLSGETAAGQYPVEAVKTMHQIALRTEQALEHRDILSQRTKESQTTITDAIGQSVAHTALNLDVAAIVTPTVSGKTPQMVAKYRPKAPIIAVTSNEAVSRRLALVWGVYTKEAPHVNTTDEMLDVAVDAAVRSGLVKHGDLVVITAGVPVGETGSTNLMKVHVISDLLAKGQGIGRKSAFGKAVVAKTAEEARQKMVDGGILVTVSTDADMMPAIEKAAAIITEEGGLTSHAAVVGLSLGIPVIVGVENATTLFKDGQEITVDGGFGAVYRGHASVL

SEQ ID NO: 84775 - protein, 475 aa, Vitis vinifera
MDRKQGFFAALKEEVVRGLSPARSRAKSPGRAGSPMSGLLRRRKQSHNQYVANPEPLISRSGSLRPVVGETLTPLMEGPDPDGSEIGESKRSGLGLGHWMKGQLSRTPSVTSAAYRRSDLRLLLGVMGAPLAPVHVSTTDPLPHLSIKDTPIETSSAQYILQQYTAASGGQKLQNSIRNAYAMGKVKMIASEFETATRVLKNRNASKDADSGGFVLWQMNPDMWYVELAVGGSKVHAGCNGKLVWRHTPWLGAHSAKGPVRPLRRALQGLDPRTTASMFADARCIGEKKINGEDCFILKLCADPQTLKARSEGPAEIIRHVLFGYFSQKTGLLVHMEDSHLTRIQSNGGDAVYWETTINSFLEDYRPVEGIMIAHSGRSIVTLFRFGEMAMSHTKTRMEETWTIEEVAFNVPGLSVDCFIPPADLRSGSISEACELPHEERGKSSVSLAAHRAKVAALEKTHDGGIDNVIWRMEV

SEQ ID NO: 84776 - protein, 280 aa, Listeria monocytogenes str. 1/2a F6854
MTLSFSDTYRLNNGIEMPRHGFGVYKLTDEARMRTALETAVDVGYRLFDTASFYHNEKELGDFFASSGLKRDEFFVTTKMWNTEQGYDETLWAFEKSQKKLQLDQIDLYLVHWPKQDTFFDTWRAVEKLYDEGLVRAIGVSNFEAHHLDRLRTSANVLPVVDQLETHPHFPNHLLHRYLEELHIVHQAWSPLGRGGVLQEQILIDLAEKHGKSPAQIVLRWHLQNNISIIPKSETPSRIRENAAIYDFELSEADMRQVERLNTGERVSHAPDVMYVRSEI

SEQ ID NO: 84777 - protein, 194 aa, Shigella dysenteriae
TMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGF

SEQ ID NO: 84778 - protein, 204 aa, Arabidopsis thaliana
AFLPTTTSLPEEHHVDFFGERLIVTVTHTPSVIRRWIHSIRFVSRLRLSHPLVVGLGVQWTPRGSDPPPDILQLCVGTRCLIIQLSHCKYVPDVLRSFLEDQTITFVGVWNSQDKDKLERFHHQLDIWRLVHIRHYLHPLLLSSSFETIVKVYLGHEGVTKDKELCMSNWGARSLSHDQIVQASHDVYVCCKLGVKERLWKMGA

SEQ ID NO: 84779 - protein, 186 aa, Shigella dysenteriae
MIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIG

SEQ ID NO: 84780 - protein, 1106 aa, Ustilago maydis 521
MGASQSSHKPGVAGGTATDANGDPAFVDYYELLHIEQTATSDEIRKAYRKLALKHHPDKNPDNVEQANKIFHKLQEAYEILSDDTERAWYDQNRERLLNGEGPDLDDDDVFEAFRSGAAEAPQPTSSARGLTAKALLRFFDPSLAKDLTEGDNGFYATYRRLFERLAQEERIAAPYPGEEKDSTLPSADAYPSFGYSHTPYSNAKGQQAAIHQTPVKDFYNVFMNFQSRKSFGWFDKYDVRDAPDRRVKRLMEKENKRARDAARREYNDAVRSLAAFIRKRDPRYKKFQAELNSTGPGSTADLARRKAEAEKIRLEREARAQSYQAQSWQQPDYHFSDEDDEEEEDVNDDDADSDFESVQKDGSRSLAGQDGALDSLDHSYAAWDCVACDRVFQSEAAFRNHERSAKHNKAVQKLQREMQDEEDELGLGLDADDIAIDASLADMHLDGSMAQTKADTNVSAGFSIPAFASEGAAGKSKKQKKQAKKRRQMEEVAGRTLDEDGFVVQDLNRKQAKPRASEEASPANEPSNDTGANKDTLVIHVVDDDDQLDGDAETNVCDQVGAGDEESVPPKPSASQKHDAAKSKTGPDQLQATDKGALSGTKDDPWAGLEDPYIPKSAFSVSLPPPLPPLTRPAGSFDIFGYGSLIFKPPPYVIGATPCYIKGFVRRFAQHSVDHRGTHERPGRVVTLVKASDWHPLRRAAKQYLDYREKNGYSAMYVPLYTKSKEQDGAQEETVLKNALVYVGLPSNPAFVGPQSLDALAQRIYTCAGPSGPNAEYLLKLANAVRELAPQSVDQHLFSLEKRLLLLQEQKVDPAMLIAQEAKQPSCKKVTTDSIEDEEDQQDARGWKGKKGSKDTDSTRLQDDGVTDASVFSPRTIRYTKLRIYPLPLHFVWLSVQRCLQAEWQNRENSAKLMMCGCCPYRSSDKVRSEQMPALAECAHSVTDGQETKQPIRSRWKQITNREYTHRKHTDTEFKVQTAQDDECLRGSTFRGLFLEIGACVISLEWKDNHHLEAVAHNLEATANVDVAEVTSGARRRALYLDMLDACTAQSQLNCEMFLNSTCTTTKLARKAKALNALSSGSTATSLGTDDSRFEAKQDDDAGQA

SEQ ID NO: 84781 - protein, 407 aa, Myxococcus xanthus DK 1622
MSGFDVNQVRKDFPILDQEVRGRPLVYLDSAATAQKPQAVIDALVRFYQHDNANVHRGVHVLSERATEAYEGARETVRRFINARDVKEVVFVRGTTEAINLVAQTYGRKHIGAGDEVLITQMEHHANIVPWRMLCEQTGAVLKVIPVDDRGELVLDAVDALLTERTRILAVTHVSNALGTVAPVKELTRRAHAKGIPVLVDGAQAVTHFPVDVQDLGCDFYAFSGHKMFGPTGIGVLYGRKERLDAMPPYQGGGDMILSVTMEKVTYNRVPYRFEAGTPNLEGAVGLAAAIRYLEALGMENVAAHDRELLAYATQALESVPGLRMVGTAREKSGVLSFMLADIHPHDVGTILDREGICIRTGHHCAQPVMQHFKVPATSRASLALYNTREDVDALVRGLHKVLEVFQ

SEQ ID NO: 84782 - protein, 953 aa, Flaveria trinervia
MMSSLSVEGMLLKSARESCLPARVNQRRNGDLRRLNHHRQSSFVRCLTPARVSRPELRSSGLTPPRAVLNPVSPPVTTAKKRVFTFGKGRSEGNRDMKSLLGGKGANLAEMSSIGLSVPPGLTISTEACEEYQQNGKSLPPGLWDEISEGLDYVQKEMSASLGDPSKPLLLSVRSGAAISMPGMMDTVLNLGLNDEVVAGLAGKSGARFAYDSYRRFLDMFGNVVMGIPHSLFDEKLEQMKAEKGIHLDTDLTAADLKDLVEKYKNVYVEAKGEKFPTDPKKQLELAVNAVFDSWDSPRANKYRSINQITGLKGTAVNIQSMVFGNMGNTSGTGVLFTRNPSTGEKKLYGEFLINAQGEDVVAGIRTPEDLGTMETCMPEAYKELVENCEILERHYKDMMDIEFTVQENRLWMLQCRTGKRTGKGAVRIAVDMVNEGLIDTRTAIKRVETQHLDQLLHPQFEDPSAYKSHVVATGLPASPGAAVGQVCFSAEDAETWHAQGKSAILVRTETSPEDVGGMHAAAGILTARGGMTSHAAVVARGWGKCCVSGCADIRVNDDMKIFTIGDRVIKEGDWLSLNGTTGEVILGKQLLAPPAMSNDLEIFMSWADQARRLKVMANADTPNDALTARNNGAQGIGLCRTEHMFFASDERIKAVRKMIMAVTPEQRKVALDLLLPYQRSDFEGIFRAMDGLPVTIRLLDPPLHEFLPEGDLEHIVNELAVDTGMSADEIYSKIENLSEVNPMLGFRGCRLGISYPELTEMQVRAIFQAAVSMTNQGVTVIPEIMVPLVGTPQELRHQISVIRGVAANVFAEMGVTLEYKVGTMIEIPRAALIAEEIGKEADFFSFGTNDLTQMTFGYSRDDVGKFLQIYLAQGILQHDPFEVIDQKGVGQLIKMATEKGRAANPSLKVGICGEHGGEPSSVAFFDGVGLDYVSCSPFRVPIARLAAAQVIV

SEQ ID NO: 84783 - protein, 438 aa, Glycine max
ERNMQQRLKLQQQQQALMQQALLQQQQMYHPGMLAAAMSQMEPVPSGNLPPGFDTSACRSVYVGNIHVNVTDKLLAEVFQSAGPLAGCKLIRKEKSSYGFVDYHDRASAALAIMTLHGRQLYGQALKVNWAYANSSREDTTGHFNIFVGDLSPEVTDATLFACFSVYPSCSDARVMWDHKTGRSKGYGFVSFRDHQDAQSAINDMTGKWLGNRQIRCNWATKGAGGSSNEEKINDSQNAVVLTNGSSDGGQDNNNEDAPDNNPSYTTVYVGNLPHDVTQAELHCQFHALGAGVIEEVRVQRDKGFGFVRYNTHDEAALAIQMANGRLVRGKNMKCSWGSKPTPPGTASNPLPPPAQPYQILPTAGMNQGYSPAELLAYQRQLALSQAAVSGLSGQALLQMTGQHGLAPASMGINSGASQAMYDGYTGNSSRQQLMYYR

SEQ ID NO: 84784 - protein, 326 aa, Candida glabrata CBS 138
MSVGISKDTLLKFKAVKSFRVSEKEVSPITSLCFDDHGQHLLASSASDTMHLYDSVGCRFLNTIASKKYGCHAAKFTHAQSECIYSSTMKTFDIRHLNLETNQYLRYFVGHGALVSDIQMSPINDSFLSASYDESVRVWDLRTSKAQAIIPTVVPNCIAYDPSGLVFALGNPESNEIGLYNVRQLKNGPFLVIKVEQGFKQWNKLEFSNDGKYILLASSYGKQLILDAFTGEQLFELVGTKPFPLREFMDSGSACFTPDGQFTLATDYDGKIAIWNHGESISNRTLKPQGYVQAPEEVCPRTILFNPKYSMFVTADESVDFYVLEQ

SEQ ID NO: 84785 - protein, 469 aa, Rhodopirellula baltica SH 1
MVLSLFDPHRQAGSLSHFLSPKRSPLLFMPTDFTSRIQDRSATVGVVGLGYVGLPLALAYAGGGFKTVGFDIDDKKTSAINAGTSYIKHISADSIATAIQSGNLAATTDFSQIREVDAIILCVPTPLDEHFEPDLSYVVSTIESILPHLRAGQTISLESTTYPGTTAEELVTRIEAAGLTVGTDVHVVYSPEREDPGNPEFAATNIPKVVGGHTPACLKAGEALYGSVFDQVVPVSSTQVAELTKLLENIYRSVNIGLVNELKLVADQMGIDIWEVIQAASTKPFGFKAFYPGPGLGGHCIPIDPFYLTWKAREFGVHTRFIELAGEINRAMPTHIVRRCADALNQNKKALNGSKVLLVGLAYKPNVDDDRESPSYELLDRLTSQGAEVDYHDPYVPVIRPSREHSHWAGKPSVAWDEATIQEYDLVLISTWHDCLDIHELAQWSTFIVDTRNATAKLPPELQTRVLKA

SEQ ID NO: 84786 - protein, 307 aa, Malus x domestica
MGEGEEDCRTIPAIDLKKFPDAEEYRKLREASETWGCFRLVNHMIPPALMSEMKSVVRSLLDLPMEIKKQNKDVIAGSGYMAPSKVNPLYEALGLYDLGSGQAVDSFCSRLNASSYQRDVIEKYAQAVYEQIVDIGKRLAESLGLADSDYLKGWPCQFRINKYNFTPESVGSSGVQLHTDSGFLTILQDDEDVGGLEVMDKSGAFVAVDPCPGTLLVNLGDVAKAWSNGRLCNVKHRVQCRDATIRISVATFLLGPKEEAVVDAPAEFVDPEHPRLYVPFTYEDYRKLRLSTKLQAGEALALMPSPS

SEQ ID NO: 84787 - protein, 222 aa, Acidobacteria bacterium Ellin345
MNLPNSITLSRIFSIPLLIWILLTPRIGSLHGERELLASAVFILASITDGLDGYLARKRQQVTTMGMLLDPLADKLMVTAAFITLVQVNPHIVSAWVAVIVIGREFLVSGLRSIAASEGFTIQASDLGKMKMVVQIVCVVAAILDVRWWDAEWDFGSFHFVLAIDLIAKMAIWFMVALSLISAVDYFVGFWRKIDRSSERRRRRSFVLSRRRKSPDVAATQQ

SEQ ID NO: 84788 - protein, 151 aa, Glycine max
MACFSLNLSALHMFRPCVYIPQIVANPLQHQNRKIKILACQANQNLDQSSTTEKSVAELGNSKGTSSPNGVPPKFPSKDFKKKIAIVSFLGALGLLLSSRLHFFGVPMKDHCAHALPSKEARPNGKFTVVEFNADWCEVRGELAPDVYEVE

SEQ ID NO: 84789 - protein, 355 aa, Arabidopsis thaliana
MAIRSLPSSSRCSSSSSSSSYSLASTSLSNRLETIFKKASELCTLCDIEACVIYYGPDGELKTWPPEREKVEDIALRYSQLNEALRRKKSVTLYDFLNKKKDKTNLEKKAKITDNDDLKTCLKNVNILKYPLADHYSPDQVSQLIQSLEPHVSKVRERIRFVESQKHKETKPDHQSLASSSLNHQTQSLNPSQFSLFMYNHGDNTLSQIPVSASNFNQDYFSALLEQSELKSQIMKQDLCGYEQNMCMSNHGDATLSQIPLSASNLNQDFSALLQDESGLMQQELCGYDQNMFMNNNNFQHSFVSNTQDHSAPVVQESVNNNYGLMPHVPCGYDQNLFTSDITNNNLLINNSMFL

SEQ ID NO: 84790 - protein, 174 aa, Pseudomonas putida GB-1
MKYRLGNLRVETHPTSWAAPNATLIGNVRLQADASVWFGAVLRGDNELIDIGEGSNVQDGTVMHTDMGSPLTLGKGVTVGHNAMLHGCTVGDYSLVGINAVILNGARIGKHCIIGANALIPEGKEIPDGSLVMGSPGKVVRELTEQQKRMLEASAAHYVHNAQRYARELVVDDE

SEQ ID NO: 84791 - protein, 843 aa, Vitis vinifera
  misc_feature (40)..(40): Xaa can be any naturally occurring amino acid
  misc_feature (86)..(86): Xaa can be any naturally occurring amino acid
  misc_feature (96)..(96): Xaa can be any naturally occurring amino acid
  misc_feature (185)..(185): Xaa can be any naturally occurring amino acid
  misc_feature (198)..(198): Xaa can be any naturally occurring amino acid
MDRFDLIEGIALVSPPGITTLPPLNRSLGPTADRRMMETXYDKQELIWESDRMRYEERWALGIQEESGPGLYLAVAPHNFYGINRXFIYHGLHRLXCSFNTSGCTWAQVYDPNLTRATTLNVHLVGGPWRCWALHIVGAGDRKSESTSIPLVQIQTTARRHRFNNCTNPHVVWFGAQTERFPPPXCHVAIKSVSRRYXSGLSFLSTLSTGSFTSQPFEPKESFNSPLLPRPMVPKASMLDPQSAAVKAVSVIGCGYDLSTDIRLSGCKSGPSFSRLIDLDQALTRDLVLPGGIIVPDVSSSIKCDKGERTRFRSDVLSFNQMSERFNQDLSLSGKIPSGLFNSMFDFKVCWQKDAGAAKGLAFDGWFITLYNIELVRSQISLSEDIKREVPSSWDPDALAGFIEKYGTHIVVGVKMGGKDVIHIKQLQSSNLQPTEVQKLLKQLADERFSEDVNGNFISNPIEFSGKLKQERSVAWDLPVALANAIRPSVISHSKNDDLLSIQVRRGGIDNGQSHKQWLSTISQSPNVISMSFVPITSLLSGVRGSGFLSHAINLYLRYKPPIEELHQFLEFQLPRQWAPEYGDLPLGPRRKKQASPALQFTFMGPKLYINTEKVNSGNRPVTGIRLYLEGRKSDHLAIHLQHLATLPKSLQLSDDHSYEPIDESVKRGYLEPVKWSIFSHVCTAPVEYNGACIDDYATIVTKAWFEVNIVGMKKVLFLRLGFSMVASAKLRRSEWEGPSTSSRKSGVMSMLISGRFSTGLTPPVKPTKVDLNSAVFPGGPPTPARPPKMSNFVDTKERVRGPEDPPGYWVVTGAKLCMESSRITLKAKYSLLTIMSEDSLLM

SEQ ID NO: 84792 - protein, 526 aa, Salinibacter ruber DSM 13855
MHDKIVVLDFGSQYTQLIARRVRETGVYSEIRPCTVEADAIDALNPSGVILSGGPCSVYDEAGPALDPALLELERPDGTPVPLLGICYGLQAMAHQFGGEVARADRREFGRAQLQVPPDGQEKSLLFEGVPSGSTVWMSHSDHLTDLPDGYEVIARTDNAPVAAVRDTDGPYYGVQFHPEVVHTDYGRQILENFAHAICGCSGDWTPASFVEEQTETIRDRVGDRHVILGLSGGVDSSVAAALLQRALGDQLHCIFVNNGLLRKGEWNQVQDTFRGHFEMDLRTTDATDRFLERLDGVTDPEEKRTIVGNTFIEVFEEQTEAIAADLGHRPTYLAQGTLYPDLIESVSFKGPSVTIKTHHNVGGLPEELDFDLIEPFRELFKDEVREIGRLLDVPDPIVGRHPFPGPGLAIRILGQITRERLALLREADAIFIEELRANDLYDEVWQAFAVLLPVQAVGVMGDERTYENVCALRAVTSVDGMTADWAHLPHDFLGHVSNRIVNEVPGINRIVYDVSSKPPATIEWE

SEQ ID NO: 84793 - protein, 451 aa, Mycobacterium sp. JLS
MTTAVVPRVSGGEEEHGHLEEFRTDPIGLMKRVRDECGDVGWFQLVDKHVILLSGAEANEFFFRSADEDLDQAEAYPFMTPIFGKGVVFDASPERRKEMLHNSALRGEHMKSHAATIEGEVKKMIAGWGDEGEIELLDFFAELTIYTSTACLIGLKFREQLDHRFAEYYHELERGTDPLCYVDPYLPIESFQRRDEARVKLVALVQEIMNQRVADPPKDKADRDMLDVLVSIKDEEGNPRFSADEVTGMFISLMFAGHHTSSGTSSWTLIELIRHPEVYAAVQQELDELYADGQEVSFHALRQIPLLDNVVKETLRLHPPLIILMRVAQGEFEVAGFPIHKGDFVAASPAISNRIPEDFPDPDAFKPDRYDKPEQADVVNRWTWIPFGAGRHRCVGAAFATMQIKAIFSVLLREYEFEMAQPPETYRNDHSKMVVQLERPAKVRYRRRVKA

SEQ ID NO: 84794 - protein, 305 aa, Miscanthus sinensis f. glaber
IESVGEGVTDVAPGDHVLPVFTGECKECPHCKSAESNMCDLLRINTDRGVMIGDGKSLFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNISAMIQAFECVHDGWGVAVLVGVPHKDAELKTHPMNFLNERTLKGTFFGDFKPRTDLPNVVELYMKKELEVEKFITHSVPFAEINKAFDLMAKGEGIRCIIRMEN

SEQ ID NO: 84795 - protein, 305 aa, Miscanthus sinensis f. glaber
IESVGEGVTVVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLTAAEGARIAGGSRIIGVDLNPSRFEEARKFGCTEFVNPKDHKKPVQEVLAEMTNGGVDRSVECTGNINAMVQAFECVHDGWGVAVLVGVPHKDAELKTHPMNFLNERTLKGTFFGDFKPRTDLPNVVELYMKKELEVEKFITHSVPFAEINKAFDLMAKGEGIRCIIRMEN

SEQ ID NO: 84796 - protein, 482 aa, Staphylococcus aureus subsp. aureus NCTC 8325
MGSFFNKIARKEDPAIYQNKDGHLKRTLRVRDFLALGVGTIVSTSIFTLPGIVAAEHAGPAVALSFLLAAIVAGLVAFTYAEMAAAMPFAGSAYSWVNVLFGEFFGWVAGWALLAEYFIAVAFVASGFSANLRGLVKPIGIELPAALSNPFGTNGGFIDIIAAIVILLTALLLSRGMSEAARMENILVILKVLAIILFVIVGLTAINVSNYVPFIPEHKVTATGDFGGWQGIYAGVSMIFLAYIGFDSIAANSAEALDPQKTMPRGILGSLSVAIVLFIAVALVLVGMFHYSQYANNAEPVGWALRQSGHGVVAAIVQAISVIGMFTALIGMMLAGSRLLYSFGRDGLLPSWVSHLNDKHLPNRALVILTIIGVLIGSMFPFAFLAQLISAGTLVAFMFVSLAMYRLRKREGKDLPIPAFKLPLYPVLPAITFVLVLLVFWGLGFEAKLYTLIWFIVGIILYLSYGLRHSKKNDVAEYHPPK

SEQ ID NO: 84797 - protein, 305 aa, Miscanthus sinensis f. glaber
IESVGEGVTDVAPGDHVLPVLTGECKECAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRNVECTGNINAMIQAFECVHDGWGVAVLVGVPHKDAEFKTHPMNFLNERTLKGTFFGNFKPRTDLPNVVELCMKKELEVEKFITHSVPFAEISKAFDLMAKGEGIRCIIRIEN

SEQ ID NO: 84798 - protein, 596 aa, Oryza sativa Japonica Group
MAAPGPGWVVPPPPQPQPQQQQQAVVVDGRDGLVAWLRGEFAAANAIIDLLLAHARDAADPAGFDAVAAAVQRRRHHWAPVLHLQHYFPVTEVALALHHAAARQGPPPPPPPPRPPSGSAGAEGDDAAIASGGVKEVETSAEATQNSQLVSHISHATEAQPQKGLHVISNVVPVPTCFVVNEVIDGRMVNVLEGLKLYKGYVDLTEIGKVLSFVNEAKTMRRKPGLEAGQTVVVAKRPMKGHGREIIQLGLPITEGPPEDEHLREVKVDPIPGVLQNLFDSLVHQKVVPSSPDYCVIDIFNEGDYSHPHHHPPWYGRPICTLCLTDCDMVFGHVIAADSRGDHAGPLKLSLSTGSVLVFEGKSADIAKRALPATSKQRILLSFGKSVSRKHVQSESSLLITPPLTPPPMPWAAPLRPGNIAIHPSSPKQLVYNPSNRVPAVSTPGLHHIPSNGIQTVFVAPLPITPKAVPFASAVTLPNSTAAWIAEAAPRPASPRLPLQGTGVFLPPGSGNPPPAQKLGVKHADAKPFFPQESSASSSGVSARAHKANGSVSSKPTRKDDMAEAKPKCNGSSDGGSSVAHAKATGGLEEQNVVAK

SEQ ID NO: 84799 - protein, 305 aa, Miscanthus sinensis f. glaber
IESVGEDVTDVAPGDHVLPVFTGECKERAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSILFAEISKAFDLMAKGEGIRCIIRMEN

SEQ ID NO: 84800 - protein, 313 aa, Clostridium difficile 630
MSKMATREAYGKALVKLGQINDNVVVLDADLSKSTKTHDFYKSFPDRFFNMGIAEQNLIGAACGLSTAGKIPFASTFAMFATGRAFEIIRNSVCYPKLNVKICATHAGLTVGEDGASHESVEDIAIMRAIPNMTVLVPADGVETEKIIFEIAKYNGPVYVRLGRSSVPVLFDEDYKFEIGKGTVLREGKDVSIIACGIMVNEALLAQEKLQEEGISARVINMSSIKPIDKDLILESAKETNAIVTVEEHSIIGGLGSAVSEVVGESCPTIVKKVGIKDTFGESGTPNELLKKYELTCDDIIKTVKEAIIAKRM

SEQ ID NO: 84801 - protein, 437 aa, Oceanicola granulosus HTCC2516
MPIDQIDLVRERLGDLRVRHLLGRVSGVASAALEVTGFGAGVRVGDPVTLPSLDGRRGEVIGLDDGTARVLLEGGTEGISLRTPVRLEPPVRFAPGPHWLGRVIDPDGRPLDGRPLLPGTGRRPRAAPPPRPHRRRPLGARLSTGFAVFDTLLPLVRGQRLGLFAGSGVGKSTLLGDLARGVEADVVVIGLVGERGRELRTFVDEVLGAEGMARAIVVTATSDTAPQVRRRCAPAAMAVAQHFRDTGHHVLLLLDSVTRFAEAHRELAAAQGEPASLRGFPASTAGAIAALCERAGPGEDAGDITAVFSVLVAGSDMEEPVADMLRGVLDGHVILDRKVAERNRFPAIDLLRSVSRALPAAASDVENSLISRARALLGSYDRAEMMIQSGLYASGSDARIDEAIACHDALDGFLAQRSASVSESFAALRRALNSGAR

SEQ ID NO: 84802 - protein, 369 aa, Oryza sativa Japonica Group
MIQSNVYKYLSTLLEWRECFEDEALEEEKELGMSNHKGDGEPKAVQSTSSLYSLNQRLMHFANWLLEIVALGNLDAFFPAATREYAPIVEEVWKDPAIQATYKRKNELHFLPDVASYFLDRVVEISSNEYEPTETDILYAEGVNQWNGLSTLEFSLDDRGPLSDSYADKAGNPAIQTKYQLIRMNSKGLTGGFKCLGMLEDIRAIIFCISLADYDQTWVQSSGEPCNKMIASRDLFEDVIRHPSFEDTPCVLLLNKYDAFEEKISRVPLTVCEWFADFSPVRPHHTSQTSLASHAYYYVAVKFKDLYSSVADGRKLFVFQTKALERRTVDDAFRYIREVLRWDDVKNSDAGYCSADESSYSVDMTTSPS

SEQ ID NO: 84803 - protein, 305 aa, Miscanthus sinensis var. sinensis
IESVGEGVTDVAPGDHVLPVFTGECKECPHCKSAESNMCDLLRINTDRGVMIGDGKSRFSINGKPICHFVGTSTFSEYTVMHVGCVAKINPQAPLDKVCVLSCGISTGLGASINVAKPPKGSTVAIFSLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 84804 - protein, 497 aa, Banksia attenuata
MRINPTTSGPGVSALEEKNLGRVAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLK

SEQ ID NO: 84805 - protein, 311 aa, Oryza sativa Japonica Group
MHFANWLLEIVALGNLDAFFPAATREYAPIVEEVWKDPAIQATYKRKNELHFLPDVASYFLDRVVEISSNEYEPTETDILYAEGVNQWNGLSTLEFSLDDRGPLSDSYADKAGNPAIQTKYQLIRMNSKGLTGGFKCLGMLEDIRAIIFCISLADYDQTWVQSSGEPCNKMIASRDLFEDVIRHPSFEDTPCVLLLNKYDAFEEKISRVPLTVCEWFADFSPVRPHHTSQTSLASHAYYYVAVKFKDLYSSVADGRKLFVFQTKALERRTVDDAFRYIREVLRWDDVKNSDAGYCSADESSYSVDMTTSPS

SEQ ID NO: 84806 - protein, 231 aa, Burkholderia xenovorans LB400
MTQDELKQLVGQAAADYVNANVPEGSVIGVGTGSTANCFIDALAAGKTRYRGAVSSSLATTARLQSHGFKVLDLNEIDSLPVYVDGADEIDHSGAMIKGGGGALTREKIVASVSDVFVCIADASKLVETLGSFPLPIEVVPMARTSIGRRVTALGGVPVVRVTKEGVPFITDNGNEIIDVKGLRISDPRTLETHVNAWPGVVTVGLFASRGADLCLLGTDTGVDTIRFSKG

SEQ ID NO: 84807 - protein, 843 aa, Oryza sativa Japonica Group
MLLVGVLLLLFFNLHLPTAAIDTLTLGQSLLWNQTLVSNGGNFELGLFSPGKSNKHYLGIWYKKISKKTVVWVANRERPILEPSSCHLELSVHGDLRLFSTAPSNTLLWSSNASASSSPSPPRTTVATLQDDGNLVVNSNATRSRSRSPSSTTTTHVAWQSFDHPTDTWLPGARLGYDRGRGVHSFLTSWTDSENPAPGAFSMVIDARGLAKFDLLAGGEHRYWTTGLWDGEIFANVPEMRSGYFTGVPYAPNASVNFFSYRDRLPGAVGNFMLDVNGQMRRRQWSETAGKWILFCSLPHDACDVYGSCGPFGVCSNATNPECRCPAGFEPRSSEEWRLENAAGGCVRRHPLECHGDGFLALPYTVRLPNGSVEAPAGAGNDKACAHTCLVDCSCTAYVHDGAKCLVWNGELVNMKAYAANENGQGDPGLAGAVLHLRVAHSEVPASSTEHSWKKSMVILGSVVAAVVLLLASLVTVVAVAAVLRMRRRRGKVTAVQGSLLLLDYHAVKTATRDFSEKLGSGSFGTVFKGALPDGTPVAVKKLDGLRQGEKQFRTEVVTLGMIQHVNLVRLRGFCCEGNKRALVYDYMANGSLDSHLFVMSGSSSGPDSKQVTLTWSQRYNVAVGVARGLAYLHEKCRECIIHCDVKPENILLDQEMAARLADFGMAKLVGRDFSSVLTTMRGTVGYLAPEWLAGTPVTAKADVYSFGLLLFELVSGRRNSTAPSSSSEGGPGIYFPVHAVVKLNEGDVAGLVDERVAKDADPKEVERLCKVAGWCIQDEEGDRPTMGLVVQQLEGIANVMLPPIPSRLHILAIENEWVRGVPEDERCSKSGSKPETEAIEEM

SEQ ID NO: 84808 - protein, 364 aa, Acidobacteria bacterium Ellin345
MKLKIAVLGGDGVGPEVTAEAVRVLRAIANVNGYEFQFTEAEVGGVAIRKHGSPLPEKTLHTCLESDAVLLGAVGHPEFDSMPRDKKPETGLLALRQALGGFANLRPVQAYAALSDSSPIKQELVFGADVMIVRELLGGLYFGEPRGIKDDTATNTMSYSRYEIERVAHIAFQQARNRRKKVTSVDKANVLECSQLWRLVVTEVAKQYSDVKLEHAYVDSFAMRLIQAPTAFDVVLTENLFGDILSDEAAVIGGSLGLLASATIGGEVDLYEPVHGSAPDIAGKGIANPVGAINSVAMLLRHTAKLEQDARLIESAVNAVLLDGYRTKDLVPSARKFNTTAEVGSAIERQCADMAISHYAYHAV

SEQ ID NO: 84809 - protein, 589 aa, Aspergillus oryzae
MEKDEIEAKAEPRGAAFESPPPLYGDSEPTQAGLGRRIWDSFKRDPNAHVTGGHGSSGADGKSFDIENAAQKTASSPLQRSLKGRHLQMIAIGGSIGTGLFVGSGKVLATGGPASVLIAYALIGCMLYCTVHALGEMAVLFPVAGSFAHYSTRFIDPAWGFAMGWNYALQWLVVLPLEIVAASITVDYWQSDISNAAWVAIFWVLIVSINLFGVRGYGEAEFVFSLIKVVAVIGFIILGIVLNCGGGPQGGYIGGKYWSDPGAFHNGFKGLCSVFVNAAFAFAGTELVGLAAAETANPRKSLPTAVKQVFWRICLFYIVSLTLVGLLVPWNDERLLDGSSSADAKASPFVIAIKNAGISVLDSIMNVVIMIAVLSVGNSSVYGSSRTLAALAEQGQAPKFLSYIDRKGRPLWAILIASALGLLSFLAASDKQEVAFEWMMAISGLSSIFTWGSVCLAHIRFRRGWKAQGHSLNELAFQSQPGVIGSWIGFLFNCLVLVAQFWVGFAPIGYATKTAGELVEAWFSVYLAAPVVLLFYIPYKLWFKTPFIRAKDMDLQTGRRDLDLQYLIEQERAEQAEWPAWKKVYKFFC

SEQ ID NO: 84810 - protein, 206 aa, Larix x marschlinsii
LDLKKHMDSCPELAKDPRLIKTFLYQILRGIAYCHSHRVLHRDLKPQNLLIDRKTNALKLADFGLARAFGIPVRTFTHEVVTLWYRAPEILLGSRHYSTPVDVWSVGCIFAEMVNQRPLFPGDSEIDELFKIFRVLGTPNEETWPGVTSLPDFKSAFPKWPAKDLATVVPGLEPAGIDLLSKMLCLEPSKRITARSALEHEYFKDL

SEQ ID NO: 84811 - protein, 194 aa, Shigella dysenteriae
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGV

SEQ ID NO: 84812 - protein, 485 aa, Banksia media
MRINPTTSGPGVSALEEKNLGRVAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATA

SEQ ID NO: 84813 - protein, 393 aa, Listeria monocytogenes str. 4b F2365
MDLPLSKRVKGVAPSPTLAITAKAKQMKQEGIDVIGLGAGEPDFNTPQNIIDAAIESMNKGFTKYTPSSGIIELKQAIVDKLQKDQFLNYETNQIFVGTGAKHVLYSAFQTILDPGDEVIIPVPYWVTYPEQVKLAGGIPVFVETGFDADFKISAANFEKAITKKTKAIVLNSPNNPSGMCYTKEELIAIGEVAEKHQIYILSDEIYEKLYYGNKADLVSIASLSDRLYDLTIVINGVSKAYSMTGWRIGYAAANKEIIAGMSKLADHLTSNPTANAQYAALEAYVGSQEVPEKMYKAFEERMERFYPELSSIPGFKPKKPDGAFYFFIEVKEAAHKKGFQDVDAFVAALLEEAKVAVIPGSGFGMPDYIRLSYATNPDLFQEAINRIKSFMK

SEQ ID NO: 84814 - protein, 497 aa, Banksia benthamiana
MRINPTTSGPGVSALEEKSLGRVAQIIGPVLDVAFPPGKMPNIYNALVVKGRDTVGQQINVTCEVQQLLGNNRVRAVAMSATDGLMRGMEVINTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLK

SEQ ID NO: 84815 - protein, 198 aa, Shigella dysenteriae
KARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVG

SEQ ID NO: 84816 - protein, 685 aa, Oryza sativa Indica Group
MAWHFTAAFMIATCLMLFPRSEQSSQGYLPLHVVILVSLGLWGPLPDKIHRLSSLQVLDLSSNFLYGSIPPKLSAMPKLRTLTLDGNFFNGTVPDWFNLYSNLTVLRLQRNRLKGPIPASIGKATMLSELALAGNSIAGEVPQLGSLNKLEMLDLRDNELDGELPELPTALVTILLSKNSLKGEIPEQFGQLNRLQHLDLSFNFLVGKPPEKLFALPSISYLNLAANMLSGSFSTSLTCSSTLGFVDLSTNQLTGDLPVCLNVNVNNRVVKFDGNCFSDDPEHQHETKYCQQPHKGRGSNKDVGLVVTVVGVVFIVLVLSLILMASNRRSCQRVLAEQQLLQKQMQDNSTSGMSTELLVNARYISQAVKLGTQIMPMYRAFSLEELKEATKSFERSAFLGEGSIGKLYKGKLENGTLIAIRCLALHQRYSIRNLKLRLDLLAKLRHPNLVCLLGHCIDGEVDESSVKRVFLVYEYVPSGTFPSYLSGSSPEKTLNWCERLQVLMNIAKAVHFLHTGIIPGSLYNRLKPSSILLDEHLVAKLSDYGLSIITEEIYKHEAAGEGQRCVEDNGGELENLEEDVLSFGGILLEVLMGPKRHRKDLSVLSELVLSISKQEEREQVLDPIVLSTSSQDSLSMVISITVKCLSVESSARPSIEEVLWNLQYAAQVQAISDGDQRSEVSSQTC

SEQ ID NO: 84817 - protein, 135 aa, Streptomyces avermitilis MA-4680
MSYDIEKPDEAWRAELTPAEYAVLRKAGTEPAFTGEYTDTRTKGVYSCRACGAELFTSNEKFESHCGWPSFYDPKNTDAVELIDDRSHGMVRTEVRCARCGSHLGHVFEGEGYATPTDQRYCINSISLRLAPDEG

SEQ ID NO: 84818 - protein, 422 aa, Acidobacteria bacterium Ellin345
MTTAEQFDKELNPWEQQAARFDTATTKLKLDEGLISVLRVPAREVTVNIPVSMDTGKIRMFTGYRVQHSFARGPAKGGVRFSPEVSLDEVRALAAWMTWKCAVVNIPFGGAKGGIICDPKTMSMGELERMTRRYTAELMEFIGPEKDVPAPDVNTNEQTMAWMMDTYSMHMRMTVNAVVTGKPLNMGGSRGRREATGRGVMITADQCLKKFNMSRESTRVIVQGFGNVGSNAAQLMHQAGYKVIGIGEWDGGLHNVNGIDINALVDYKAHNGSIHGFPGAEKAATADLMIADCDVLIPAATENVITTKNAEKVKARIIVEGANGPTTSGADEILNDKKVFVMPDILANAGGVTVSYFEWVQDRQGYFWKESVVNEQLEHIMVSSFEDVVNMSEQHNVPNRIGAYMLAIDRVAYTIRQRGIYA

SEQ ID NO: 84819 - protein, 198 aa, Shigella dysenteriae
ARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGF

SEQ ID NO: 84820 - protein, 328 aa, Myxococcus xanthus DK 1622
MGTLASSLVETLRASRGRRGPLLGDARTTAWRVVNAEADGVPDVTADVFGDVYVISLYRDFTPDEEETLLDAAVAAWAPRSLYLKRRPREARVLANVAKESLAPEAPARGEAVESFTALENGLTFLIRPAQGLSVGLYLDMRDTRAWLLSQARGLTVLNLFSYTCAFGVVAMAGGAKRALNLDASRRVLEWGEENARLNGQTVDRYDYVAGDVFDWLKRLAKKGESFDIVISDPPSFSTTRSGRFSAARDYARLAEAAARVVSPGGQLVACCNHAGLAARRFEAMVLEGVSQAGRQGKSLGSLAPSALDFPPPPGQEPALKVHRVQVR

SEQ ID NO: 84821 - protein, 375 aa, Coccidioides immitis RS
MGEVDAKNCIGLDCRNPAGSLRCPTCLKIGIESYFCSQDCFKRSWAEHKAIHKSKSTYDPFPTYPYTGKLRPVYPLSPQNKVPPNVVQPDYAIDGIPRSEQKLFGRNNIRILTEKEQDGMRKVCRMGREVLDIAAREIKVGVTTDHIDKVVYQACMERKAYPSPLNYMNFPKSVCTSVNEVICHGIPDQRPLEDGDIINIDISIYHGGFHADLNETYYVGDKSLADPDTVRVVETARECLDKAIEIVKPGMLFREPGNVIEKHAKSRDCSVVRTYCGHGVNQLFHTAPSIPHYAKSKTVGSAKPGMCFTIEPMINLGSYRDKTWPDNWTSVTIDGKKSAQFEHTLLVTETGVEILTARQSDSPGGPVSMPSISGD

SEQ ID NO: 84822 - protein, 239 aa, Zea mays
MEEELTLVGYWSSPFALRARFALNLKGLPYAYVEEVGLFDGKSPLLLASNPVHKRVPVLIHNGKPVPESQLIVQYVEEAFPASSPRFLPPDPHERAVARFWASYVDGELLSAWLPVYGGRTGEERAEAAGRVGAALETLERAFGECSKGKGFFGGDTVGLVDVVLGGFVGWLQTSEAMCGVRLLDAAATPLLAAWAERFRALDGVKEVMPDAQRLLEYNLMRRARLGLPLTQPPPPQHQ

SEQ ID NO: 84823 - protein, 582 aa, Caulobacter crescentus CB15
MTGAEIVVRGLVDQGVEVLFGYPGGAVLPIYDALFHEPRLQHILVRHEQGAAHAAEGYARSSGKPGVVLVTSGPGATNAITGIMDALMDSIPMVVITGQVPTHLIGTDAFQEADTVGMTRSCTKHNYLVKDVRDLPQIIHEAFKIATTGRPGPVLIDIPKDVQFAKGEYFGPGEVASTHAYAPRTKGDAGRIAEAARMIAQARRPIFYTGGGVINAGPKASAALREFAALTGAPVTSTLMGLGAFPAADPAWLGMLGMHGTFEANNAMHDCDVMICVGARFDDRVTGRLDAFSPGSKKIHIDIDPSSINKNVRVDLPIVGDAGSVLEDLIAAWKAANLQPNKAALTDWWAQIDQWRARQCLSYRRSDSVIKPQYAIERLYELTKDKDVYITTEVGQHQMWAAQFFRFEEPNRWMTSGGLGTMGYGLPAALGVQLAHPNSLVVDIAGEASIQMCIQELSTAIQFDLPVKIFILNNEWMGMVRQWQQLLHGERYSHSYSDSLPDFVKLAEAYGAVGIRCDNPAELDAKILEMVNSDKPVIFDCRVEKHENCLPMIPSGKAHNEMIMGEVEDIGNVIGEDGAGLV

SEQ ID NO: 84824 - protein, 641 aa, Photorhabdus luminescens subsp. laumondii TTO1
MIVFSSLQIRRGTRVLLDNASATINPGQKVGLVGKNGCGKSTLLALLKNELQAETGTFTFPSNWALSWVNQETPALEIPALEYVIDGDREFRQLEQQLRIANEKNEGNLIAHLHGQLDTIQAWTIRSRASSLLHGLGFSQEQLDQPVRAFSGGWRMRLNLAQALLCRSDLLLLDEPTNHLDLDAVIWLEKWLKSYPGTLILISHDRDFLDPIADKILHIEQQSLFEYSGNYSSFERQRATKLAQQQALYKSQQEKVAHLQSYIDRFRAKASKAKQAQSRIKMLERMELIAPAHVDNPFHFSFRKPESLPNPLLKMEKVSAGYGERTVLNSIKLNLVPGSRIGLLGRNGAGKSTLIKLLAGELQSQSGTVELAKGIKLGYFAQHQLEYLRADESPLQHLVRIAQQETEQQLRDYLGGFGFKGDQVTDPSGRFSGGEKARLVLALMVWQRPNLLLLDEPTNHLDLDMRQALTEALIDFDGALVVVSHDRHLLRSTTDELYLVHDGRVESFNGDLEDYQQWLIDQQRQQNQQIRENNDKEKETSSQSAQERKDQKRRQADFRNQTQPLRKQLANFEKQMEKLGGELVALENQLLDSAIYDSSRKVELTEYLQKQNQTKLKLEEIELAWMEIQEQLEKITQEFEG

SEQ ID NO: 84825 - protein, 351 aa, Arabidopsis thaliana
MATPMENENPNFARTATSFRNFVSKDPDSQFPAESGRYHLYISYACPWASRCLAILKLKGLDKAISFSSVQPLWRNTKENDEHMGWVFPDSDTEVLGAERDHINGAKSVRELYDIASSNYTGKYTVPVLWDKKLKTIVNNESSEILRMFNTEFNHVAENPSLDLYPPNLRAIIDETNEWIHDGINNGVYKCGFATNQETYDVEVKRLYEALDRCEDILRKQRFLCGNTLTESDIRLFVTVIRFDEAYAVIFKCDKRLVREYYHLFNYTKDIYQIAGMSSTVKMDHIKQNYYGSFPSINPLEIIAHGPNIDYSLPHDRHRFSLESDYTRLELFESASFVCELKLIEIFDSLG

SEQ ID NO: 84826 - protein, 305 aa, Miscanthus sinensis var. sinensis
IESVGEGVTGVAPGDHVLPVFTGECKECPHCKSAESNMCDLLRINTDRGVMIGDGKSRFSINGKPIYHFVGTSTFSEYTVMHVGRVAKINPQAPLDKVCVLSCGISTGLGASINAAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 84827 - protein, 229 aa, Dechloromonas aromatica RCB
MSAIADNLQAVHSRIALAAAAAGRSPDTVRLLAVSKTWPLSCVLDAADAGQRAFGENYVQEGIDKIAAISGRNLEWHFIGPLQSNKSRPVAERFDWVHSIERLKIAERLSAQRPAYLPPLQVCIQVNVSGEASKSGCAPDEAPALCKSIAALPGLRLRGLMAIPEPTDDLDAQRLPFRQLREIYEHIRASGLPLDTLSMGMSHDLEAAIAEGATIVRIGTAIFGERNYA

SEQ ID NO: 84828 - protein, 388 aa, Arabidopsis thaliana
MTTISDLPYDLVKEIFSWVPFTSLRAVRSTCKTWNALSKNQIFGKKSVARNQFLELMILDSRVCSLRFDLQKIRNEDEEDLVDPSMKQISIPNNDDQVEISRVYHCDGLLLCIPKDNSSLMLWNPYLGQTKRIRPKNTFHRDDSFALGYNNRNHKILRLNEENESHIDVYDFSSDSWRTVPDDNPYRDELIYQSGVSLKGNAYFFDREVTTEAEVGTEDLLITGIEDYLRCFDFTTERFGPRLPLPFILPSPSFEYLALSWARDDKLAVLYSHYDTFDIIEIWISTKIEPNAVSWSSFLTVDMSLVNGLPDHFSMYFEAKSFFIDEEKKVVVLFDSKEIKTCRYQMAYIVGDDGYFKSVNIGVSPNSQRKPGRLVCSSYVPSLVQLQD

SEQ ID NO: 84829 - protein, 274 aa, Thermobifida fusca YX
MLRKGRNRIELKSPAEIEKMRAAGRVVARTLDLLREAVRPGISTLELDALAEQSIREAGAIPSFKGYHGFPGSICASVNEEVVHGIPRATKVLADGDIISIDCGAILDGWHGDSAITVPVGTVTEEDRTVMEVCEEAMWQGIAQMRPGNRLGDIGHAIESYIASRGNFGNVREYGGHGIGTQMHMEPHVLNYSPPGRGMRLVEGMCLAIEPMVNRGTRHVHLLEDGWTVVTRDGSRSAHFEHSVAITADGPLVLTAREENREKIASLGFPDPGF

SEQ ID NO: 84830 - protein, 270 aa, Dechloromonas aromatica RCB
MKIVFLGGGNMANALIGGMVKQGFSAADIHVIDPGAEALAKLASAYGVNCHASADAAPASPDVLILAVKPQQMKDAVAPLVGKLGKALIISIAAGLDMTALSRWLGGHRQIVRCMPNTPALIGAGITGLCALPEVSTDQRAVADRVLRAVGTTVWIDDEAKIDGVTAISGSGPAYVFLFIEALQQAAADLGFTPEQGRQLAIETVQGAAALAAQSTEPASILRERVTSKGGTTAAALNVMAERGVKEGIVAGCMAAAARGQELGKILGAD

SEQ ID NO: 84831 - protein, 305 aa, Miscanthus sinensis var. sinensis
IESVGEGVTDVAPGDHVLPVFTGECKECPHCKSAESNMCDLLRINTDRGVMIGDGKSRFSINGKPICHFVGTSTFSEYTVMHVGCVAKINPQAPLDKVCVLSCGISTGLGASINVAKPPKGSTVAIFSLGAVGLAAAEGARIAGASRIIGVDLNPSRFEEARKFGCTEFLNPKDHKKPVQEVLAEMTNGGVDRSVECTGNIYAMIQAFECVYDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 84832 - protein, 521 aa, Azoarcus sp. EbN1
MAHQKILILDFGSQVTQLIARRVREQQVYCEIHPFDVSDDFVREFAPAGVILSGGPNSVYEAVGWHAPQSVFELGVPVLGICYGMQTMAQQLGGSVESSGKREFGYAEIRARGHSELFRSIEDRTNDEGHGLLDVWMSHGDKVTALPPGFKVIASNESCPVAGMADEVRKFYAVQFHPEVTHTIKGRDMLARFVHEICGCGRDWNMPDYVNEAIEKVRAQVGQEEVILGLSGGVDSSVVAALLHRAIGEQLTCVFVDNGLLRLNEAEQVMLTFARNLGVKVIHVDATEQFMGHLKGVSDPEAKRKIIGREFVEVFQAEANKLPNAKWLAQGTIYPDVIESAGSKTGKAHTIKSHHNVGGLPETLNLKLLEPLRELFKDEVRELGIALGLPHEMVYRHPFPGPGLGVRILGEVKQEFAELLRRADAIFIDELRAADWYDKTSQAFAVFLPVKSVGVMGDGRTYEYVVALRAVETQDFMTAHWAELPHSLLGKVSNRIINEVRGINRVVYDISGKPPATIEWE

SEQ ID NO: 84833 - protein, 404 aa, Haemophilus somnus 129PT
MRVFPKSDKLEHVCYDIRGPVHQEALRLEEEGKKILKLNIGNPAPFGFEAPDEILVDILRNLPAAQGYCDSKGLYSARKAIVQYYQSKNILSATVNDVYIGNGVSELITMSLQALLNDGDEVLIPMPDYPLWTAAATLAGGKAVHYLCDEQADWFPDVADIKSKVTSRTKAIVIINPNNPTGAVYSKELLLDIVEVARQNGLMIFADEIYDKILYDNAVHHHIAALAPDLLTVTFNGLSKSYRVAGFRQGWMILNGPKHQAKGYIEGLDMLASMRLCANHPMQHAIQTALGGYQSINEFILPGGRLLEQRNKAYELINQIPGLSCTKPMGALYMFPKIDTKKFNIYDDEKMVLDLLRQEKVLLVHGRGFNWQQPDHFRIVTLPYVNQIEDALGRLARFLEYYRQ

SEQ ID NO: 84834 - protein, 489 aa, Oryza sativa Indica Group
MKLERYASSAGAMLLLRRAASGKVVSASSHLLFRATVLATMALVFLFTFHYPSLLSRSFTLSSGAGAGEGGAAAHASHRSLLMSSSSASASAASVYGGAAWEKEVRRSAKPRKDGGIAVLVTGAAGFVGTHCSLALRARGDGVLGLDNFNAYYDPELKRARQRLLAGRGVLVLDADINDALLLEKLFDLVPFTHVLHLAAQAGVRYAMEAPQTYVASNVAGLVTVLEVAAKHADPQPAIVWASSSSVYGLNTDAPFSEEHRTDRPASLYAATKKAGEAIAHTYNHIYGLSITGLRFFTVYGPWGRPDMAYFFFAKSIVSGEPITLFRAADGADARRDFTYIDDVVKGCLGALDTSGKSTGSSKSGKKSGPAPLRVYNLGNTSPVPVTRMVAILEKLLGKKANKRIVAMPSNGDVPFTHANVTHAAHDFGYRPTTSLDAGLRHFVDWFADYYKLKLDVPKIAAKVAGAGKPSSSSASKKKKKAAAMSASS

SEQ ID NO: 84835 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPLKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 84836 - protein, 309 aa, Oryza sativa Indica Group
MAANFWTSSHCEGSKQLLDQEDVDKVPQADSDRGITPEEFRLVKIHMSFLLQIKANHLMISDIWRLAQQVKVRQRVIATAVTYFRRVYTRWPYFPIKLINALRIMWNIKLLEFCSDAGYVYRKSMTEYDPRLVAPTCLYLASKVEESTVQARLLVFYIKKMCASDEKYRFEIKDILEMGMKLLEALDYYLVVYHPYRPLLQCFDFRLLQDAGITDLTQFAWGIVNDTYKMDLILIHPPYMIALACIYIASVLKDKDITLWFEELRVDMNIVKNISMEILDFYDTYKIDPQRGLPEDKIAPVMNKLPSKA

SEQ ID NO: 84837 - protein, 464 aa, Clostridium difficile 630
MANVGKVVQIVGAVLDVKFDSEQSLPNLLNALVIKLGDKEIVAEVAQHIGDDTVRCIAMSATDGLVRGMEVVDTGGPISVPVGDETLGRIFNVLGKPVDGKPAPKSAPKLPIHRPAPAYDELETTAEILETGIKVVDLLAPYLKGGKIGLFGGAGVGKTVLIQELINNIAKQHGGISVFSGVGERTREGNDLYGEMSESGVINKTALVFGQMNEPPGARMRVALTGLTMAEHFRDEQGQDVLLFVDNIFRFTQAGSEVSALLGRMPSAVGYQPTLATEMGALQERITSTKKGSITSVQAVYVPADDLTDPAPATTFSHLDAKTVLSRQISSLGIYPAVDPLESTSRILDPSIVGKEHYEVARGVQSILQRYKELQDIIAILGMDELSDEDKLIVARARKIQRFLSQSFTVAEQFTGNPGQYVPVKETVRGFKEILEGKHDDLPESAFLFVGTIEDAVRKAKGSM

SEQ ID NO: 84838 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPLKGSTVAIFGLGAVGLAAAEGARIAGASRIIGVDLNPSRFEEARKFGCTEFANPKDHKKPVQEVLAEMTNGGVDRSVECTGNINAMIQAFECVHDGWGVAVLVGVPHKDAEFKTHPMNFLNERTLKGTFFGNFKPHTDLPNVVELYMKKELEVEKFITHSIPFAEINKAFDLMAKGEGIRCIIRMEN

SEQ ID NO: 84839 - protein, 252 aa, Oceanicola granulosus HTCC2516
MPMTHDRDQTTHFGYETVLEDQKAGRVRGVFSSVASRYDVMNDVMSGGVHRLWKDAMMDWLAPRPGQRLLDVAGGTGDIAFRFLRRARSGHATVCDLTEPMLVEGRKRADAARMADQLDWVVGDAMSLPFPDASFDVYTISFGIRNVTRPAEALAEAYRVLRPGGRLMVLEFSRVPTPSLRHLYDLYSFNVIPRLGQVIANDRDSYQYLVESIRRFPDQETFLSMVRDTGFGNAKYRNLTMGVACLHSGWKL

SEQ ID NO: 84840 - protein, 175 aa, Zea mays
SGHIEVDEYQNTSVDGVYALGDVTGHAELTPVAIAAGRQLGNRLFGPDEVRDSKLSYDNIPTVVFSHPEVGTVGLTEPEARERYGDDQIKIYHTRFTAMYYDVMPAEEKKKNPTEFKLVCAGPEEKVVGLHILGLGVGEMLQGFGVAVKMGATKKDFDSCVAIHPTSAEELVTLR

SEQ ID NO: 84841 - protein, 362 aa, Zea mays
  misc_feature (191)..(191): Xaa can be any naturally occurring amino acid
MESDASTSPRRRSTSCYSDSGDSSCSEPFSECGSDDLSFTPAAAAGIHRLLLSCASEASEDAISSLVAELERPSPSLDSLRRAAMELRLLAKHNPDNRVRIAAAGGVRPLVRLLAHADPLLQEHGVTALLNLSLCDENKAAIIEAGAIRPLVRALKSAASPAARENAACALLRLSQLDGASAAAIGRAGAXPLLVSLLETGGARGKKDAATALYALCSGARENRQRAVEAGAVRPLLDLMADPESGMVDKAAYVLHSLLGSGDGRAAAVEEGGIPVLVEMVEVGTSRQKEIATLCLLQICEDNAVYRTMVAREGAIPPLVALSQSSSARTKLKTKAESLVEMLRQPRSPSLRARPAAVVAAE

SEQ ID NO: 84842 - protein, 305 aa, Miscanthus sinensis var. sinensis
IESVGEGVTDVAPGDHVLPVFTGECKECAHCRSAESNMCDLRRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLDPSRFEIARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 84843 - protein, 497 aa, Banksia grandis
MRINPTTSSPGVSALEEKNLGRIAQIIGPVLDVAFPPGKLPNIYNALVVKGRDTVGQQINVTCEVQQLLGNNRVRTVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLK

SEQ ID NO: 84844 - protein, 523 aa, Azoarcus sp. EbN1
MKNLVLDNRFVHELPGDPNPSPDVRQVHGACYSRVMPTPVSAPHLIAWSPEVAALLGFDESDVRSPEFAAVFAGNALMPGMEPYAACYGGHQFGNWAGQLGDGRAITLGEAVTTRGDGHTGRWELQLKGAGPTPYSRHADGRAVLRSSIREFLCSEAMHHLGVPTTRALCLVGTGEKVVRDMFYDGRPKAEPGAVVCRVAPSFIRFGNFEIFTSRGDEALLTRLVDFTIARDFPELGGEPATRRAEWFCKVCERTARMIAQWMRVGFVHGVMNTDNMSILGLTIDYGPYGWIDNFDPGWTPNTTDAGGKRYRFGNQPHIAHWNLLQLANALYPVFGAAEPLHEGLDLYARVFDEENRRMLAAKLGFEAFGDEDATLVETLHALLTRAEVDMTIFFRGLASLDLEAPSIDPLRDAFYSAEKAAVAEPEMNSWLAAYTKRTKQERTPGDQRRVRMNAVNPRFVLRNYLAQEAIDAAEQGEYALVSELLDVMRHPYDEQPGRERFAARRPDWARNRAGCSMLSCSS

SEQ ID NO: 84845 - protein, 494 aa, Banksia oblongifolia
MRINPTTSGPGVSALEEKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVES

SEQ ID NO: 84846 - protein, 198 aa, Shigella dysenteriae
ARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGF

SEQ ID NO: 84847 - protein, 497 aa, Banksia ericifolia
MRINPTTSGPGVSALEEKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLK

SEQ ID NO: 84848 - protein, 204 aa, Shigella dysenteriae
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGFSF

SEQ ID NO: 84849 - protein, 220 aa, Aspergillus oryzae
MSETATTTAASAASKSKPERLPITVSKPTPYTFDLGHLLANDPNPLEISRSEPVNVSLKATARDGVQSLLNQLLTTCPITSSQQGVLLTLPAPTTVLPRHKPLPTPKPPTKWELFARKKGIGRFSGKAGAGLAEKERRKKLVYDEEKGEWVPRWGYKGKNKSDEDWLVEVNEKDWKKEEEAAAKGSSIRGMSRAERKERIRRNERKMRNNERKSRKSGGG

SEQ ID NO: 84850 - protein, 185 aa, Caulobacter crescentus CB15
MTANVQPAPASAYDLSPKDQAEQSATFALLVDNEPGVLHRVVGLFAARGYNIESLTVAETDRKAHTSRITVVTRGTRHVLDQIEAQLNKVVNVRRVHDVTRDPNGVERELALVKVRGSGVDRLEALRIAEIFRAKPVDTTLESFVFEISGAPSKIDKFLDLMRPLGLVELSRTGVLSIERGFEGM

SEQ ID NO: 84851 - protein, 193 aa, Shigella dysenteriae
MIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGF

SEQ ID NO: 84852 - protein, 326 aa, unidentified eubacterium SCB49
MDYVENILGTIGNTPMVKVNKLAEEIPGLVLAKYETFNPGNSVKDRMALTMIEDAEADGRLKPGGTIIEGTSGNTGMGLALAAVVKGYKMVCVISDKQSKEKVDILRAVGSEVVVCPTDVAPDDPRSYYSTSKRLAEETPNSWYVNQYDNPSNAKAHYQSTGPEIWKQTEGKITHFVVGVGTGGTISGVGKYLKEQNPNIKIWGIDTYGSVFKKYHETGIFDEAEIYPYVTEGIGEDILPKNVDFSIIDGFTKVTDKDAAVWTQKLAKDEGFFLGNSAGAAMKGIHQLKEHFNEDDVIVVLFHDHGSRYVGKMFNDDWMREMKYIE

SEQ ID NO: 84853 - protein, 209 aa, Dehalococcoides sp. VS
MKKIYDLSPEICPEMISWPGDGCPEITLLHSIKNGSHSNLSRLTMTLHNGSHIDAPLHFSEDGDGAGEIPLEILIGNVRVLRFSGVKTVTRDMLEQVDLRGVIRLILATDNEALWYKPDFDRNYTYIDIGAARYLTEIGVRLLGIDYLSVEDFEGLAGVHRHLLSHGVFILETLQLAGVPEGDYELYCLPLKLGKVDGAPARVILIERD

SEQ ID NO: 84854 - protein, 200 aa, Shigella dysenteriae
ELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVG

SEQ ID NO: 84855 - protein, 191 aa, Acidobacteria bacterium Ellin345
MVFVLDNYDSFTYNLVQYLGELGAEIEVRRNDQVTVEAVEAMRPDRILVSPGPCTPGEAGISIELIRHFAGKRPVLGVCLGHQAIGEAFGGKVVRAKNLMHGKTSQVEHDGKTIFRDVRSPMTATRYHSLIVRESDLPKELEVSARTNDHDGNSVIMGLRHKKFPVEGVQFHPESVLTSDGKQLIKNFLAL

SEQ ID NO: 84856 - protein, 319 aa, Zea mays
  misc_feature (243)..(243): Xaa can be any naturally occurring amino acid
MGSVASAAAPPSPHSALPQEGAPPYGPGLAGILPQTSVGEEKKEEKVDYLNLLCPVPFEEIQREALMSLKPELFEGLSVFMGSLEVPAQGSETIKVPTAHYEFGANFLDPKLMLIGRVMTDGRLNARVKCDLTDNLMLKVNAQLTQEAHYSQGMFNFDYKGSDYRAQFQIGNNAFYGANYIQSVTPNLSMGTEMFWLGHQRKSGIGFACRYNTDKMVGTLQVASTGIVALSYVQKISEKVSGXLASDFMYNHMSRDVTSSFGYDYLLRQCRLRGKIDSNGVVAAYLEERLNMGVNFLLSAEIDHCKKNYKFGFGMTVGE

SEQ ID NO: 84857 - protein, 220 aa, Dehalococcoides sp. VS
MKDVKVVPAILTDDPAAFEMMIKQSEGFAPSAQIDIMDGQFVPSLSIPPEVLVRYKPRFASEIHLMTINPEEYLIYCKRHGAFRVIFHFEATTRPEYVISRIKELGFQAGLAVNPETPVSDFAYLVPQLDMVLFMSVIPGFYGAPFIPAVLLKVKEFKLRFPETEIGLDGGAKEGNIAEIVAAGVNDICVGSAIFRQTDPKSSYRYLDELAKNAAKEAGI

SEQ ID NO: 84858 - protein, 421 aa, Oceanicola granulosus HTCC2516
MTVKTHTLPNGFRIVTELMPSMKSAALGIWVNAGGRHERADQNGIAHFLEHMAFKGTKRRSALQIAEEIEDVGGYINAYTSREMTAYYARVLEEDVDLGLDLISDILLNPVFDEREIEVERGVILQEIGQSHDTPDDVVFDWLQEVAYPDQPMGRSILGLPERVQGFGRDDLTSFVGEHYGPGQMILAAAGAVDHDHLVRLAEDLFGHLKPVNLTFQTEPARFGGGERRVKKRLEQVHFALALDGPDYRDPEIYTAQVYATALGGGMSSRLFQELRENRGLCYTIFAQAGAYADAGMTTIYAGTAADQIESFAHLTIDEMKRAADDLSDAEIARARAQMKAGMLMGLESPSNRAERLARMISIWGRVPTIDETVERIDAVGRDDVRAFGAKMAGQAGTAMAIYGPIERAPTLQALRERLAA

SEQ ID NO: 84859 - protein, 190 aa, Wolbachia endosymbiont of Drosophila simulans
MVQATYASMSLPGISSVEDVLEDARSGKLFILVDDENRENEGDLIVLAEKIKPEHMAFMVRYGTGVVCLAMTKFHMKRLGLNFMEKKNIGENHTAFTTSIDARYGITTGVSAEDRTKTIHAAINKDGTQDDIITPGHVFPVIAHKGGVAQRAGHTEASVEMAKLVGFDHSAVICELVNDDGSMMRLLSVT

SEQ ID NO: 84860 - protein, 515 aa, Oceanicola granulosus HTCC2516
MARAIFAAFGDAIRGNVAPPTLSGGQVRTEILSGLTVALALVPEAVAFAFVAGVHPLVGLYAAFIVGLITALFGGRPGMISGATGALAVVMVSLVSQHGVEYLFATVVLMGLIQIVVGLLRWGKFIRLVPHPVMLGFVNGLAIVIFLAQLTQFRVPGTAEVSGHGMSGGEWLSGWPLYLMLGLVALTMAIIWATPRITRAIPAPLAGIGIVALIVIVFGLDVPRVGDMASIEGGLPSFHLPQVPLTWETFEIILPYAVILAAIGLIESLLTLNLVGEITGKRGGASRECLAQGAANTVTGVFGGMGGCAMIGQSMINVNSGGRTRLAGTCAAVFLLLFILVGSPIIEQIPLAALVGVMFMVVIGTFAWNSLKILTKVPRADAFVTVLVTIVTVATDLATAVVVGVIVSALTYAWQNATRIRATTETEGDAKVYKVHGPLFFGSSDGFAEMFSPESDPERVIVDFAASRVVDQSALQAIEAVAARYEGAGKRLQLRHLSHDCHRLLAKAGHLVVDS

SEQ ID NO: 84861 - protein, 547 aa, Listeria monocytogenes str. 4b F2365
MTVKPGFDYMNNPLLNKGTAFSKEERASYQLDGLLPPIIETIEQQAVRIETQIENLETPLHKHQLLTNLYNENRTLYYYVVTKNVTDYLPIIYTPTIGDAVIQYHKEYTAPDEALFIDAFAPEKLSASIKNYAKNNPNIDMIVITDGEGVLGIGDWGVNGVKIAVGKLAVYTVAAGLAPDRVLPVVIDAGTNNETLLNDPLYLGNKRPRLSESEYDAFIASFVNVMKEVFPKAILHWEDFGRANASRILHNYRDKICTFNDDIQGTGAMVVAAVLATIQVSKIPLSEQKIIIFGAGTAGIGIADQLSAQWMRETGLPFESAKKHFYLVDRNGLVLDNMTDLTTGQKKYAHPSTEWSNVPTDTLENLMEAVHPTMLIGCSGVTGAFKESIVKKMTQYTERPAILPLSNPTKLAEATASDLIQWTDGKALIVTGSPSKPVEYQHTTYEIGQANNALLYPGLGLGALVTRAKYITDGMLAAASMAVAEQISPNKAGAALLPHVRTLRETSRAVAIAVANQAIKENIHQVELTNVTEAIEREMWQPIYKGV

SEQ ID NO: 84862 - protein, 429 aa, Escherichia coli O157:H7 EDL933
  misc_feature (342)..(342): Xaa can be any naturally occurring amino acid
  misc_feature (382)..(382): Xaa can be any naturally occurring amino acid
MTTDDLAFDQRHIWHPYTSMTSPLPVYPVASAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQHFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKMCDREGILLIADEIATGFGRTGKLFACEHAEIAPDILCLGKALTGGTMTLSATLTTREVAETISNGEAGCFMHGPTFMGNPLACAAANASLAILESGDWQQQVAAIEVXLREQLAPARDAEMVADVRVLGAIGVVETTRPVNMAALQKXFVEQGVWIRPFGKLIYLMPPYIILPQQLQRLTAAVNRAVQDETFFCQ

SEQ ID NO: 84863 - protein, 494 aa, Mycobacterium avium 104
MRGEDMSSSVTPSRPTTGTAQIGVTGLAVMGSNIARNFARHGYTVALHNRSIAKTDALLKEHGDEGEFVRCETIAEFLDALEKPRRVLIMVKAGDPTDAVINELADAMEPGDIIIDGGNALYTDTIRREQAMRERGLHFVGAGISGGEEGALNGPSIMPGGPAESYRSLGPLLEEISAHVDGVPCCTHIGPDGAGHFVKMVHNGIEYSDMQLIGEAYQLLRDALGKTAEQIADVFDEWNSGDLDSFLVEITAQVLRQTDAKTGKPLVDLILDEAEQKGTGRWTVKSALDLGVPVTGIAEAVFARALSGSVAQRRATTGLASGRLGEKPSDAAQFTEDIRQALYASKIIAYAQGFNQIQAGSAEYGWDITPGDLATIWRGGCIIRAKFLNRIKDAFDENPDLPTLIVAPYFRSAIEAAIDGWRRVVVTATRLGIPIPGFSSALSYYDALRTERLPAALTQGLRDFFGAHTYGRIDEDPDKRFHTLWSADRREVPA

SEQ ID NO: 84864 - protein, 359 aa, Coccidioides immitis RS
MAASRTLRIGLIPGDGIGREVIPAGRRILEALPASLGLKFSFVDLDAGFETFKRTKTALPDKTVDTLKKECDGALFGAVSSPTTKVAGYSSPIVALRKRLDLYANVRPVKTTPGANVPAPIDLVIVRENTEDLYVKDEKSYDTPEGKVAEAIKRISERASSRIATIAGEIALRRQKIRETGQAAPRSGPMVTITHKSNVLSQTDGLFRETARKALAAEKFSSVEIEEQIVDSMVYKLFRQPSYYDVIVAPNLYGDILSDGAAALVGSLGLVPSANVGDGFAIGEPCHGSAPDIEGKGIANPIATLRSAGLMLEFLGEEEAAAKIYAAVDANLDEGKFLSPDLGGKATTEEVLQDVLRRL

SEQ ID NO: 84865 - protein, 433 aa, Alkalilimnicola ehrlichei MLHE-1
MSEVQDMQQAQELLDFIDDSPSPWHAVANMAEMLQAAGFVELREDEPWHLNPGDAAYVIREEASLVAFRVGSRAPEAAGFRVLAAHTDSPGLRVKPGGAHRAGPFLRLGVEVYGGPILATFADRDLTLAGRVAVRGEVGIDSVLVDFPEALARLPTPAIHLNREVNEQGLKFDRQKELPLIFSLPDDDEPSPEAFRQLLATRAGVELDDLLGWDLAVSDTQPGAFFGADREFLAAPRIDNLASCHAAIKALLAVEQPTATAVCALFDHEEIGSTTYRGAAGTLLPNVLERLGGAGEELHQAKARSRLVSVDMAHAWHPNFPHFYEDEHKAHVNHGPVIKVNANQRYTSESTGGAWFAELCRGAGVPWQTYVHRTDLPCGSTIGPVTAARLGLPVIDVGNAIWSMHSARESAGAKDHAWMTGALSAFLAVPQLP

SEQ ID NO: 84866 - protein, 454 aa, Pseudomonas fluorescens PfO-1
MTQTNGPKRHLPVFQALLITLGMVITTDILKTAPTVALNVGPEHFYWVWVLGGLASMAGALCFAEMATAFPHPGGDYHFLRTAYGERMGFLFAWSRFSVMHTGWIALSAFMFADYFNAVVPLGHYGSGLFAGAIIAALVLLNLTGKHIGFMTQTVLVGLLALGFLSIASAGVWLAWQGFEPTLPSDPVVPEHTGAAGFSAAMIFVFLAFGGWSDAATLSAEVRDGRRGIFIAMLGALTVLMAIYLALNWAFVQGLGFEGLAASNAPAVELLNRAFGAPGVLLILLMVGIAAIATINSTLLVGARTTYAAARDVAQLRRFGEWDERDGVPRKALLAEGAVALLLVLFGSFTQSGFNTMVEYLTPVYWLFLSLSSLALIILRRRFPEVPRPVRVPLYPVLPLVFFGLCVYMLYSSVTVVGFGAFLGIGVLLVGAFLLAGLSCLVSTPRQALQRSVD

SEQ ID NO: 84867 - protein, 188 aa, Flavobacteria bacterium BBFL7
MKNILIIDNYDSFTFNLVHYLEDLDVNVTVVRNDKITPQECVDYDAIVLSPGPGIPSEAGNLIPIIEFLKDKKPLLGICLGHQAITEVFGGEIINLDKVYHGISTQMTHSGNDIFNDIDTNFEAGRYHSWAAQASSFPDALEITATDENGQIMALKHKELPIYGLQFHPESIMTPHGKQMLKNFIDTL

SEQ ID NO: 84868 - protein, 305 aa, Miscanthus sinensis var. sinensis
IESVGEGVTDVAPGDHVLPVFTGECKECAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRADLPNVVELYMKKELEVEKFITHSIPFAEINKAFDLMAKGEGIRCIIRMEN

SEQ ID NO: 84869 - protein, 305 aa, Miscanthus sinensis var. sinensis
IESVGEGVTDVAPGDHVLPVFTGECKECPHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRILGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFDNFKPRTDLPNVVELYMKKELEVEKFITHSIPFAEINKAFDLMAKGEGIRCIIRMEN

SEQ ID NO: 84870 - protein, 335 aa, Arabidopsis thaliana
MVKKGGTKRKIAIETIQKRDSLRVTCTKRREGLYSKASQLCLLSDAQIAILATPPSSESNVSFYSFGHSSVDAVVSAFLSGQRPVPKDNKETREDVGICLTRNNLGLGFWWNDESLARSENPQEISEAIDSMRTLLRNLKELRADEALACNQAFVNDREDLKNNDKCDFVSDHETHDQTLILQSASPICCIPENLNEITQEPNQTLNIQSSTSAICCVPDNSPENFNEITEEQDQIRSICETFCVMDNNAALPEMNLDYDQDIGFDTPFESALNDWFSDNTTHQEISASILNAVVDDQVSVDLTPFSYFQRCLDGDNLRFSDCFKDFANTISALG

SEQ ID NO: 84871 - protein, 239 aa, Zea mays
MKLNISYPNNGTQKLIEIDDERKLRVFMERRMGHEVPGDSVGDEFKGYIFRITGGNDKQGFPMKQGVMHPTRVRLLLSDGHSCYRPRRTGERKRKSVRGCIVGMDLSVLALSIVKKGDEDIPGLTDIVHPKRLGPKRATKIRRFFGLSKEDDVRKFVIRREVQPKKEGSKPYTKAPKIQRLVTPQRLQHKRHRLALKRRRAEASKDAANEYAQILSKRINDAKAAHDEARKRRASSMKH

SEQ ID NO: 84872 - protein, 305 aa, Miscanthus sinensis var. sinensis
IESVGEGVTDVAPGDHVLPVFTGECKECPHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRILGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 84873 - protein, 525 aa, Pseudomonas putida GB-1
MALDIHAHRILILDFGSQYTQLIARRVREIGVYCELHPFDMDDEAIREFNPRGIILAGGPESVHEANSPRAPQAVFDLNVPVLGICYGMQTMAEQMGGKVEGSDLREFGYARVDVVGKSRLLDGIEDHVDDDGVLGLDVWMSHGDKVTQMPGNFNILASTPSCPIAGMYDDARGYYGVQFHPEVTHTKQGGRILSRFVQDICGCEALWTASNIVEDAIAQVRAQVGSANVLLGLSGGVDSSVVAALLHRAIGDQLTCVFVDNGLLRLHEGDQVMAMFKENMGVKVIRADAEKQFLDNLEGEADPEKKRKIIGRTFIDIFDAEASKLENIQFLAQGTIYPDVIESAGAKSGKAHVIKSHHNVGGLPEEMNLKLVEPLRELFKDEVRKIGLELGLPYDMVYRHPFPGPGLGVRILGEVKKEYADILRRADHIFIEELRKADWYHKTSQAFVVFQPVKSVGVVGDGRRYAWVVALRAVETVDFMTARWAHLPYELLETVSGRIINEIDGISRVTYDVSSKPPATIEWE

SEQ ID NO: 84874 - protein, 372 aa, Oryza sativa Indica Group
MASSISVMASAGRNRGVGFAKLQGEDFEYFMQTYSIILGRDSKREKVDLDISGGDLTISRHHAHIFYDFECKRFSLLVLGKCGCTVEGVLHLPGGSPIKLDSQDLLQIGHKKFYFLLPTRSIFGTSSNQHGPSASAAFQPANNGTAADEHNLTASAAAQPAHIGTAAPPPHIGTAQPGQIGIVTLPPAHIQNNAENENIAGIETQEEFMNQNKMPFGELDTCSSHHITIEPTLAPGGQPVNNLAIRPADNNKDQQEVLLKEEEYVLASIGIVISDLCGLKKMIPIEKLHSELVACYSATWTQRQVQMHLAPEAGSSAAGTECKPWLKLMYLLRKYPERFTVMNSSCDEEGRQHRCVCTLYGDGTVCVFLKRT

SEQ ID NO: 84875 - protein, 399 aa, Sinorhizobium meliloti 1021
MAATTPLYDTYLRAPLRFERGEGVWLIAEDGTRYLDFAAGVAVNSLGHAHPHLVEALKAQADKVWHLSNLYEIAGQESLARRLTQVTFADRVFFTNSGAEALECAIKTARRYHFAKGHVEKFHVITFEGAFHGRTLATIAAGGQQKYIEGFGPKAPGFYQVPFGDIGAVKNAINEETAAILVEPIQGEGGIRTASKEFMQGLRELCDEFGLLLILDEVQSGVGRTGKLFAHEWAGIKPDIMAVAKGIGGGFPLGACLATEAAAAGMVAGTHGSTYGGNPLAMAVGNAVLDVVLAEGFLDQVREVALVFRQGLASLKDRFPDVIEEIRGDGLMLGIKAKVPSADLLKAIRAEKLLVVPAGENVLRLLPPLITTPAEAREGLARLERAAEAVSGKSGNAAA

SEQ ID NO: 84876 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNISAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 84877 - protein, 303 aa, Sinorhizobium meliloti 1021
MTRHFLDLSAMTATDLRTIIDDARVRKSATKAGTAEKPLAGKMLAMIFEKPSTRTRVSFDVGMRQLGGETLFLSGTEMQLGRAETIGDTAKVLSRYVDAIMIRTTDHRRLLEMAEHATVPVINGLTDDTHPCQIMADILTFEEHRGPVKGKTIAWTGDGNNVLHSLIEGSARFGYRMNMAVPLGSEPHDKFLNWARNNGAEVLLSHEAEQAVAGAHCVVTDTWISMNQEHRARGHNVFQPYQVNGALMKHAAPDALFMHCLPAHRGEEVTDEVIDGPQSVVFDEAENRLHAQKSILAWCMGAV

SEQ ID NO: 84878 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMDFLNERALKGTFFGNFKPRTDLPNVVELYMKKELEVEKFITHSIPFAEINKAFDLMAKGEGIRCIIRMEN

SEQ ID NO: 84879 - protein, 497 aa, Banksia dryandroides
MRINPTTSDPGVSALEEKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLK

SEQ ID NO: 84880 - protein, 300 aa, Arabidopsis lyrata
STNLTRMVKSPVVAELLDNGNFVLRDFKSNNQNRFLWQSFDYPVDTLLPEMKIGRNLKTGHESFLSSWRSPYDPSSGGFSFKLETQGLPELYLYKKEFLLYRSGPWNGVGFSGIPTMQNWSYFDVVNNFIENREEVAYSFNVTDHSMHYLRFTLTSEGLLQIFRWVTISSEWNLFGVLPTENCDLYQICGRDSYCDMKTSPTCNCIKGFVPKNVTAWALGDTFHGCVRKSRLNCHGDGFFLMKRMKLPDTSTSIVDKRIGLNECKERCSKDCNCTGFANKDIRNGGSGCVIWTRELRDMR

SEQ ID NO: 84881 - protein, 730 aa, Cryptococcus neoformans var. neoformans JEC21
MAAPRRSAGVTSSSGYADVAELEKYKLISNIGKGSFGVISKVQRVSDGKEFALKQLDYSKMTEKDRKQILAEVAILDSLKHRNIVQLIQKIKDPKNERIYIVMEYCTSGDLGTLIRRAQRNNSSLPEDKIWNIFLQIVLALHHCHWPAERPANTGGRQSVVAPSTDGGVARYQVLHRDLKPENVFLSDEFVKLGDFGLSKDMGTASFTSTYVGTPLYMPPEILAENRYDTKSDIWSLGCLVYEMCALHSPFSAAQTQAELITMVKSGKIPPLPARYSPALRSVIKAMLTLHPAKRPSTKDLLEMPEMKLHRKLFTVQNQTSLLFAKRDELKQFEDQIRARAVALDEREKELAGREASLQAREDLCDSREEEAKETQRKLNQAAESLRGQWERFREEKEQWERYRELEEEAKETAFGVTDVPDEKCQPHTGAVGIARPPLEERNTAPASPSVSRFTRCLDTPSKIPLATAAVSPAPLAPLEARFSTSHFQPRPATPLRRAATKSMGNLAGVVRAQTAQEWAGATQSTPAKQFSFPIRQQRISIGSPSELQSVCCEDVSMISAIPSPWVPRPRKSSVAPSIVVAQQECPASGESFSTGNNRLASVAPTQIPAPTFIYREAATPAKWSFDDPDLPSPFIRRPNSMPTQPQAASFPPSSNMVGMRQPLGSINPQATITAPSALGSPVAKKIPSRSGNLHQHVLKVNAARVSGEGVAPSVAPVGVVRGRTGNRIG

SEQ ID NO: 84882 - protein, 323 aa, Bordetella petrii
MNQAVILDTHGGPEVLRVTDRPLPAPAAGEVTVAHRAVGVNCIDLYYRGGRYPHPLPHGLGFEGAGVVEAVGSGVAGLRPGDRVAYATGPLGAYAQARNLPASHIIKLPPDIGFDTAMAILYKGLTVQYLFRQVYRPQAGEIVLFHAAASGVGLIACQWARLLGVRLIGTVSDSARGALAREHGAWRTIDTRHEDVAARVMALTDGAGVAAVYDGVGRDTWLDSLASLRPRGLLINFGDASGPVAGVALSALQKKSLYLTVTSLAAYMNTPARLLAAASELFRHVRAKALHAHIPRHYPLAQAARAHAALEKRSIAAAVLIPS

SEQ ID NO: 84883 - protein, 107 aa, Oryza sativa
  misc_feature (15)..(15): Xaa can be any naturally occurring amino acid
  misc_feature (20)..(20): Xaa can be any naturally occurring amino acid
  misc_feature (31)..(31): Xaa can be any naturally occurring amino acid
  misc_feature (45)..(45): Xaa can be any naturally occurring amino acid
  misc_feature (94)..(94): Xaa can be any naturally occurring amino acid
MDLNNLTNLHGLYGXDDLTXKYYFKLRRQNXLEVSAKATCVSLCXYVNLSNGRSTSNLVYKSKLCVRYASIVMIPGNSTPLTIEQSQKGHTTCXMVLDMRGCEPINI

SEQ ID NO: 84884 - protein, 497 aa, Banksia tricuspis
MRINPTTSVPGVSALEEKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLK

SEQ ID NO: 84885 - protein, 470 aa, Bifidobacterium longum DJO10A
MDTITLTGVHANGTHGVLAFEHERPQTFVVDVTLHLDLAAAGQSDDLNDTIDYGRVAKDIVAVIEGPHVDLIERLAQRIADKILADAPAVASIDVTVHKPHAPIVVAFADVSVSISRVRATDNGRTAEKHAIHNAVVALGGNVGEVESTLRAAVREIDALLGTQVTGISPLYRTAAWGMADGTPDFLNAVVELETTMGSHELLAALQNIEANHGRIRENHWDSRPLDLDIIDFDGITSADPDLALPHPRAWQRAFVLAPWAALNPNAKLAGAHEGPVADLLAAAPDRNAVQLESEDWMLGGHAVKQESASESEPVSRKAIISLDSTSQDAERLFRETIVSIDSVPGNQVQGISPLYHVSHFDSPDAMSAVIQIETKLPPADLIAVLGSIESVHDLAVDLDLVDMEGVTSDEPNCSIPWPSARNHASVLAPWLDMDPNASLGGDPVAFLLAMAPDAGQVGLLSDNWILSNS

SEQ ID NO: 84886 - protein, 104 aa, Arabidopsis thaliana
  misc_feature (6)..(6): Xaa can be any naturally occurring amino acid
  misc_feature (21)..(21): Xaa can be any naturally occurring amino acid
  misc_feature (48)..(49): Xaa can be any naturally occurring amino acid
  misc_feature (51)..(51): Xaa can be any naturally occurring amino acid
  misc_feature (54)..(56): Xaa can be any naturally occurring amino acid
  misc_feature (58)..(59): Xaa can be any naturally occurring amino acid
  misc_feature (61)..(61): Xaa can be any naturally occurring amino acid
  misc_feature (63)..(67): Xaa can be any naturally occurring amino acid
MASSMXSSAAVVTSPAQATMXAPFTGLKPSAAFPVTRKTKKDITSIAXXGXKEXXXCXXCXQXXXXXASGGGGQKNMKEKGKKIKIKKKKKKTKKKSSNSPTGR

SEQ ID NO: 84887 - protein, 369 aa, Trichodesmium erythraeum IMS101
MEIKAAVAFEAGKPLTIETINLEGPKAGEVMVEIKATGVCHTDAYTLSGADPEGLFPSILGHEGAGVVVEVGHGVTHLKPGDHVIPLYVPECRQCEYCLSMKTNLCQAIRTTQGRGVMPNGTSRFSLNGEIIHHYMGTSTFANYTVLPEISLAKIRKDAPFDKVCYIGCGVTTGIGAVINTAKVEVGAKVIVFGLGGIGLNVIQGAKMVGADMIVGVDINPAKQELAKKFGMTHFVNPKEVEGDLVPYLVDLTKGGADYTFECIGNINVMRQALECCHKGWGMSVIIGVAGAGEEISTRPFQLVTGRVWKGSAFGGAKGRTDVPKIVDWYMEGKINIDDLITNVMPLEKINEAFDLMHEGKSIRSVVTF

SEQ ID NO: 84888 - protein, 205 aa, Shigella flexneri
LRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 84889 - protein, 192 aa, Shigella flexneri
ARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGV

SEQ ID NO: 84890 - protein, 570 aa, Oryza sativa Japonica Group
MEASDEDRPLIHHLPPQEQCSKYTCDGTVNIDSKPALKQSTGNWRACFFILGVEFTECICFYGVSKNLVTYLTSVLHESNVNAAQSVSIWIGSCFFTPLIGAFLADTYWGRYWTVVMSILVIILGMIVLTVSASPLFLNASFYNGGISRLTVYLGLYLFALGTGGIKPNIPAFGADQFDGADPVERVTKGSFFNWYYFSINVGSLLSSTVVVWVQDNIGWSVGFAGPMLLLGFGLAMFIAGRRAYRYKKLGGSPLTRVFQVLVAAVRNHRLNLPDDSSLLHELPGVTEGDYRTQHTYQFRFLDKAAILSDKNCAPAAPSSPWRLCTVSQVEELKMLLRTFPVWASLVGFFMVTAQMTSTLIEQGVAMDGRVGRFTVPPASLATFDVVAVLALIPVYDAALVPLARRVTGRDRGVSHMQRIGVGLALSAVAMAYSALVEARRLAMAAAAAGTRMSIAWQVPSFFVLGAGEVFAVIGMLEFCYEQSPASMKSLGTALVQLAVAVANYLNSGMLRVVAAATARGGGAGWIPDKLDEGHLDYFFWMMAALSVLNLLQFLHCSIRFRGNNTLSSS

SEQ ID NO: 84891 - protein, 334 aa, Ustilago maydis 521
MAAASSTFNEAGPSSSAASDAKKLAISSNLISVLKPAKVFSQYVTKGTSITSASFDDAGFQCITSGEDDFMHVYDAKYGLHVAKIPSQKYGVHLTRFTHDKDSVIYASTKENNAIRYMDLKTKAYMRYFEGHENKVVTLQMAPQNDTFLSGSVDEAVRLWDLRTPKSMGLMNIQGHPVVAYDPTGKVFAVSKDERSAVLLQYLLLGTSGDVHYVIDTFSEGDLVVARLIGHEGLEKASGTSIGMVAEAGISGQEICWTPDGKWVLSGSADGSVVFWSIDLEEASRNEFRNLRPRYKQSAHDGASRVLAFNPRYAQFMSAGAEVAFWLPDLPEEV

SEQ ID NO: 84892 - protein, 359 aa, Zea mays
  misc_feature (40)..(40): Xaa can be any naturally occurring amino acid
  misc_feature (126)..(126): Xaa can be any naturally occurring amino acid
  misc_feature (154)..(154): Xaa can be any naturally occurring amino acid
MAPVDLTPRQPRKAYGGDAGAYYEWSPADLPMLGVASIGXAKLSLAAGGLSLPSYSDSSKVAYVLEGTGTCGIVLPEATKEKVLAVKEGDALALPFGVVTWWHNGPAAPTQLTVLFLGDTSKGHRXGQFTNFQLTGASGIFTGFSTEFVSRAWXLPEANAAALVSSQPASGIVRASSPLPAPSAQDREGVALNCLEAPLDVDIPGGGRVVVLNTANLPLVREVGLGADLVRIDAHSMCSPGFSCDSAYQVTYIVRGSGRVQVVGPDGVRVLETRVEGGFLFIVPRFHVVSKIADASGMEWFSIITTPNPIFSHLAGKTSVWKAISAEVLQASFNTTPEMEKLFRSKRLDSEIFFAPPSN

SEQ ID NO: 84893 - protein, 103 aa, Brassica napus
  misc_feature (5)..(5): Xaa can be any naturally occurring amino acid
  misc_feature (13)..(16): Xaa can be any naturally occurring amino acid
  misc_feature (18)..(18): Xaa can be any naturally occurring amino acid
  misc_feature (20)..(20): Xaa can be any naturally occurring amino acid
  misc_feature (29)..(29): Xaa can be any naturally occurring amino acid
  misc_feature (38)..(38): Xaa can be any naturally occurring amino acid
  misc_feature (40)..(40): Xaa can be any naturally occurring amino acid
  misc_feature (48)..(48): Xaa can be any naturally occurring amino acid
  misc_feature (59)..(59): Xaa can be any naturally occurring amino acid
  misc_feature (61)..(61): Xaa can be any naturally occurring amino acid
  misc_feature (63)..(64): Xaa can be any naturally occurring amino acid
  misc_feature (67)..(67): Xaa can be any naturally occurring amino acid
  misc_feature (75)..(75): Xaa can be any naturally occurring amino acid
  misc_feature (80)..(82): Xaa can be any naturally occurring amino acid
  misc_feature (84)..(84): Xaa can be any naturally occurring amino acid
  misc_feature (95)..(95): Xaa can be any naturally occurring amino acid
MEEEXNVTSSPSXXXXHXKXSSTTEGGHXGNPSPLLVXDXNEYKSFMXRTYSTIWMIGXFXMXXYMXHLYITAMXLVIQXXXMXKELFNLLKKAXASLTNTLN

SEQ ID NO: 84894 - protein, 187 aa, Silicibacter sp. TM1040
MAERENRRGNRRDREETPEFADRLVAINRVSKTVKGGKRFGFAALVVVGDQKGRVGFGKGKAKEVPEAIRKATEQAKRQMIRVPLKEGRTLHHDMYGRHGAGKVVMRTAPEGTGIIAGGPMRAVFEMLGIKDVVSKSVGSQNPYNMIRATIDGLKKEQSPRSVAQRRGKKVADILPKRDEAPAEAEA

SEQ ID NO: 84895 - protein, 408 aa, Mycobacterium avium 104
MAQRTQGSLKGNWYLLGPAFVAAIAYVDPGNVAANVSAGSQYGYLLLWVIVAANVLAGLVQYLSAKLGLVTGRSLPATIGKRMSRPARLVYWVQAELVAIATDAAEVVGGAIALHILFGLPLLAGGLITGVVALLLLGIQDRRGQILFERVITGLLLVIAIGFAASFFVKTAPPEAVLSGLLPRFRGTESVLLAAAILGATVMPHAVYMHSGLVLDRHGHPDEGPHRRLLLRVTRWDVVLAMAVAGTVNAAMLLIAATNLQHRDVSASIEGAYAAIHNTLGATIAVMFAVGLLASGLASSSVGAYAGAMIMQGLLHRSIPMVVRRLITLCPALLILAVGYDTTRALVLSQVVLSFGIPFAVLPLIKLTSDRELMGSDANHRITTILGWGVGILISLLNMVLIWLTVTG

SEQ ID NO: 84896 - protein, 450 aa, Methanosarcina barkeri str. Fusaro
MENKYDIIIIGTGTAGRTFAGKVAHSGLKIAIVDSREYGGTCPIRGCDPKEVLTNITKVIDSSNRLMGKGVRIDAPLKLDWTSLIKFKKTFTEGYSSKTEKHLVGMGIDTYHGRAHFENQNTVVVGMDKLKGEHIFLATGAKPRTLNIPGEEYIITSEKLMETKKLPEKIIFIGGGYISMEFAHIARRTGAEVTILQRSEKVLRAFDSDMVDLLMKASKAAGIKILTNKPVISVEKDNNGLILKVQSQSETEPEIQIFRADMVVQGAGRVADIEDLRLENARIKTEKGAIVVDKHMRTSNSRIYAGGDCALEGMQLTPVAALQGEVAAINVLEGDSAEADYTGIPSAVFTIPVLASVGISVAKDDDKYKVIFQDRSNWYTTRKKGMEFAASKVIIDEANDRIMGAHILGPNAEEAINIFASVMRLGLKASDIKKLIFTYPTTCSDIPYML

SEQ ID NO: 84897 - protein, 123 aa, Photorhabdus luminescens subsp. laumondii TTO1
MSINKEQILDAVATMSVMDVVELITAMEDKFGVSAAAAVAVAAGGAAEAVEEQTEFDVVLSAIGGNKVAVIKAVRGATGLGLKEAKDLVESAPNATLKEGISKDDAEALKKSLEEAGASVEIK

SEQ ID NO: 84898 - protein, 178 aa, Oryza sativa Indica Group
MSKSKTIADKCALASSGFQGDIKALHKNLAARELLYQHQHNKRMSCPAMAQLLSNTLYYKRFFPYYAFNVLGGLDSEGKGCVFTYDAVGSYERTGYSAQGTGSALIMPVLDNQLKSPSPLLLPARDAVTPLSETEAVDLVKDVFASATERDIYTGDKLEIVVINKAGTKREYIDLRKD

SEQ ID NO: 84899 - protein, 256 aa, Zea mays
  misc_feature (253)..(253): Xaa can be any naturally occurring amino acid
FTPSPSFSLSLRRLCGVPPPPPQALTPRRRRPRRLRQVPRDGPFIFVSLFAGRRAPARFRNDLCNNCKRPGHFARECPSVAVCHTCGLPGHIAAECSSKGVCWNCKEPGHMANSCPNEGICRNCGKSGHIARDCTAPPVPPGEVILCSNCYKPGHFREECTNEKACNNCRQSGHLARNCTNDPVCNLCNVAGHLARQCPKSDTLGERGGPPPFRGVGAPFHDVGAPFRGGFSDVVCRACNQIGHTSRDCMAGXFMI

SEQ ID NO: 84900 - protein, 518 aa, Zea mays
MAPPRISFLELCLSFLCFVVFYYFHMRSKRKNPFVPLDWPLVGMLPALLGNLHHLHDWITSLLVASQLSFLFTGPPRSGMQFFVTADPANVRHVFTSNFANYPKGPEFEEIFDVLGGGIFNADGESWRRQRAKAQLLMSSAPFRALVSRYSRAKVDTALLPLLSHMAATGEAFDLQDVFLRLTFDTTTTLVFGVDPGCLSVGLPEVPFARAMDDAMGVLLLRHVVPMTWWKLARRLRIGHERKMAEAWRTIDQFVADTIAKRRAEKARHGNGQVSADLLSSYINDDEDEEGGVDAFLRDTTINLMLAGRDTTGSALSWFFYLLTRNPRVVGKIRQELECVKSKSSGSGGGMASFDPDELSRLTYLHAALCESLRLYPPVPQELKEAAAADVLPCGHEVRAGDKILVSLYAMGRMEEVWGSDCREFRPERWIPELEDGRRVVQVRYVPSYKFMSFNSGPRTCLGKDMAFVQLKAAAAAVVSNFDVEAVPGHVVEPMLSIILHMKNGFMATVKRRRQTFA

SEQ ID NO: 84901 - protein, 299 aa, Zea mays
RPVTTSPSTPGGSDGGCSTPPPPSSGTSPSTPGSGGTGGCSAPPSPSSDTSPSTPGGGGGYYGPPSPSSDTSPTTPSAPSGGYYGPPSPSSDTSPTTPGGGYYGPPSPSSDTSPTTPGGSGGGGYYGPPSPSSETSPTTPGGGGGYTPTPQVPLPPISTSPPFSPLTPTPTTPTPYDPNTPPFTGPCTYWMMHPGVIWGLFGFWCPLVRLFGPSAAVPFGHDLTVPEALANTREDGMGALYREGTASLLNSMVNNRFPFTTQEVKDAFGAALNSGDDGAAAAQARLFKKANEGHVIRQN

SEQ ID NO: 84902 - protein, 450 aa, Oceanicola granulosus HTCC2516
MIPPKPASRPERVSLWRYLRLFRRDILSAQPEKLYRAWMAEFRTPFFRSYLVNDPSLVKRVLQERPDDFPKSDRIGAGLRPLLGQSVFLTNGAQWKRQRRIIDPAFEGGRLRDTYPAMWAAGQAAVARLGPLADGRPVEIEAETSHAAADVIFRTLFSIPIEHALAREVFAEFRTYQRSQPILNLAAFIPARWLPRFFRRETRASAHRIRALIARLTTERGAEIRAGRAPDDLATKIMTTRDPETGETFSDAEMVDQVAIFFLAGHETSASALAWALYLLALYPDWQDKVAAEAAGASDDFASVSRLRITRDVFREALRLYPPVPMMVREARCPETFRDRAVSPGAQVVLSPWHLHRQSRLWERPDEFDPARWASDNGRACAREAYIPFSAGPRVCTGAGFAMIEGVLLLALILRAYRVTPVEDRTPVPVAHLTVRSADGIWLRLAPRQP

SEQ ID NO: 84903 - protein, 184 aa, Anaplasma marginale str. St. Maries
MITAVRAVPFRVGIGYDVHGFADSPPENGHIVLCGVEIAFHRKIKAHSDGDVGTHALVDALLGCVGEGSIGEHFPNTDPRWENMSSTHFLLEAQSKALAKGYAVLNFDLTIVCELPKIIPHVPKMKLFMSKLLGMDASAINIKAVTTEKLGFIGRGEGIAAHAVVLCRKVTAAAPNPGSENPRG

SEQ ID NO: 84904 - protein, 489 aa, Pseudomonas putida GB-1
MAAISVEPCTFALFGALGDLALRKLFPALYQLDRANLLHPDTRLLALAREAGSAQVHLDTIEAHLRRHVPEADIEPASLGRFLARLSYQHLDFLQPEGYQALAEQLPGEQPLIAYFATAAVVYGAICENLDKVGLAPRTRVVLEKPIGHDLESSRRVNDAVARFFPENRVYRIDHYLGKETVQNLIALRFANSLFETQWNQNSISHVEITVAEKVGIEGRWGYFDKAGQLRDMIQNHLLQLLCLIAMDPPSELSADAIRDEKVKVLKALAPITGDGLSTRVVRGQYIAGYSEGKPVPGYLEEDNANAQSDTETFVALRADIRNWRWSGVPFYLRTGKRMPQKLSQIVIHFKETPHYIFAPEQRLQIGNKLIIRLQPDEGISLRVMTKEQGLDKGMQLRSGPLQLNFSDTWRSARIPDAYERLLLEVMRGNQNLFVRKDEIEYAWKWCDQLIAGWRNAGDAPKPYAAGSWGPMSSIALITRDGRAWYGDI

SEQ ID NO: 84905 - protein, 760 aa, Cryptococcus neoformans var. neoformans JEC21
MTSPSAQPMIPRSQPPRPSHTQSSPAINSTGIKPNGPPSVIRRAPSVPVNPSTAAASGSLSSLLKSENTAQAVSRSSPPTEPNDLPRPIEPTPMLPITGLPNSSSSSSNARHGSSSSISRGPSVTGTLTPATTALGAPIEPTPPQTGASKMAAAAKRGLDGSAGNNVKVYEEGHPLNEETLKQRGYQTLNILNHPFHLPDRWKLLRPLGQGAYGLVIQVQDAETEIPIAVKCVTRVFDKVILARRALREITLLRHFGEHDNLTGLVDMDNVWDGYNEIYLYMEPMEADLHQIIRSGQPLGNAHIQFFIYQLLRGMKYIHSANVIHRDLKPGNLLVNSGCELKICDFGLARGFNPVKGEEPQGEEGKLTEYVATRWYRAPEIMLSNRRYTTAIDVWSIGCILAELLGLKPVFKGKDYIEQMTLILETLGTPDEETMARVASEKALTFLKTLPTYEKKDLGSIFPDADPLAVDLTDKLLEFDPTRRIDVPSALTHAYVERYHDPEDEPSCDKIFDKWEEVESLSTIEELKEAITREIQGFREEVRMAAEEDDEDEEWAEGEYLDDENVFHDSPGPALASTLEKFTYPDHIAPTGSAPRTREHSPTTTFITSAEDYFTAQHGFGGPNGRASRRSSSHSTSGRRPASFLFSPFGAGMTQIVPTPNAYPRSHAQASPELTTAEKTPRDRRSSGLWRTRSRAQSQSGNLVLERLSSLEINDHKDGEKNRIDALHAVVGLGGDGEVPPMTVSPSDAPPSEVPKSFGY

SEQ ID NO: 84906 - protein, 168 aa, Anaplasma phagocytophilum HZ
MGYLGMPFRVGMGFDVHRFTESREEGQYIPICGIKVAHTQGIVAHSDGDVALHALTDALLGCMGEGSIGQHFPNSDPQWKNASSSYFLLEAQKKAAAKSYAILNFDVTIVCEQPKIMPHVPKMKEFLSKLLDVDVSQMNIKAVTTEKLGFLGRGEGIAAHAVLMCYRV

SEQ ID NO: 84907 - protein, 252 aa, Debaryomyces hansenii CBS767
MSTEAAAPKRNFARSNRGGKPRRGGRRDEEKGWTPVTKLGRLVKAGKITSVEEIYLHSLPVKEYQIIDQLLPELKDEVMKIRSVQKQTRAGQRTRMKAVVVIGDSNGHVGLGIKTAKEVASAIKAAIIIAKLSIIPIRRGYWGTNLGAPHSLPTKVTGKCGSVAVRLIPAPRGKGIVASPAVKKLMQLAGVEDVYTSSSGSTRTTENTLKAAFIAIGNTYAFLTPNLWTEAPLAPSPLDVYAEEAAGSKRRY

SEQ ID NO: 84908 - protein, 476 aa, Azoarcus sp. EbN1
MADKQFDVLVIGGGPGGYVAAIRAAQLGFKTACAESNPYADPKGEPRLGGTCLNVGCIPSKALLHTSHLFEEAEHAFPTQGIRLEGKVSIDVPVMIGRKNKVVDQLTSGIKGLFKKNKVTFLAGHGSFEGNGPAGYVVRVGAETVEARHVIIATGSKPRHLPGIPVDNRIVCDNVGALDFDSVPKKLGVIGAGVIGLEMGSVWRRLGAEVTVLEALPDFMPFADMDVAKEALKVFTKQGLDIRTGVTIGETKVGADGVSLAYTGKDGKEARLECERLIVSVGRVPNTEGLNASTVGLDVSDRGQIVVDGHCRTNLPNVYAVGDVVRGPMLAHKAMEEAVMVAEIIAGQAGHANLDTVPGVIYTSPEIAWVGKSEQQLKAEGVAYRAGKIPFMANGRALGSGDPTGFVKMLADADTDRILGVHIIGANASELISEAVVAMEFGGAAEDLARICHAHPTLSEVVHEAALAVDKRPLHF

SEQ ID NO: 84909 - protein, 213 aa, Haemophilus somnus 129PT
MSDQSCIIIAIAGASASGKSLIASTIHEELCNELGCEEIGIVTEDSYYKDQTHLSFEERIKTNYDHPNSMDRDLLIQHLCDLKKGKAVDIPVYSYVEHTRTQEVTRFEPKKVIILEGILLLTDERIRQEVNMSVFVDTPLDICFIRRLQRDMEERGRSLQSVIDQYKSTVRPMFLQFIEPSKQYADIVVPRGGKNRVAINMLKVQIQHLLNNK

SEQ ID NO: 84910 - protein, 394 aa, Azoarcus sp. EbN1
MLIEVKVPQLSESVSEATLVSWHKKEGDAVSRDENLIDIETDKVVLETPAPADGVLVKIVKADGENVTSGDLIAQIDTEAKAPAGAKPAEAVQAVAAPAPAVAAATTGGAPSPAARKILEEKGVAAGDVSGTGRGGRVTKEDAVAAQPRAAAPVAAAVRGGDRAEERVPMTRLRARIAERLIQSKNENAILTTFNEVNMAPVMALRKQYGEKFEKAHGVRLGFMGFFVKAAVAALKKYPIINASVDGNDIVYHGYIDIGIAVGSPRGLVVPIIRDADQMSIADIEKKIAEYGQKAKDGKLSLEELTGGTFSISNGGVFGSMLSTPIINPPQSAILGIHATKDRPVVENGQIVIRPINYLALSYDHRIIDGREAVLGLVAMKEALEDPARLILDV

SEQ ID NO: 84911 - protein, 489 aa, Actinidia chinensis
  misc_feature (486)..(486): Xaa can be any naturally occurring amino acid
PGASVLEKQNQGRIVQIIGPVLDAAFPPGKMPNIYNALLVKGRDTAGQPINVTCEVQQLLGNNRVRAVAMSATDGLTRGMEVIDTGAPLSVPVGGATLGRIFNVLGEPVDNLGPVDTGITSPIHRSAPAFVQLETKLSIFETGIKVVDLLAPYRRGGKIGLFGGAGVGKTVLIMELINNIAKAHGGVSVFGGVGERTREGNDLYKEMKESGVINEQNIAESKVALVYGQMNEPPGARMRVGLTALTMAEYFRDVNKQDVLLFIDNIFRFVQAGSEVSALLGRMPSAVGYQPTLSTEMGTLQERITSTKKGSITSIQAVYVPADDLTDPAPATTFAHLDATTVLSRGLAAKGIYPAVDPLDSTSTMLQPRIVSNEHYETAQRVKQTLQRYKELQDIITILGLDELSEDDRLTVARARKIERFLSQPFFVAEVFTGSPGKYVGLAETIRGFQLILSGELDGLPEQAFYLVGNIDEATAKAMNLEMESXLEK

SEQ ID NO: 84912 - protein, 737 aa, Sinorhizobium meliloti 1021
MSYTNFKIETDADGIALVTWDMPDKSMNVFTEEVMKELDAIIDQTTADPAVKGVVITSGKSSFSGGADLSMIKSMFTFQAEERKKDPDNAARKLFDLVGRMTGLFRKLETSGKPWVSAINGTCMGGAFEMSLACHGRVASNAKSVKIALPEVKVGIFPGAGGTQRVPRLTNTQDALQMMTTGSSLTPARAKAMGLVHEVVDPDKLIEAAKAMIKNGLKPVQPWDEKGFKLPGGGIWTPASAQLWPAASGILRRETYGNYPGAIAILKCVYEGLQVPFDTALKIEQRYFTEILQTTEAFSMIRSLFVSMQELGKGARRPAGVPKTELKKVGVVGAGFMGASIAYVTAAGGIPVTLIDRDMEAAEKGKTHSEGLVKDAIGKGRLTKEEGEALLSRITPSADYGDLRDAGLVIEAVFEDRQVKKDVIEKVEAVIAEDAIFASNTSTLPITGLARNSKRPDRFIGIHFFSPVEKMMLTEVILGKETGDRALAAALDYVAAIRKTPIVVNDTRGFYVNRCVFRYIHEAYDMLIEGVPPAMIENAAKMAGMPVGPLSLNDEVAIDLSQKILKAAVADLGDKAVDLRHMALIDKMVDELDRRGRKNGKGFYEYPAKPARKYLWPGLKELYPQKDAGEIEVGVLKQRLLVTIALEAARTIEEGIVTDPREADVGSILGFGFAPYTGGTLSYIDGMGAKAFVELCEKLAADHGDHFRPTPLLKEMAEKGETFYGRFDPYGAGQKAA

SEQ ID NO: 84913 - protein, 147 aa, Listeria monocytogenes str. 4b F2365
MEQTYVMVKPDGVERGLIGEIVTRIEKKGLKIVAGKLMQIDRELAEKHYAEHIGKSFFEDLIGFITSGPVFAMVLEGDDAIATARRMMGKTNPLEADPGTIRADYAIHTNRNVIHGSDSPESAKREIQLFFAPQEILSYQKAIDTWI

SEQ ID NO: 84914 - protein, 156 aa, Desulfovibrio vulgaris subsp. vulgaris str. Hildenborough
MRTLRILAVGRIRTPFWQQAATHYMERIRHNCRLTETVVKDGGAALPPTARNADEGARLIAAMGPTDIVVCLDEHGRNMTSRDFAGFIERLTENATRTPCFVIGGAFGLDKSVLQRAEHKLALGPMTFPHEMARVVLLEQLYRADAILRGAPYHHD

SEQ ID NO: 84915 - protein, 708 aa, Streptomyces avermitilis MA-4680
MSTTELLKGAAALFPDEVVTSAHVRHLDLPSGAGRFALITLDNGFDHTKPTTFGPASLANLNTAIDQVEKEAAAGEIVGVGITGKPFIFAVGADLKGVELLKNHDDALAIGKGGHEVFKRLAGIAVPTFAYYNGAAMGGGVEVGLHCQYRTVSAALPAFSLPEVFLGLVPGWGGCTILPNLIGADKAVSVIIENSLNQNKQLKGEQVYDLGIADAIFEGADFLEQSLLWTTAVLKGEIAVERPEIDRGEAWDQAVAKGRFIADSKVHGAAPAAYRALDIIAAAKNGDLQQGFDAENQALADLIMGGELRSGIYAFNLVQKRGKRPAGAPDKSLARPVTKVGVVGAGLMASQLALLFLRRLEVPVVLTDIDQERVDKGVGYVHAEIDKLLLKGRVNQDKANRLKALVSGVLDKAEGFSDADFVIEAVFEEIGVKQQVFAEVEAVAPAHAIFATNTSSLSVTEMASKLKHPERVVGFHFFNPVAILPLLEIVRGEQTDDASLATAFGVAKKLKKTAVLVKDAPAFVVNRILTRFMGEIQNVIDEGTPVEVAEKAVEPLGLPMSPLVLLELVGPAIGLHVSETLNRAFPDRFTVSPNLAAVVKAGKRGFYVYDSGKPELDPEVAALLKQGDVVLTEEQVRDRVLDAVAQEIGLMLDEGVVAEAQDIDLCLITGAGWPFHLGGITPYLDREGVSERANGKRFLEAGVASVPA

SEQ ID NO: 84916 - protein, 521 aa, Xanthomonas oryzae pv. oryzae KACC10331
MFIRDSHCVRSPSPAVANPQSHPPNPSPMSRKQAFQFLDLPRTMPTRIPVELRTSGDWGELYGKFDKAEAQYQSGRCLDCGNPYCSWKCPVHNAIPQWLQLVQENRIEEAAALCHSTNPLPEVCGRVCPQDRLCEGSCTLEEFGAVTIGAVEKYIVDTAFKMGWRPDLGNVHPTGHRVAVIGAGPAGLACADRLARAGIEAVVYDRYEQIGGLLQFGIPSFKLDKSVIGKRREILEGMGVQFRLGVEIGRDISIEQLLGEYDAVFLGTGAYRYTDGGLPGQDLKNVLPALPFLVQNSRIVSGNDPHGRPIAGWENQLALPDLTGKRVVVLGGGDTGMDCVRSAIRLGAAKVTCAYRRDEASMPGSAREVANAREEGVRFLFNRQPLSIESGADDEAIGVTVVETKLGEPDASGRRNAVPVEGSESLLEADVVIIAFGFSPSLPDWLASQGVEAGSNGRIVAPADGHGRLPYQTSNPRLFAGGDCVRGADLVVTAVAEGRDAACSIVQLLGVKAQVKEPAAA

SEQ ID NO: 84917 - protein, 211 aa, Synechococcus sp. WH 5701
LRVTDADTMDVVEMVLVGRVNKQIVNGLNQLGARAVGLSGCDGGLVEARPWGDGSHGLVGDVARINPDVLEPLLNEGYVPVISSVAATPSDGRAHNINADTVAGELAASLQAEKLILLTDTPGILRDRDDPESLIRKLRLSEARQLIEDEVVAGGMTPKTECCIRALAQGVAAAHIVDGRVPHALLLEVFTDAGIGTMVVGRENHPNKTVD

SEQ ID NO: 84918 - protein, 90 aa, Desulfovibrio vulgaris subsp. vulgaris str. Hildenborough
MSKTLYVGNLPFTAEQEDVRDLFAAHGEVVSVKLMFDRETGRPRGFGFVEMADADMRTAMEALDGYDFMGRNLRVNEAQERAPRAPRRAW

SEQ ID NO: 84919 - protein, 535 aa, Coccidioides immitis RS
MSRNDRNTSSYMASSLSHLSNRMKLEWTSKLSTEYQPAKNYRRTSIICTIGPKTNSVETINILRKAGLNVVRMNFSHGTHEYHQSVIDNAKEAERIQPGRPLAIALDTKGPEIRTGLTPDNKDIPISAGTELNITTHDDFAAKSDNKNLYVDYKNITKVIEKGKLIFVDDGVLSFEVLGIVDDQTLRVKCLNNGTISSKKGVNLPGTDVDLPALSEKDIDDIKFGVKNRVDMIFASFIRRGDDIKRIREVLGDEGHEIQIIAKIENQQGVNNFDEILDQADGVMVARGDLGIEIPAPKVFIAQKMMIAKCNIKGKPVICATQMLESMTYNPRPTRAEVSDVANAVLDGADCVMLSGETAKGNYPKEAVAMMHETCLQAEVAIPYFSVFDELRNLCPRPADTVESIAMAAVSASLELNAGAILVLTTSGLTARLLSKYRPVCPIIMVTRNEAAARYSHLYRGVYPFFFPEKKPDFNIRIWQEDVDRRLKWGIAQALTLEVISKGDSVVCVQGWRGGQGHTNTIRVVPAEPNLGLAE

SEQ ID NO: 84920 - protein, 232 aa, Mycobacterium avium 104
MPCNTGQPRGPLIAPSILSADFSRLADEAAAVTGADWLHVDVMDNHFVPNLTIGLPVVQSLLATTTIPMDCHLMIENPDRWAPPYAEAGAHNVTFHAEATDNPIGVARDIRAAGAKAGISVKPGTPLEPYLEILPQFDTLLIMSVEPGFGGQSFIPEVLGKVRTARKLIDAGELTILVEIDGGINADTIEQAAEAGVDCFVAGSAVYGADDPAAAVEALRRQALGASQHLRR

SEQ ID NO: 84921 - protein, 338 aa, Listeria monocytogenes str. 4b F2365
MTQKKVAILGAGSWGTGLALVLADNNHQPVIWGNLDKIVNEINESHTNSHYLPDIILPTEVKATLSLDEAIDGAEIVVIAIPTNAMRIVCKQLNEALKEPTILVHVSKGIEPETNLRMSEVIEDEIDASKRKALVVLSGPSHAEEVALRHPTTLCASCKDLSAAEIVQDRFINNNLRIYTNDDVIGAEIGGALKNIIALGAGISDGLGYGDNAKAALMTRGMAEITRLGVAVGSNPQTFYGLTGIGDLIVTCTSVHSRNWRAGNMLGKGENLDEVLEKMGMVVEGVRTAKAVHGWAKKLDIDMPITESIYAILFENKDAREAVDLLMGREKKIEKESF

SEQ ID NO: 84922 - protein, 455 aa, Escherichia coli O157:H7 EDL933
MSFDSLGLSPDILRAVAEQGYREPTPIQQQAIPAVLEGRDLMASAQTGTGKTAGFTLPLLQHLITRQPHAKGRRPVRALILTPTRELAAQIGENVRDYSKYLNIRSLVVFGGVSINPQMMKLRGGVDVLVATPGRLLDLEHQNAVKLDQVEILVLDEADRMLDMGFIHDIRRVLTKLPAKRQNLLFSATFSDDIKALAEKLLHNPLEIEVARRNTASDQVTQHVHFVDKKRKRELLSHMIGKGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRIAIPGYEPDPSIKAEPIQNGRQQRGGGGRGQGGGGRGQQQPRRGEGGAKSASAKPAEKPSRRLGDAKPAGEQQRRRRPRKPAAAQ

SEQ ID NO: 84923 - protein, 467 aa, Sinorhizobium meliloti
MAREAAEKTATSTSLAALAGLVERYANPDFAIAPGGHVQTISPGHYTVSGLSRHVRLGDFVAHKSATGTHLGEVVRVEPERVVVCPIEPGDPIGIHDVVIRKGAFRIAPTDNWCGRTINALAEPIDGLGALLQGDIRRSIANTAPPSMTRKRVEQGFRTGVRAIDIFSPLCLGQRLGIFAGSGVGKSTLLSMLARADAFDKVVIALVGERGREVREFIEDTLGDNLSKSVAVVATSDESPMLRKMAPLTAVTIAEHYRDKGDNVLLIVDSVTRFAHAIREVATAAGEPPIARGYPASVFTELPRLLERAGPGAEGAGTITAIISILVDGDNHNDPVADSARGILDGHIVLDRSLAEEGRYPPVNPLASISRLARKAWTPDQEKLVARLKSLIHRFEETRDLRLIGGYRPGGDADLDMAIKQVPVIYDVLKQMPGERPAFDAFTDLANALKAAAMGNQPGAAGLRGRG

SEQ ID NO: 84924 - protein, 181 aa, Oryza sativa
  misc_feature (92)..(92): Xaa can be any naturally occurring amino acid
TVDDFHRFLFSHELNPPIRHGQGQVHHDMAAPLSHYFIYTGHNSYLTGNQLSSDCSDLPIIRALQRGVRVIELDMWPNSSKDDISILHGRTXATRVSLLKCLLSIKKHAFEASPYPVIITLEDQLTPDLQDQGSKKGLDVFGRNPLLTWPKNHVKEFPFASRSSRGRGPSFSTKAPQWRTF

SEQ ID NO: 84925 - protein, 153 aa, Streptococcus mitis
EHFIRGQYRSGKIDGMKYISYRSEPNVNPESTTETFASGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 84926 - protein, 386 aa, Photorhabdus luminescens subsp. laumondii TTO1
MLYADVASTSWPKSQEVKDMINMYLDTLGVTPGRSLSQQSKKVTELVEECRHEFIEQTKLNGHGTVIFNSGATYSLNECLKGTLKPGDNVITTHLEHNSVLRPINHLKDIGVSSQFIDVTDGEIDMSHLAFLLKNKKTKLLVIHSCANTIGTFCNIDEIGKLAHLYGAMVLVDGSQSFGSQVMDLSKGNIDYLVFSGHKSLGGVSGIGGYFILDNGFSHNELIQGGTGVLSRLTTQPTGIPYKYESGTQNTIGILSLLASIRRLKKIGVENIQNQLQTLRTTLIDELSQLKKIKLICKHQVGLPTILFTVEGYHPGEVSYILENKYNIITRPGLQCAPLAHKKFGTYPDGAVRVSLDTTHTTEDILKIKSALVNITEENYRENTDN

SEQ ID NO: 84927 - protein, 384 aa, Vitis vinifera
MAVTVHPVCSHLSSFHPVRTRLTTRPVSRKFGANSVRCDGSIETQRVTVKNGNDSLDICRVLNGMWQTSGGWGRIDRNDAVEAMLRYADAGLSTFDMADHYGPAEDLYGIFINRVRRERPPEFVDKVRGLTKWVPPPVKMTSNFVRESINVSRKRMDVAALDMLQFHWWDYSNTGYLDALKHLTDLKEEGKIKTVALTNFDTERLQIILENEIPVVSNQVQHSIVDMRPQQKMAELCQLTGVKLITYGTVMGGLLSEKFQDTNIAIPFSAPPLNTPSLQKYKRMVDAWGGWSLFQTLLRTLKTVATKHGVSIPTVAVKYVLDQPAVAGSMVGVRLGLSEHINDSNAVFSLVFDEDDVNSIQEVLKKGKDLLRVIGDCGDEYRRA

SEQ ID NO: 84928 - protein, 482 aa, Oryza sativa
  misc_feature (40)..(40): Xaa can be any naturally occurring amino acid
MSDVRSRRSVASSTRRQQDAELAAAEERRRATAQTATAAXARAARLAAAELAAVRAEVEAEAAEDAARAAEVEVETLRSSINGSIAGDITADRELEELARGGARERAERWAAAHLHGGGGDPRDRALADGNPDGRGRAGGSPEPARGPRRQRGSPSPDRRHGHHGVQTVVRDFGPGGGWPTLTKTNYIEWAAVMRVRLQVWHMWEAVRYGDVDYNEDGKEPRLPRTEQAHPGEFHLFRTASTPLAYFSVARTAAFGCPLGQHPIQISNFRLGGCSNRLAASYGYIYMYPTSLGYEYYFALLRDFPDVQFTLNGGITTIDQVTASIRQGAHRVMVGRAAYNNPWNMLGHVDSEVYGMPTRRSSRRQILESYQVYGDSIMGQYGPSRPNVRQLVKPLLNLFHSEPGNGLWKRKADSTLRHCKTLESFLEETLDAIPNSVLDAPIGKEAYIEEGHFADMDSLLPPRYSSLTNGSCEIPALVTAST

SEQ ID NO: 84929 - protein, 288 aa, Populus tremula x Populus tremuloides
MEGKEEDVKLGANKFSERQPIGTSAQTDKDYKEAPPAPLFEPGELKSWSFYRAGIAEFIATFLFLYITVLTVMGVTKPGTSKCSTVGIQGIAWAFGGMIFALVYCTAGISGGHINPAVTFGLFLARKLSLTRAVFYIIMQCLGAICGAGVVKGFQGSHNFELQGGGANVVNHGYTKGDGLGAEIVGTFVLVYTVFSATDAKRNARDSHVPILAPLPIGFAVFLVHLATIPITGTGINPARSLGAAIIFNKDHAWDDHWIFWVGPFIGAALAAVYHQIVIRAIPFKSRA

SEQ ID NO: 84930 - protein, 278 aa, Populus tremula x Populus tremuloides
MEGKEEDVRLGANKFNERQPLGTAAQSQDDKDYKEPPPAPLFEPGELTSWSFYRAGIAEFMATFLFLYITVLTVMGVVKDPTKCTTVGIQGIAWAFGGMIFALVYCTAGISGGHINPAVTFGLFLARKLSLTRAVFYMLMQCLGAICGAGVVKGFYGKTNYELHNGGANMVAHGYTKGDGLGAEIVGTFILVYTVFSATDAKRSARDSHVPILAPLPIGFAVFLVHLATIPITGTGINPARSLGAAIIFNKDSAWDDHWIFWVGPFIGAALAALYHRL

SEQ ID NO: 84931 - protein, 350 aa, Pseudomonas fluorescens PfO-1
MQHNKNNNSGWMMPAEWVTHAATWMVWPHNQALWESGWGVTLPLVQEDFARVANAIARFEPVKMVVDPSAIASAKALCGPNIELIPLAVNDSWCRDSGPSFVVHPEQGLAGVSWRFNAWGGKSAHDLDESLARRVLNHLGGECFGTALSNEGGAIHVDGEGTLITTESVLLNPNRNPGVSKAEMEEIFSRLLGVKKTIWLPGDPDYVTGDMTDGHVDGVCAFARPGVLLVDATHDCSSVYAEVVRENRRALELATDAQGRKFELIELYEATDAVDTEAEVFCASYTNFYIANGAIIMPAYGIEADHVAAQTLAEAFPGREVVPVQINHLAHGGGGVHCITQQQPAWPVEG

SEQ ID NO: 84932 - protein, 755 aa, Agrobacterium tumefaciens str. C58
MRDLSAGPRVLLKRLREMMAEHLEPQERLDQIVRQIASNMVAEVCSVYVLRSDSVLELYATEGLNKDAVHLAQLKMGQGLVGTIAASAQPLNLSDAQAHPAFRYLPETGEEIYHSFLGVPILRSGRTLGVLVVQNKASRTYREDEVEALETTAMLIAEIVASGELKKITRPGVELDLTRAVSIDGDAYGEGIGLGHVVLHDPRIVVTNLLNEDADTEIRRLADAIGSLRLSIDDMLQRRDVPTEGEHREVLETYRMFAHDQGWVRRMEEAIRNGLTAEAAVEKVQSDTKARMMRLTDPYLRERMHDFDDLANRLLRQLIGFGGHNPAQDFPLDAIVLARAMGAAELLDYPREKLRGLVLEDGAVTSHVVIVARAMGIPIIGQATGIVALAENNDPIIIDGDDGQVHLRPMSDLQRAYEEKVRLRAKRQEQFRALRNVEPITKDGQKVNLKMNAGLLVDLPQLEESGADGIGLFRTELQFMIASNMPKGEEQEAFYRSVLRQAKGKSVTFRTLDIGGDKVVSYMRGQEEENPALGWRAIRLSLDRPGLMRTQMRALLRAASGAELRMMLPMVTEVSEIRAARDLLQKEVQHLSKFSHALPKKLQFGAMLEVPSLMWQLDELMQEVDFVSVGSNDLFQFSMAVDRGNARVSDRFDNLGKPFLRILRDIVRAGEKHHTAVTLCGEMASKPLSAMALIGLGFRSVSMSPTAIGPVKAMLLGLDAANLAEELNAALDDHNSLESAREVLLRFAATHSIPI

SEQ ID NO: 84933 - protein, 275 aa, Geobacillus kaustophilus HTA426
MNGLQDCATLHNGVKMPWVGLGVYKVKEGEEVRSAVRTALEIGYRHVDTAAFYENEEGVGRAIRESGIPREQVFVTTKVWNTDQGYETTLKAFDKSLKKLGFDYVDLYLVHWPVKGKYKETYKALEKLYKDGYVRAIGVSNFHIHHLQDVLADCEIKPMVNQVEYHPRLTQKELLTFCRENGIQLEAWSPLMRGEILSEPTIIDIGRKYGKTPAQVVLRWDLQHGVVTIPKSVTPARIKENADIFDFSLTDEEMKQIDALNLNKRVGPDPDNFNF

SEQ ID NO: 84934 - protein, 546 aa, Lophopyrum elongatum
MGLDLGAIALKYTGLAVSDHGSIVAITMFIALLCGCIVFGHLLEGNRWVNESTTALVLGLITGGVILLCTKGVNSRILIFSEDIFFIYLLPPIIFNAGFQVKKKQFFRNFATIILFGAAGTLISFVIITLGAMGLFSKLDVGPLELGDYLAIGAIFSATDSVCTLQVLNQDEAPLLYSLVFGEGVVNDATSVVLFNAIQNIDINHFDVFVLLQFIGKFLYLFFTSTVLGVAAGLLSAYIIKKLCFARHSTDREVAIMILMAYLSYMLSMLLDLSGILTVFFCGIVMSHYTWHNVTESSRVTTKHTFATLSFIAEIFLFLYVGMDALDIDKWKLASSSPKKPIVLSAVILGLVMVGRVAFVFPLSFVSNLSKKESHPKISFNQQVIIWWAGLMRGAVSIALAYNKFTTSGHTAVRVNAVMITSTIIVVLFSTMVFGLLTKPLINLLVPPRPGTAADISSQSFLDPLTASLLGSDFDVGQLTPQTNLQYLLTMPTRSVHRVWRKFDDKFMRPMLGGRGFVPFVPGSPIERSVHGPGLLGTVTEAEDRS

SEQ ID NO: 84935 - protein, 328 aa, Streptomyces avermitilis MA-4680
MTWLITGGAGFIGAHVVRTMLEAGERVAVYDDLSTGDPGRTPEGVPFVKGSTLDGGLLRRTLADLHITGVVHLAAKKQVAESVERPLYYYRENVHGLETLLDAAAETGVRNFLFSSSAAVYGMPDVKVVTEDTPCAPINPYGETKLAGEWLVRAAGRAHGMTTASLRYFNVAGAADERLADTGVFNLIPMVFEKLTQGTAPVIFGDDYDTEDGTCVRDFIHVEDIASAHLAAARALTGREPGSDLTVNIGRGEGVSVREMIELIGEVTGYGADAAPVSAARRPGDPARVVAAADRIQAELGWSARYDARAMVASAWAGWCARHPQARR

SEQ ID NO: 84936 - protein, 496 aa, Austromuellera trinervia
MRINPTTSGPGVSALEEKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNL

SEQ ID NO: 84937 - protein, 1028 aa, Magnaporthe grisea 70-15
MRQPTRPQKQYRTIRTRIQLPGSIAKSQQSASPSVHDAGTEQTHKATAAVRRPSLAINPSSNHAAIDPLSQLRNPTSKPDASATLDGQRLGGDGTDNPDKKRPRPSFLSRLGMRANRLRNDDDDSGSDVGSQRPDGNNARVFASPVGAQGYIPHHKEPPRYIRTKVYNKKEREFNRMFLAQELVGTRPLAQAKTDEKVPVVTVSTADGTSRRAERTGGAVWATEFSRDGRYLAAAGKDQVVRVWAVISTIEERRTREDEEEALHQQSSPTNSGGSRERLHAPVFREQPLREFQGHTGEILDLSWSKNNFLLSTSMDRTVRLWHVSRKECLCAFRHGEFVSKVAFHPQDDRFFLAGCLDSRLRLWSIPDRAVAFEAQTNDMITAVAFTPDGKTAIAGMLNGVCNFYDTEGLKFQSLLHVRSSRGKNAKGSKITGIRTAEVPTGRGSSDMKVKVLVTSTDARVRVYNLGDKALDVKFKGHEHTAAQLSASFSHGANYVICPSEHRKVFIWSLGSPNQRALNVSNPGGIGTDTLKGDKGPCESFAAHGSGVTTAIFAPAETRQLLGASGDPIYDLCNPPPVTLISREEEAAAAAATSSSRDPSPTSPARATHNMSQTALSEAPSVARSRRADESPAYVARSTHQQGNIIVTTDDTGIIKVFRQDCAYRRREGPETASLLSRKRDSIVGRSASILTRTSASSAARSRKGSLSRSIQGIITGEGVAHSGGAISDQILDWRRDVEAKGSNGRSGSINSAAGTPVRVERSVSPIKSPLTARTLASERRREQYAHSGSPLVPRGDRGHLSPASSTFSDAHRINSEAAMATGSVTPAGTGKPANDDASKKPLDQPSSCSSKKEETTADGQKKPSGEDETLGDGEGVTPAPSTPSGVGTGTSTSDGQGSVPGGYPNVRASSDLSIKEKIKEASKMSKEKGKEKEKEKERKARTPPLQMPSFSDKSPPRQTQAGGGGLSTKDKRSSEGAVDSEEDMACPRCGAREFKAKKLGSGQQQQRQRLVCATCATPAAEQEDFAF

SEQ ID NO: 84938 - protein, 518 aa, Zea mays
VSLHLSPLPPLPATASSPSSPPPTRRPPPFARPRPQGLSSSSVQYCRLAERWGMAKPTPVASAEEAAAMRRRLRRLVAAVAAGSADAEAFDEAAEALAKLRDAELAPRKDRTSDGRENKRSTEAAVPEHFLCPISSEIMRDPVVLASGQTYDRRFIQEWLSAGNRTCPQTQQVLSNTIITPNHLVRSMISQWCTDNGITLPPVENQDEDLVTNNERETFRKLFERIVSSSSDLSEQREAIKELRLRTKCNSSLRAAIGERPDSISQMISVASSPELENSAEVVEDTVTAILNLSIHESNKKIIGDDPLAVPFLIKALQSGTMEARSNAAAAIFSLSALDGNKARIGELGAMRPLVELLEHGSTAARKDAASAIFNLCTLHENKSRATKSGAVDVTLRAVACAGDGSGSGSLVDESLAVLALLSGDHEAVEEVGETGGVASMLHVVKDDPCKRNKENAAAVLFAVCVYDRTRLREVAEHEKLNGSLGWLARNGTSRARRKAAGILDKMKRSMHHPHYSC

SEQ ID NO: 84939 - protein, 364 aa, Bifidobacterium longum DJO10A
MSLTIGIVGLPNVGKSTMFNALTRNNVLAENYPFATIEPNTGIVPLPDKRLPVLAKLVHTEKVVPATVTFVDIAGIVKGASEGEGLGNKFLANIREADAICEVVRAFEDDDIVHVNGKVDPADDIDTINTELILADLQTIENALPKLEKDLRGKKIEPAYMDAVKQAKTILEAGETLDKAAREGRFDKDSVYDLHLMTAKPFIYVFNVDDNELANKDLQAKLAASVAPAPAVFLNAQFEADLTELDEADAREMLADAGLSESGLDQLARVGFDILGLQTFLTAGVKEVRAWQIHKGWTAPQAAGVIHTDFEKGFIKADIVSYDDFVAADGSMAKIKEEGKLRQEGRDYVMADGDIVEFKFNVSK

SEQ ID NO: 84940 - protein, 642 aa, Streptomyces avermitilis MA-4680
MPLLTRIRGPRDLDRLSLEQLDQLAEEIRTFLVDAVSKTGGHLGPNLGVVELTIALHRVFDSPKDRVLFDTGHQSYVHKLLTGRQDFSKLKMKGGLSGYPSQAESEHDVIENSHASTVLGWADGLAKANQVLERDDHVVAVIGDGALTGGMAWEALNNIAAAKDRPLVIVVNDNERSYAPTIGGLANHLATLRTTDGYERFLARGKDLLERTPVVGRPLYETLHGAKKGLKDFIAPQGMFEDLGLKYVGPIDGHDIEALESALARAKRFGGPVIVHCLTEKGRGYQPALQDEADRFHAVGKIHPDTGLPIASSGADWTSVFGEEMVKLGQERKDIVAITAAMLQPVGLDKFAKVFPKRVYDVGIAEQHAAVSAAGLATGGLHPVFAVYATFLNRAFDQVLMDVALHKCGVTFVLDRAGVTGTDGASHNGMWDMSILQVVPGLRLAAPRDADQVRAQLREAVDVDDAPTVVRFSKGAVGPAVPAVGRIGGMDVLREPGTDAPDVLLVSVGALAPMCLEIAGLLDKQGISATVVDPRWVKPVDEAMAPLAERHRVVVTVEDNSRVGGVGSAIAQALRDAGVDVPLRDFGIPPRFLDHASRGEVMAEIGLTAPDIARQVTGLVSKLDGRFERPTAEIDSVEPARD

SEQ ID NO: 84941 - protein, 266 aa, Bifidobacterium longum DJO10A
MSNPTIGFIGYGNMAQAIAEGLVAAGAVDGADIVACAAHYDKLEKTTMKVGAKPLHNAAEVVAASDMVVIAIKPYQIESVIKPVIGAIADEDKFVVSIAAGWDLDKYRDLFGADFNAAHIQCTIPNTPMAVGKGVLVTEADNTLTDTQAEVFERLFSSISLIERVDSAHMGIGMCIAGCAPAFTDMYIEALGDAGVKYGLQRATAYRLAAKMVEGVGALYLKNETHPGVMKDAVCSPGGTTIKGVTSLEESAFRGAVIKAVDAIEA

SEQ ID NO: 84942 - protein, 335 aa, Xanthomonas axonopodis pv. citri str. 306
MTQTITVIRGDGIGPEIMDATLFVLDALQAGLTYEYADAGLVALEKHGDLLPESTLASITKNKVALKSPLTTPVGEGFSSINVAMRRKFDLYANVRPAKSFPNTKSRFADGVDLITVRENTEGAYLSEGQTVSEDGETAFSGTRITRKGSERIVRYAFELAKSTGRKKVTAVHKANIIKSTSGLFLKVARDVAAQYPEIEFQEMIVDNTCMQLVMRPEQFDIIVTTNLFGDIISDLCAGLVGGLGLAPGANIGLDAAIFEAVHGSAPDIAGQGKANPCALLLGAAQMLDHIGQPQNAERLREAIVATLEAKDSLTPDLGGTGNTMGFAKAIASRL

SEQ ID NO: 84943 - protein, 652 aa, Arabidopsis thaliana
MEKIELPIHKHPLLPITRFFSRHGCNGCGSDGYIYGGYHCNELGCETPAFHRECAESLQEIKHFSHPDHPLNLRLNDKASTCNRCGIHLLRKTYIYVCSICDFKLDLHCAKDAAPLPILENYNLHEHPLKLFDVSKSLKRVRLRECKTCDSPFLIEKLCYICYQCKILFHASCAEFFPEANHTSHPQHPLKLLKFAEAPDYADKKCLLCDEKFDQDQGLHHCDVCNFSICRACMKNPPPVGVESPTTHEHQLHLVPRRIHFTCNACGTLGEQSPYFCLQCNFMIHRQCIDLPRVININRHDHRISYTRRIRHGKGICKVCRKMVDGFYGGYICVKCLSFAIHARCATREDVWEMVELEGTPEEDEIGPFEVIDDNTIKHFSHDHNLRINNDGDGQILHENIVCEACALQILSEPFYSCKQCNFKLHQKCANHPRKKHHVYRNLPFTLLTSGNEIFQCWLCLQEFNGFMYQSGHYVIDVRCAAISDTLEYKSHQHSLYYYSTTYTHCSRCGKKDSVFRCDECDYGLGGKCAILPGKVMNNRYDDHPLFLSFDEMNVDGEYWCEACETKVNSKEWFYTCNDCGTTLHISCVVGDFSYIKHGSHLMNTKVVSNTSICRPFCFVCNSRCKLPSILKLSKGGVNVYICSFKCRLETY

SEQ ID NO: 84944 - protein, 175 aa, Zea mays
TRPDHFNASDANADGFLDKTEFNDFLNPSDSDNPKIINLLCKQEIRQRDKDGDGKLNFEEYFTGLHDHIHGYDDENADISQIGNITVAKDRFFKLDKDNDGFISEHELEPVLDKLYLSERYYSRQQAIHAISEADKDHDGRLTLEEMVENPYAFYGSVYLSSDDDDEDYFHDEFR

SEQ ID NO: 84945 - protein, 338 aa, Acidobacteria bacterium Ellin345
MTTLPMAHITPRKVTSVKNTNDRDLVSITDFTPEEITSALDLASAMKVHPADFRGALAGKQVVMFFEKPSLRTRITFESGISSLGGVSFFVDQGASRLGAREPLSDIAHNLERWVDGIVLRTFAHDTCSVMAEHSSIPVINALSDHEHPCQALADVLTLKEHFGSLRKLKVAFVGDGNNVAHSLMLACASVGANLTVGTPKGYEPSVQVLKQAQKIAKSTGATIDVTTDAVAAVTGAQAIYTDVWASMGQESEAAERQQIFLPFQVNAKLMSQAAKKAKFMHCLPAHRGDEVTADVIDSPSSVVFDQAENRLHAQKAILLMLLGGGTAHRFPSRSAHA

SEQ ID NO: 84946 - protein, 157 aa, Zea mays
MGGFSLSGATGLAAYREEEDEELFETSSSISGDSDDEGHQLSDGEGGAYDLSSVMAQLPVKKGLSRYYDGKSQSFACMSEVRCLEDLRKKETPYKKIKTSRSSVALDEEQDCHTPPGRTNSNKAPGSCCANLVARNNGKNMLYRPPPVPVNKSGYRQ

SEQ ID NO: 84947 - protein, 261 aa, Acidobacteria bacterium Ellin345
MKIVLKIGGAALENKDLVGQFCTTVASLAKDGHHVLVVHGGGAALSRTLKELGIEPKFLNGLRVTDARTRDVALMVLGGLLNKQLAAAIGAVGQPAIGLCGSDLHLCVARKKPLAEDLGFVGEIASVNEEAIAHLWANNAVPVVASLAQGADGEFYNINADEMASALAAACIADTLIFLTDVPGVKDANGDVLNRLGLDRIESLIANGIVSGGMLPKLEACKRALQAGVGSVRILPATKAEALPSLFESPIAFGTELVATV

SEQ ID NO: 84948 - protein, 303 aa, Ehrlichia ruminantium str. Welgevonden
MQYCILINLCFTNLFNHYILMYTLYNVVAYKTMNILLIGCGNLGSILLNKWSLNDQISDIVVVQPSLSKKNIFNTINKITFVRDHKEINKSFMPQIVVIAIKPQQVANAIPDYKAYNKSASFISLCAGIDIEFLKKHLDSTTIIRVMPNIAMSLGESVNLAYMEEEIDQEKQKVHTVFNGTGLLYWLQKEDVFDKLSPITGSGPAYFFSLAEELVKNTMKAGIREEDAITLISQTFIGSAKLLETRKDSISNLISSITSRGGITQAALEILNSHLPNIMSLSLKSATERLVHLKNSDDNKKNT

SEQ ID NO: 84949 - protein, 500 aa, Ehrlichia ruminantium str. Welgevonden
MGYVAHFLFSYCNMSFALKYRPSSFNDLIGQDVLVRILRNAFHLNKVPQSILLTGSSGIGKTTAARIISMCLNCISGPTSNPCNTCNNCISIKNFNHPDVIEIDAASNTSIEDVKIILENSHYVPITSKFKVYIIDEVHMLSNSAFNALLKVLEEPAPYVKFILATTEVKKIPVTIISRCQRFDLQRIPTESIVNHLRIIAKEENILFDEASIKLIAYNSDGSMRNALSLLEQSAIYSNKNLSEESTKKMLGYVNRHVLLKIIESITNGNITEALNKFEEVCNMYSPVIVLANILQMIYEICYFSITKKNDFLPASDIITSTQNNKIQSPIFLSRLWQILSKGIQEVKSSACVKQAANMLIIRLCYLSDLPSPKQIIEKLQNNVKANENGLEINRKMLLALLKTNNMEDLYNQLSKSLLEITYNNDCTSNIILNTMLPNNSQKELLNFLSNLTSKKWNICIKKNNDPCYNSQLNSTISDILQEFDGAKVINIETIKKEQQ

SEQ ID NO: 84950 - protein, 279 aa, Populus tremula x Populus tremuloides
MSKEVIEEGHTRGKDYVDPPPAPLFDMGELKLWSFFRALIAEFIATLLFLYVTVATVIGHKKNQDACGGVGLLGIAWAFGGMIFILVYCTAGISGGHINPAVTFGLLLARKVSLIRAVGYMVAQCLGAVCGVGLVKAFMKPYYNSLGGGANTVAHGYSTGTALGAEIIGTFVLVNTVFSATDPKRSARDSHIPVLAPLPIGFAVFMVHLATIPITGTGINPARSFGAAVIINDKKAWDDHWIFWVGPFVGALAAAAYHQYILRAGAIKALGSFRSHPTN

SEQ ID NO: 84951 - protein, 279 aa, Populus tremula x Populus tremuloides
MSKEVSEVGQTHGKDYVDPPPALLLDLGELKLWSFYRSLIAEFIATLLFLYVTVATVIGHKSNKDPCDGVGLLGIAWAFGGMIFVLVYCTAGISGGHINPAVTFGLFLARKVSLIRAVAYMVAQCLGAICGVGLVKAFMKKKYNSLGGGANTVAMGYNTGTALGAEIIGTFVLVYTVFSATDPKRSARDSHIPVLAPLPIGFAVFMVHLATIPITGTGINPARSFGAAVIFNNEKAWDDHWIFWVGPFVGALAAAAYHQYILRAAAIKALGSFRSNPAN

SEQ ID NO: 84952 - protein, 285 aa, Populus tremula x Populus tremuloides
MAKDMEVAEAGSFSAKDYHDPPPAPLFDAKELTKWSFYRALIAEFIATLLFLYITVLTVIGYKSQIDGSADSCGGVGILGIALAFGGMIFVLVYCTAGISGGHINPAVTFGLFLARKVSLIRAVMYMVAQCLGAICGVGLVKAFQKSYYKKYGGGANTLADGFSIGTGLGAEIIGTFVLVYTVFSATDPKRSARDSHVPVLAPLPIGFAVFMVHLATIPITGTGINPARSLGAAVIYNQDKAWDHHWIFWVGPFAGAAIAAFYHQFILRAGAVKALGSFRSAQRF

SEQ ID NO: 84953 - protein, 402 aa, Thermobifida fusca YX
MTDRPRISARIGGISESATLAVDAKAKALKAAGHPVIGFGAGEPDFPTPDYIVEAAVAACRDSRFHRYTPAGGLPELKEAIAAKTLRDSGYRVEPNQVLVTNGGKQAIYEAFATLLDPGDEVIVIAPYWTTYPESIRLAGGTPVYVVTDESTGYLATVEQLEAARTDRTKVLLFVSPSNPTGAVYSPEQVREIGRWALEHNLWVLTDEIYEHLVYGDARFSSMPVEVPELADRTVVVNGVAKTYAMTGWRVGWLIGPVDVVKAATNLQSHATSNVANVSQAAALAAVSGDLSAVEEMKQAFDRRRQTIVRMLNEIPGVVCPEPQGAFYAYPSVKEILGKEIRGQRPQTSSELASLILEHAKVAVVPGEAFGTPGYLRLSYALSDADLVEGVSRIAKLLSEAH

SEQ ID NO: 84954 - protein, 166 aa, Alkalilimnicola ehrlichei MLHE-1
MANTDAQNDGLREKLVAINRVAKVVKGGRQFGFTALAVVGDGDGQVGFGYGKAREVPAAIQKAMEKARANMKRVHLDGGTLQYAVTANHGSSKVYMQPASAGTGIIAGGAMRAVFEVVGVQDVLAKAIGSRNPINVVRATIKGLTDVDSPDAVAARRGKKVEDIVG

SEQ ID NO: 84955 - protein, 639 aa, Vitis vinifera
MGTSEAVLPSLSTAVPHLSHSKPCLNSLNSMLHLKSGINSRRKRALGYMRLLNCSRMLRNCRRVYSIQGIDGFSHGKTKISRLESVSCKGQQAESVSGITAEDGHGTIIAPKIKEFEMVEPMRHEKGGFASNGKFAAGGTINDTLGKASIDSIEDEAWNLLRESIVFYCGYPIGTIAANDPSNSSSLNYDQVFIRDFIPSGIAFLLKGEYDIVRSFILHTLQLQSWEKTMDCHSPGQGLMPASFKVRTVPLDGDDSATEDVLDPDFGEAAIGRVAPVDSGLWWIILLRAYGKCSGDLSVQERFDVQTGIKMILKLCLADGFDMFPTLLVTDGSCMIDRRMGIHGHPLEIQALFYSALLCAREMLAPEDGSSALIRALNNRVVALSFHIREYYWIDMRKLNEIYRYKTEEYSYDAVNKFNIYPDQIPPWLVEWMPSKGGYLIGNLQPAHMDFRFFSLGNLWSIVSSLATTDQSHAMLDLIEAKWSELVADMPFKICYPAFEGQEWRITTGSDPKNTPWSYHNGGSWPTLLWQLTVACIKMNRPEIAEKAVKIAEKRISRDKWPEYYDTKQGRFIGKQARLFQTWSIAGYLVSKLLLANPDAANILVNREDSDLVSAFSSMLSANPRRKRDWKGLKQKFIV

SEQ ID NO: 84956 - protein, 428 aa, Triticum aestivum
  misc_feature (48)..(48): Xaa can be any naturally occurring amino acid
  misc_feature (58)..(58): Xaa can be any naturally occurring amino acid
  misc_feature (63)..(63): Xaa can be any naturally occurring amino acid
  misc_feature (184)..(184): Xaa can be any naturally occurring amino acid
  misc_feature (232)..(232): Xaa can be any naturally occurring amino acid
  misc_feature (234)..(234): Xaa can be any naturally occurring amino acid
  misc_feature (253)..(253): Xaa can be any naturally occurring amino acid
MAMAAAASPSKILIPPHRASAATAAASTSCDSLRLLCAPRGRRQRPRXLVARPAPRRXFLWAXRVGGRVGGRVGKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKXMMVDTTILGLDDARAKEMPYIASMGIYVISKHVMLQLLREQFPGANAXGXEGYFLVPSTGRRYRYLYRXPGEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINGDNVQEAARETDGYFIKSGIVTVIKDALLPSGTVI

SEQ ID NO: 84957 - protein, 285 aa, Populus tremula x Populus tremuloides
MGKDIEVGGEFIAKDYHDPPPAPLIDAEELTQWSLYRAVIAEFIATLLFLYITVLTVIGYKSQTDTAKNGDVCGGVGVLGIAWAFGGMIFVLVYCTAGISGGHINPAVTFGLFLARKVSLVRAILYMVAQCLGAICGCGLVKAFQKSYYTKYGGGANGLASGFSKGTALGAEIIGTFVLVYTVFSATDPKRNARDSHVPVLAPLPIGFAVFMVHLATIPITGTGINPARSFGAAVIYNEDKAWDDHWIFWVGPFIGAAIAALYHQYVLRAAAVKALGSFRSSSNI

SEQ ID NO: 84958 - protein, 498 aa, Triticum aestivum
MAMATAMAATYGAPITAPAPAAFSPRRAAGGRRVRAVTARPRPLFSPRAVSDSRNSQTCLDPDASTSVLGIILGGGAGTRLYPLTKKRAKPAVPLGANYRLIDIPVSNCLNSNVSKIYVLTQFNSASLNRHLSRAYGNNIGGYKNDGFVEVLAAQQSPESPDWFQGTADAVRQYLWLFEEHNVMEFLILAGDHLYRMDYQKFIQAHRETDADITVAALPMDEERATASGLMKIDDEGRIVEFSEKPKGEKLKAMMVDTTILGLDSERAKELPYIASMGIYVFSKDAMLRLLRDNFPSANDFGSEVIPGATEIGMRVQAYLYDGYWEDIGTIEAFYNANLGITKKPVPDFSFYDRSAPIYTQSRYLPPSKVLNADVTDSVIGEGCVINHCTINHSVVGLRSCISEGAVIEDSLLMGADYYETENDKKVLSESGGIPIGIGKNAHIRKAIIDKNARIGENVKIINVDDIQEASRESDGYFIKSGIVTVIKDALIPSGTVI

SEQ ID NO: 84959 - protein, 511 aa, Azoarcus sp. EbN1
MKARRVYAGWPKPAHFDRNLVVIGAGAAGLVSSYIAAAVKAKVTLVEKHRMGGDCLNTGCMPSKALIRSAKLLSHMRRSNEFGIRSARAEFDFADVMERVHAIIKTVEPHDSVERYTSLGVEVIEGRAKIVSPWEVEIARNDGRHETLTTRSIIIAAGARPTVPPIPGIEDVGYYTSDTIWTLHALPRRLLVLGGGPIGSELAQTFARFGAAVTLVVKGRRIMPREDAEVSEMVMARFRAEGIDLRTGHDTRRFVVENGEKILIAEHQGQEVHVPFDVLLVAVGRSAQLKGYGLEELGVPTGRTIDVNEYLQTSFPNIYAAGDVAGPYQFTHTAAHQAWYASVNALFAPFRKFRADYSAVPWATFVDPEVARVGLNEQEARERDIPFELTRFDIADLDRAIADGEAHGFVKVLTVPGKDRILGVTIVGEHAGDLIAEYVMAMRHGLGLNKILGTIHIYPTLAEANKYAAGEWKRAHAPQKLLEWVGRFHAWRRGSGGRPTAAARPATPSQR

SEQ ID NO: 84960 - protein, 611 aa, Bordetella petrii
MGAARRVSKLASRLFGTWVDDIGPATLRADALAGLLGALLVLPQGVAFATLAGLPPEYGLYSAIVPCVVAALFGSSRHVMSGPTNANSLALYAVLAPLAAAGSSAYIQLALAVTILVGILQWLVGTLRLGSLANFISPSALFGFTSGAALLIAVHALKDALGLDGIHAHAAGAVLLGVARGLGSLHWGALLVAAATIAASALARRWDRRKPYMLIGLAVGTALAAGLNAWVFEAAGRPISVLGALAQPWPPFHVPDIEWGKLPDLLGLAFALSIVALAQSISIAKAVAARSGQIIDANREFIGQGLSNIVGGFFSSYLSCGSLNRSIPNFESGARTPMAAVFAAVLLVALVMASAPLLALIPHAAIAGLLMLVAWNLLELPRWRHVARVQRSECMIALATLVATVTIRMEIAILLGTLLSLLAYLHRTSRPAMRTMGFDAHDPDRHFAVLEGRPDALPECPQLKLLRMEGSVYFGAVAHVADRLQTLRAAPDAPRHLLIMAKSMNFIDHAGALLWEDELRKRREAGGDLYFHRPRPEVVQMWRRLGFIERLGEDHIFPDKHTAIADIYMRLDPDVCAGCTARIFRECGPLGHAGQRACGNQAPASTGSLPR

SEQ ID NO: 84961 - protein, 403 aa, Acidobacteria bacterium Ellin345
MARPTVVTMPGDGIGNQVLPQAIRVLEAVGFEANYVHADIGWECWCNEGNALPDRTIQLLRKHKLGLFGAITSKPKKAADAELKPELRGKGLSYFSPIVTMRQLFNLDVCMRPCLSFPGNPLNFIRQTTCGGFEEPQVDVVVFRQNTEGLYAGVEWTNPPENVRTALASHKKFAAFANTPGEELAVSVRIITKKNAQRICEAAFKHAKKYRYKNVTICEKPNVLRETSGMMEEVAKQVQKQYPEIALWSTNIDAQTMWLTKNPEEYGVIVASNLFGDVISDAFAGLVGGLGFAASGNIGDEVAVFEPTHGSAPKYAELNPSIVNPIAMILSAAMMLDHIGESEKADRIRKAIADVVKEGKVRTYDMMRIAGGPKSLAQGAANTVQITDAILVHVETAIAAFAR

SEQ ID NO: 84962 - protein, 412 aa, Oceanicola granulosus HTCC2516
MPILVMKFGGTSVATLDRIRRAAKRVGREVANGYDVIVIVSAMSGKTNELVGWVSETSPLYDAREYDAVVSSGENVTAGLMALTLQEMDVPARSWQGWQVPLRTSSAHGSARIEEIPPANILRKFDEGMKVAVVAGFQGISPEGRITTLGRGGSDTTAVAFAAAFGAERCDIYTDVDGVYTTDPRICDKARKLDRIAFEEMLELASLGAKVLQTRSVELAMRYGVRLRVLSSFEDNDADAGTLVCAEEDIVESNVVAGVAYSRDEAKMTLISVADRPGIAAAIFGPLAEAGVNVDMIVQNISEDGRTDMTFSCPVDQVKRAEAAMEAAKESGAINYHDLVADTGVCKVSVVGIGMRSHAGVAAQMFQALKDENINIKVITTSEIKISVLIDRKYMELAVQALHDTFGLEKAA

SEQ ID NO: 84963 - protein, 518 aa, Lotus japonicus
MGYDQTRKLSDEYEISEILGRGGFSVVRKGTKKSGNEKTQVAIKTLRRLGSSPSGTGGGQKSTATVMGFPSLRQVSVSDALLTNEILVMRRIVENVSPHPNVIDLYDVCEDSNGVHLVLELCSGGELFDRIVAQDKYAETEAAAVVRQIAAGLEAVHKADIVHRDLKPENCLFLDSRKDSPLKIMDFGLSSVEEFTDPVVGLFGSIDYVSPEALSQGKITAKSDMWSLGVILYILLSGYPPFIAQNNRQKQQMIINGNFSFYEKTWKGITQSAKQLISSLLTVDPSKRPSAQELLSHPWVRGDKAKDEQMDPEIVSRLQSFNARRKLRAAAIASVWSSTIFLRTKKLRSLVGTYDLKEEEIESLRIHFKKICGNGDNATLSEFVEVLKAMKMPSLIPLAPRIFDLFDNNRDGTIDMREILCGFSSLKNSKGDDALRLCFQMYDTDRSGCITKEEVASMLCALPEECLPADITEPGKLDEIFDLMDANSDGKVTFEEFKAAMQRDSSLQDMLLSSLRPS

SEQ ID NO: 84964 - protein, 362 aa, Cryptococcus neoformans var. neoformans JEC21
MAPQTVPCQYKTGKTLGSGTYAVVKECVHITTGEYYACKVLNKKFLMGREHMVRNEIAVLKRVSAGHKNIVQLHDFFETTHNLYLVFDLCTGGELFDRICAKGSYFEKDAANIVRTVTSAVKYLHDQGIVHRDLKPENILFKSKAEDADLMLADFGLSKVLDDDKFAILTTTCGTPGYMAPEIFKKAGHGKPVDIWAIGVITYFLLCGYTPFDRDSQYEEMQAICKGDYRFEPVEYWGGVSETARQFVRDCLTVDPTNRPTVDELLNHPWLRDVEASKDEPAEAKGVDLLPNVKAAFDAKKTFRKAVLGMMAVHRLQDHSATIHGQTEAEQEKLKKEVEAFKEEAAQEDVKDVIQPGAPASI

SEQ ID NO: 84965 - protein, 751 aa, Oceanicola granulosus HTCC2516
MEDGFETDSRKLLGRLRDTMAEDSGGQTRLDKIVELIAHSMQTEVCSIYLFRDAETLELCATEGLEPGAVHQTRMRLGEGLVGRVARKRRTINTANAPAERGFRYMPETGEERYSSFCGVPIQRLGESLGVLVVQSKDAREYTADEIYALEVVAMVLAEMTELGAFVGEGAALSARHQQPVLIRGTVGQEGVVEGRVFLHEPRVVVTNPIADDPAAEKVRLNDAIERLRVTVDDLLENSGSVEAEQVQVFEAYRMFANSRSWLRRMEEDIDNGLTAEAAVEKEQSLARNRLNAAADPYLRERLHDLDDLSNRLLRILTGQGRETGAEMPENPVLVARNIGPGELLEYGKTIRGIVLEEGSVGSHAAVVARAWAIPLMVRCARITQEALNGDPILVDAEQGVVHLRPDEVVHNAFRDKLAMKNRAQERYASIRDLPAESRCGAVVSLHMNAGLMADLPSLPSSGAEGVGLFRTELQFLIRNKMPRRAELSALYARVMDAAGGKRVAFRTLDIGSDKVLPYMKPNDEPNPALGWRAIRVGLDKPGILRMQLQALIRAANGRPLTVMFPFIAQLEEFRAARAEFDKAMERERILGHPLPATVEVGAMLETPSLGYAPDVFYDEVDFLSIGGNDLKQFFFAADRENELVRRRYDTLNVSFLSFVQQVIERCIAHGTPLSFCGEDAGRPIEAVCFAAMGLRTLSMRPASIGPVKHLLRRVNLADVRAVIDEARARGDQSVRQAVMDHLRDGGFAAG

SEQ ID NO: 84966 - protein, 121 aa, Zea mays
  misc_feature (10)..(10): Xaa can be any naturally occurring amino acid
  misc_feature (55)..(55): Xaa can be any naturally occurring amino acid
QKKRVEKQDXSRLLNLKKAAQVGALSRYIQLAAKALPITRTKADLPQKSSKADLXESVSSIASSSTTSRTNIDENLPCEKPSKHPCKTTKVLPISQGKGIGHLEKHPDDEILDCLLAKNSD

SEQ ID NO: 84967 - protein, 553 aa, Candida albicans SC5314
MGFTDLYKPSESPEKRSDTNTDNLSEYSTDHEIEAGVQLDQNVKQIGIISATFLIINRCIGAGIFATGSTIYTLSGSVGTSLILWVAGTLIAFAGLLVYMEFGSVLTRNGSEVVYLQHIYKSPRFLVISSYAVYALTMPWTAGNSVVTGEYILTAAGKEVTQWNSRGIALAVVTFAFLINAINAKAGLFMANTLGSFKIVIILFIIITGWVGLGNGIKTGHFEPTHNFHNAFEGQTPTGYGICVALYNVIWSFVGYSNASYALGEVKNPMKVLKVSAPLALLGIAIAYMLVNIAYYAVVPVDVIAASKRILVADFFYYAFGSKASKAAAVFVALSAWGNVMSVIFSQGRIITQLGRSGVIPFSRFFGSSKPFNTPFTGLLEHWIIGVIFICAVPPGDSYNFILNLVSYPLNVINTLLGAGLVWIYIRKYQGKYEWNPKIKATFPVAVFFFLSSLYLVAAPYIPPSEGQSVYEKLPYWLHAVVTWGVFGLGGIYWVIWTQLLPRFGGYKLVEKEVLGEDGFWRNKIYKVSKDSTEEEIQQQVEAAVEAEGNKLK

SEQ ID NO: 84968 - protein, 418 aa, Acidobacteria bacterium Ellin345
MATSAHASVNLEAIRAQFPALSQTYNGHPRVYFDAPGGTQVPQQVIDAISGYLVHSNSNTHGQFHTSHLTDEVLEHAHAAMADMLGCDADEIVFGQNMTTLTFALSRALGRDLRAGDEIVTTLLDHDANVAPWRALEETGARVHAVKFHPEDCTLDLEDLQSKLNGRTKIVAVGFASNAVGTINPIKKIVEMAHAVGALVFVDAVHFAPHGFIDVRDLDCDFLACSTYKFFGPHMGVLFGKHEHLLRLKPYKVRPAADTLPDRWETGTLNHECIAGITACVEYLADVGLKTVKHPESRRDAIAAAYAWMKEHEHELARQLIGGLLEIPGLTFYGIRDLSRLDERTPTVSIRMAKLSPAELSKKLGDLGIYTWDGNFYAINVTEQLGVEEDGGILRIGLAHYATSAEVERLLKALREWA

SEQ ID NO: 84969 - protein, 123 aa, Glycine max
  misc_feature (92)..(92): Xaa can be any naturally occurring amino acid
MGSASSPPRALHAATQDDLKLVSAHRAVDMLESGMTLGLGTGSTAAHALDRLVDLLRNGSLHTVSWVTTSLKTEAHAARVGITMHRLADADXTNLLIHESDKVDPELTSVKGQRRPLPLEKKK

SEQ ID NO: 84970 - protein, 516 aa, Oryza sativa
MAVAAPGQLNLDESPSWGSRSVDCFEKLEQIGEGTYGQVYMAKETETNEIVALKKIRMDNEREGFPITAIREIKILKKLHHQNVIQLKEIVTSPVEGNKYKGSIYMVFEYMDHDLTGLADRPGMRFTVPQIKCYMRQLLTGLHYCHVNQVLHRDIKGSNLLIDNEGNLKLADFGLARSFSSMETSHEEVLPFIFLLLSFHCSLSLICVCRPPELLLGSTRYGPAVDMWSVGCIFAELLNGKPILTGKNEPEQLSKIFELCGTPDELIWPGVTKMPWYNNFKPQRPMKRRVKESFKHFDQHALDLLEKMLTLDPSQRISAKDALDAEYFWTDPLPCDPKSLPKYEASHEFQTKKKRQQQRQAEEAAKRQKLQHPPPHSRLPPIQNPGQPHQIRPGQPMHNAPPVAAGPSHHYAKPRGPGGPNRYPQGGNQGGYNPNRGGQGGGYGSGPYPQQGRGPPPYPGGGMGGAGGPRGGGGSGYGVGGPNYQQGGPYGASGPGRGPNYNQGGSRNQQQYGNWQ

SEQ ID NO: 84971 - protein, 183 aa, Methanosarcina barkeri str. Fusaro
MSESSIKIENVVASTKLAEEFDLTVIESKFEGAEYNKQKFPGLVYRVSDPKAAFLVFTSGKVVCTGAKNVADVHTVIGNMAKKLNSIGITTIENPQITVQNIVASADLHTILNLNAIAIGLGLENIEYEPEQFPGLVYRIDDPKVVVLIFSSGKLVVTGGKTPEDCERGVEVVRQQLDNMGLL

SEQ ID NO: 84972 - protein, 286 aa, Silicibacter sp. TM1040
MKTRDMNRDWIATAETLSSALPYLQRYDDAIVVIKLGGHAMGSDEGMESFARDVVLLRQVGVNPVIVHGGGPMINALLDKLQIKSEFVNGKRVTDAATMEVVEMVLSGMVNKRIVQAINAQGGKGIGLSGKDANLITCEATDPALGFVGTPSEVNADMLKNLFEKEFIPVIAPIGSGTAGETFNINGDTAAGAVAAALKADRLLLLTDVAGVKNAEGVVVTELKAADVEEMTAAGVIAGGMIPKTETALAAVRGGVRACTIVDGRVPNAVLLELFTDHGAGSMIRS

SEQ ID NO: 84973 - protein, 324 aa, Oceanicola granulosus HTCC2516
MGRLVNGDWQTTPSDTANKGGSFARAESSFRNWITADGSAGPSGEGGFAAESGRYHLYVSYACPWAHRALIFRQLKGLEEHIGVSVVHPYMLEDGWTFDDDWPGATGDDLHGDRFLRETYLRADPDATTKVTVPVLWDKARGTIVSNESAEIIRMFDSAFDEITGNRDRYWPEELRDEIEPVNARIYDTVNNGVYKAGFATSQEAYDEAVVALFDSLDWIEARLGEGRYLMGARPTEADWRLFTTLVRFDKVYHGHFKCNRRRIVDYPNIWAYTRDLYQVPGVAGTVQFDHIVPHYHYSHESVNPHRIIPIGPELDFEAPHRRG

SEQ ID NO: 84974 - protein, 342 aa, Rhodopirellula baltica SH 1
MAIKVAINGFGRIGRLTFRNLMERSDEFEVVAINDLTDNRTLAMLLKYDSIHGRFDGTVEYDNTSLTVNGKKIVALAERDPRNLPWKDHNVDIAIESTGFFTARSTADKPGYDSHLAAGAKKVVLSAPAKDGADLTCVLGVNDDKLSADLNCVSNASCTTNCLAPVAKVLNDSFGIESGLMTTVHAYTNDQNVQDQPHADLYRARGAAQNIIPTSTGAAKAVGLVIPELQGKLTGIAMRVPVPTGSVVDLTVNLSKEVTKEDINLAIQTAAEGPMKGILFYAVDPIVSSDIVHDPHSSIFAADFTQVLGDKGKMAKVVSWYDNEWGYSSRTADLCSKLGKML

SEQ ID NO: 84975 - protein, 453 aa, Pisum sativum
MATSTLSPSPLLLLLLLFHLVATVTSIGVNYGTLGDNLPPPATVANFLKTNTIIDSVKIFDVSPQILQAFANTGISVTVTAPNGDIEALAKIDSARQWVVTHIKPFHPQTKINYILVGSEVFHWGDSVMIRNLVPAMRTLHSALLAEGITDIKVTTAHSLAILRQSLPPSAGNSDQDTAKYFIGPMLKFLRQTRTPFMVNPYPYFGYNPKNANFALFRPNRGLFDRNTKLLYTNQFDALMDAVHSAMKALGYGDVDIAVGETGWPSVCDGWDACSVANAQSYNGQLIRHLAEGKGTPLMPNRRFETFIFALFNENQKPGPIAERNWGLFQPDFSSVYDAGILRNGQKPVAPVKGGGKMPTPRPVVGGQKWCVPKADASPGALQANINYVCSQGIDCRPIQPGGVCYAANNVKAIATYAMNAYYQANGKHDYNCDFSHSGVTTSVNPSHDNCRI

SEQ ID NO: 84976 - protein, 436 aa, Mycobacterium sp. JLS
MTTFCEPTVSDHLRSDVAQPLHGVGIVGLGYVGLPTALAIAESGVAVLGCDISESRIAAIKAQRVDLLAGDLMSLNRLLDTDLLTLTTEVAGLAAVDTVLICVPTPVDTHLVPDLTALRAACATVVDAARPGQTIVLTSTTYLGCTRELLVEPLARRGLVAGRDVFVAFSPERIDPGSPAHVPERTPRVVGGVTDACAVQATRTLVRSAASVHQVSSPEAAELTKLLENTFRAVNIALANEFSDVAKNFGVDVMEVISAAATKPYGFMPFRPGPGVGGHCIPCDPHYLLWQLKATRLPSPVTEAAMASIASRPQAVVNRAQELLAEEGRPLAGSRILVVGVAYKPAVADVRESPALHILEELHRRGAEVAFTDAMVESVWTESGHLARETDPAQGDWDLVIAHTLHPAADHTWLSTVPLLLDAAYGLPDLPQRRVL

SEQ ID NO: 84977 - protein, 563 aa, Bacillus subtilis subsp. subtilis str. 168
MSYQALYRVFRPQRFEDVVGQEHITKTLQNALLQKKFSHAYLFSGPRGTGKTSAAKIFAKAVNCEHAPVDEPCNECAACKGITNGSISDVIEIDAASNNGVDEIRDIRDKVKFAPSAVTYKVYIIDEVHMLSIGAFNALLKTLEEPPEHCIFILATTEPHKIPLTIISRCQRFDFKRITSQAIVGRMNKIVDAEQLQVEEGSLEIIASAADGGMRDALSLLDQAISFSGDILKVEDALLITGAVSQLYIGKLAKSLHDKNVSDALETLNELLQQGKDPAKLIEDMIFYFRDMLLYKTAPGLEGVLEKVKVDETFRELSEQIPAQALYEMIDILNKSHQEMKWTNHPRIFFEVAVVKICQTSHQSAADLPEVDMLMKKIQQLEQEVERLKTTGIKAAAESPKKEAPRVPKGGKSNYKAPVGRIHEILKEATRPDLDLLRNSWGKLLAHLKQQNKVSHAALLNDSEPVAAGSAAFVLKFKYEIHCKMVAEDNNGVRTNLEQILESMLGKRMDLIGVPEAQWGKIREEFLEDHQQANEGSNEPAEEDPLIAEAKKLVGADLIEIKD

SEQ ID NO: 84978 - protein, 420 aa, Triticum aestivum
MLLRPALPVAVSSTLPLFSHLAAVRRRCSIAATGMAGVSAASPAAAQIGSFLSKKPYAPPSWASHLALAPSHTFSLGHFPTPIHKWNLPNLPEGTEVWIKRDDLSGMQLSGNKVRKLEFLLSDAVAQGADCVITVGGIQSNHCRATAVAAKYLNLDCYLILRTSKLLVDQDPGLVGNLLVERLLGAHIDLVSKEEYGKIGSVALADLLKKRLLEEGRKPYVIPVGGSNSLGTWGYIEAVRELEQQIQLSGDVQFDDIVVACGSGGTIAGLALGSKLSSLTAKVHAFSVCDDPEYFYDYVQGLIDGLQSGLDSHDIVSIQNAKGLGYAMNTAEELKFVKDIATATGIVLDPVYSGKGAYAMLKDMADNPSKWKGRKVLFVHTGGLLGLYDKVDQMSSLAGSWRRMDLEESVPRKDGTGKMF

SEQ ID NO: 84979 - protein, 443 aa, Agrobacterium tumefaciens str. C58
MRIVMIGSGYVGLVSGACFADFGHDVVCVDKMPEKIEALKSGHIPIFEPGLETIVANNAKAGRLSFTTDLSAAVANADVVFIAVGTPSRRGDGHADLGYVYAAAKEIAHALDGFTVIVTKSTVPVGTGDEVERIIREENPSADFAVVSNPEFLREGAAIEDFKRPDRIVVGLSDERARPVMTEVYRPLYLNQSPLLFTTRRASELIKYAANAFLAMKITFINEMADLCEKVGANVQDVSRGIGLDGRIGSKFLHAGPGYGGSCFPKDTLALAKTAQDYDAPVRLIETTIAVNDTRKRAMGRKVINAVGGDVRGKKIAVLGLTFKPNTDDMRDSPAIAIIQTLQDGGAKVVGYDPEGMANARHLMEDIDYAAGPYEAAEGADAVVIVTEWNQFRALDLPRLKAIMKSPVLVDLRNIYRTDEVAGHGFIYAAVGRPHEGSSGNDT

SEQ ID NO: 84980 - protein, 339 aa, Agrobacterium tumefaciens str. C58
MRYLVTGTAGFIGFYVAKRLLDAGHFVTGFDGMTKYYDVSLKEKRHAILARSNGFRAEIGMLEDTDALKRAAEAAEPEIIIHLAAQAGVRYSLENPRAYIDSNLIGSFNMLELARSLKVKHLMLASTSSIYGANEKIPFAESDKADEPMTLYAATKKSMELMAHSYAHLHKLPTTAFRFFTVYGPWGRPDMAPIKFVDAVSNGQPIDIYGQGNMSRDFTYIDDLVEGIVRLSAVIPSEENRVTQEGVTDTLSHHAPFRVVNIGGGQPVELMHFVETIEKAVGKPAIRNMLPMQQGDVPRTFASPDLLRALTGYVPQTPVEEGIKALVAWYRGINGNLTE

SEQ ID NO: 84981 - protein, 507 aa, Mycobacterium sp. JLS
MTGLPHYRMYVDGEWRDAAESIEVRSPATGAPVATVAYGDLTAVDDAVAAARAAHEAGVWRSMPPQQRADLLDAIADKLAARSDELTALQVRENGATVRGAGAFLIGYAIANLRYFASLARSYAFQTSGPLIEAPTLASGLILREPVGVCAGIIPWNFPLLLAVWKLGPALAAGNTVVLKPDDQTPLTLLELARAADEVGLPAGVLNVVTGPGPVAGARLAEHPDVRKIAFTGSTEVGKGVMRAAADNVKKVTLELGGKGANIVLEDADLDLAVDGSLFAFLMMSGQACESGTRLLVHESVHDEFVRRLVARAETLVMGDPMSPATDLGPLVSAKQKARVEKYIALGQEEGCRMAFQGTVPSDPALAEGHWVPPVILTGATNQMRIAREEIFGPVLVVIPFRDDDDAVAIANDSEYGLSAGVWSADNGRALGIARRLESGTVWVNDWHMVNAMYPFGGVKQSGLGRELGPGALDEYTEPKFVHIDLTNDRRKRAFAVVVSAAAAESD

SEQ ID NO: 84982 - protein, 368 aa, Mycobacterium sp. JLS
MKTKAAVLWGLHQKWEVTELDLDAPKAQEVLVKLTASGLCHSDDHLVTGDMPMNLPVVGGHEGAGVVAEVGPGVTEVEVGDHVVLSFIPACGRCTECARGRSNLCVYGAAIVAGPQLDGTYRFHSGGQDVGQMCVLGTFSEYTVVPIASVVKVDKDIPLDKAALVGCGVTTGYGAAVRTGEARDGDTVVVMGVGGLGINAVQGARLAGARYVIALDPVAYKRERSFEFGATHAAATVEEAQALITDLTRGTMADVCVVTTDSAEGAYVAQGLSLVGKRGRVVMTAIPHPTDTTVDMSLFDLTLYEKQVRGCLFGSSNPRLDIPRMLELYGSGRLMLDELITREYTLDEINQGYEDMHDGRNLRGLIRF

SEQ ID NO: 84983 - protein, 480 aa, Oceanicola granulosus HTCC2516
MSQPHRPHGEPSFRQSVDIMFNRAVALMDLPPGLEEKIRVCNATYTVRFGVRLRGGIHTFTGYRSVHSEHMEPVKGGIRYAMSVNQDEVEALAALMTYKCALVETPFGGSKGGLRIDPREWEEDELERITRRFAYELAKRDLIHPAQNVPAPDMGTGEREMAWIADQYRRMNTTDINANACVTGKPLNSGGIAGRVEATGRGVQFALREFFRHPDDINAAGLSGTLEGKRVIVQGLGNVGYHAAKFLQEEDGCRIVGIIERDGALTAPDGLDVDDVHAWIGEHGGVTGYPRATYTPEGDAVLEATCDILIPAALEGVIHKDNAARIQAPLIIEAANGPITAGGDEILREKGCVIIPDMFANAGGVTVSYFEWVKNLSHIRFGRMQRRQEEARHELIVRELERLSADRDLGWELSPNFKDRYLKGAGELELVRSGLDDTMRTAYQAMSETWHGRNDVHDLRTAAYLVSIERVAASYRAKGL

SEQ ID NO: 84984 - protein, 467 aa, Oryza sativa Indica Group
MALASPGEEAGGGGAAAAAAGGGGGVGAEGVVRGGGGGGERRGGGGRRAGRALLHSSHMYHEAKSSFAHHGVKFSNLEVDLPAMMAQKDKAVAGLTKGIEGLFKKNKVTYVKGFGKLASPSEVSVDLSDGGSTVVKGKNIIIATGSDVKSLPGVTIDEKKIVSSTGALCLSEIPKKLVVIGAGYIGLEMGSVWNRLGSEVTVVEFAPDIVPSMDGEVRKQFQRMLEKQKMKFMLKTKVVGDDTSGDGVKLTLEPAAGGEQSVIEADIVLVSAGRVPYTAGIGLESVGVETDKAGRILVDKRFMTNVNGVYAIGDAIPGPMLAHKAEEDGVACVEFIAGKEGHVDYDTVPGVVYTHPEVASVGKTEEQVKALGIPYRVGKFPLLANSRAKAIDDAEGLVKVVAEKETDKILGVHIMAPGAGEIIHEAVLALQYGASSEDIARTCHAHPTVSEALKEACLQTFTKAIHI

SEQ ID NO: 84985 - protein, 852 aa, Arabidopsis thaliana
MPVNHRFTFSYRLLFLIFLLSFETAQRLVTGDPNDEACLTNLRQSLEDPANNLRNWTKSFFINPCSGFSSYLHGVICNNGRIYKLSLTNLSLRGSISPFLSNCTNLQSLDLSSNQISGEIPPQLQFFVNLAVLNLSSNRLSGQISPQIALCAYLNVIDLHDNQLSGQIPFQFGLLARLTAFDVSNNKLSGQIPSNLAMRNGNLPRFNASSFIGNKKLFGYPLEEMKNKGLSIMAIVGIGLGSGIASLVISFTGVCIWLKITEKKMEEEEGKITLEDNFRRSNGIGLVCLEKSHNDRTKNSKYDEFASDVEKSYRILRKFHSRVPKLELALNESGVELRPGLIERVLNRCGDAGNLGYRFFVWAAKQPRYCHSIEVYKSMVKILSKMRQFGAVWGLIEEMRKENPQLIEPELFVVLVQRFASADMVKKAIEVLDEMPKFGFEPDEYVFGCLLDALCKHGSVKDAAKLFEDMRMRFPVNLRVGKMMEAKYVLVQMNEAGFEPDIVDYTNLLSGYANAGKMADAYDLLRDMRRRGFEPNANCYTVLIQALCKVDRMEEAMKVFVEMERYECEADVVTYTALVSGFCKWGKIDKCYIVLDDMIKKGLMPSELTYMHIMVAHEKKESFEECLELMEKMRQIEYHPDIGIYNVVIRLACKLGEVKEAVRLWNEMEENGLSPGVDTFVIMINGLASQGCLLEASDHFKEMVTRGLFSVSQYGTLKLLLNTVLKDKKLEMAKDVWSCITSKGACELNVLSWTIWIHALFSKGYEKEACSYCIEMIEMDFMPQPDTFAKLMKGLKKLYNREFAGEITEKVRNMAAEREMSFKMYKRRGVQDLTEKAKSKQDREGKKKQRSR

SEQ ID NO: 84986 - protein, 655 aa, Arabidopsis thaliana
MATEAVDLPIHEHPLFPSARCIDDECDGCHVNGFMYAGYFCNEPYCYVWFHKDCAEAPGEISHSSHPEHPLLLTNDSKDGPCDLCGQKLLTPCYSCPTCEFKVDLTCGMKPSPPAIEHPLCHDHAVVFLKIREEKVPCELCKESIEGPSYSCLECDMYFHVNCVHLSEEVNHPCHSIHPLKLITSESLTDDAEKSCLLCGNIPAENMLYHCSVCNFTSCLGCTKNPPLLVIEHMKTHKHPLTLLPRRISCICDVCGKKCQFTAYVCLQCDFVTARKCIDRPRVININRHDHRIYLTHHLGTGYSECGVCHKNVSQYKGAYSCSVCPNYAVHSTCAVRTDVWDGVELEGTTEITEDISPFKVVGDNLICHFSHEEHQLKLHKEDVIHDERRRCEACIHPVQFGSIYVCEEEECCFVLHEKCANLPMKKRLVFGTRPYTLMKETTEITHCELCGILSDGFAYSSHEWSDVDVHCGSLNEPLVHDGHIHPLYFAKKEEHTCDGCQKSIEDYMLRCKACDFDLCLYCATLPEKIWHRNDGHPLTLCCGEKEEASGKYWCDICEKELDPSIWFYTCYDCGVTLHAQCVLGDFSRLVLGQIYSFGEKEIEFEAVPNNINTRPFCIQCNSRCKVSVILKILNDHNGYICSRSCLSSYLGEEI

SEQ ID NO: 84987 - protein, 559 aa, Melanocarpus albomyces
EPTCNTPSNRACWSDGFDINTDYEVSTPDTGVTQSYVFNLTEVDNWMGPDGVVKEKVMLINGNIMGPNIVANWGDTVEVTVINNLVTNGTSIHWHGIHQKDTNLHDGANGVTECPIPPKGGQRTYRWRARQYGTSWYHSHFSAQYGNGVVGTIQINGPASLPYDIDLGVFPITDYYYRAADDLVHFTQNNAPPFSDNVLINGTAVNPNTGEGQYANVTLTPGKRHRLRILNTSTENHFQVSLVNHTMTVIAADMVPVNAMTVDSLFLAVGQRYDVVIDASRAPDNYWFNVTFGGQAACGGSLNPHPAAIFHYAGAPGGLPTDEGTPPVDHQCLDTLDVRPVVPRSVPVNSFVKRPDNTLPVALDLTGTPLFVWKVNGSDINVDWGKPIIDYILTGNTSYPVSDNIVQVDAVDQWTYWLIENDPEGPFSLPHPMHLHGHDFLVLGRSPDVPAASQQRFVFDPAVDLARLNGDNPPRRDTTMLPAGGWLLLAFRTDNPGAWLFHCHIAWHVSGGLSVDFLERPADLRQRISQEDEDDFNRVCDEWRAYWPTNPYPKIDSGL

SEQ ID NO: 84988 - protein, 282 aa, Glycine max
MASLSLSSPPSLSSAHHNASTRLILRTPNSLKLRTPPHSLPAIRAITLTQDDLKRLAADKAVESVKSGMVLGLGTGSTAAFVVAKLGALLASGQLSDIVGVPTSKRTEEQARSLGIPLSVLDDNPRLDLAIDGADEVDPDLNLVKGRGGALLREKMVEAASDKFVVVVDDTKLVDGLGGSGLAMPVEVVQFCWKYNLDRLQELFKEEGVEAKLRLEESGKPYVTDNSNYIVDLYFKTPIRDALAAGAEISALEGVVEHGLFLNMATSVIIAAKSGVQVRLRR

SEQ ID NO: 84989 - protein, 1501 aa, Candida albicans
MAKTSQAEGQPYKGYYNNKSQGQPYHGYYSGFNKSASAQIHHLARSLTQGVQSHYDDTYTTATMHPNGINPISDKTDPTLDPESPSFSSKRWVQNMWKLYQSDSEYYKPGKLGVAYKNLRVYGDAIESDYQTTVSNGVLKYARNIFNKFRKDNDDYSFDILKPMEGLIKPGEVTVVLGRPGAGCSTFLKTIACRTEGFHVADGSVISYDGITQDEIRNHLRGEVVYCAETETHFPNLTVGETLEFAALMKTPQNRPMGVSREEYAKHVVDVVMATYGLSHTKNTKVGNDFIRGISGGERKRLSIAEVTLVQASIQCWDNSTRGLDAATALEFISSLKTSASILNDTPLIAIYQCSQNAYDLFDKVIVMYEGYQIFFGSSQRAAAYFKKMGFVCQDRQTTPDFLTSITSPAERIIKPGYERLVPRTPKEFYRYWRRSPERQALLEEIDEYLDNCENYDQKQKIFEANNAKKAKHTYNKSSYTVSLPMQVRYIMKRYWDRMRGDIIVPLSTVAGNIAMALILSSVFYNLQPNSSSFYYRTSVMYYALLFNAYSSVLEIYNMYEGRAIVQKHREYALYPPMADAIGSIISDFPLKVVCSVLFNLILYFMVNFKREPGAFFFYLLISFCSTLFMSHLFRTIGAFTNSLAEAMTPSSLLLFALSTFSGFAIPVTYMLGWCKWIRWVNPLAYAYEALISNEFHGRVFDCSNIVPSGFGYPKTGNSVVCASIGALPGEFKVDGDLYLKLAFDYSYSNVWRNFGVLMAFIIFLFGTTIFFVQTNKSSISKGETLVFRRKNIRKMRKMEEDEEAYMDGMAPLDFSGSTEISDYSYDYMDRKLLDTSNIFHWRNLTYTVKIKSEERVILNNIDGWVKPGEVTALMGASGAGKTTLLNALSERLTTGVITSGTRMVNGGELDSSFQRSIGYVQQQDLHLETSTVREALKFSARLRQPNSVSIAEKDSYVEKIIDLLEMRTYVDAIVGVPGEGLNVEQRKRLTIAVELVARPKLLVFLDEPTSGLDSQTAWSICKLIRKLANHGQAILCTIHQPSAILLEEFDRLLLLQKGETVYFGEFGANCHTLIEYFERNGASKCPQHANPAEWMLGVIGAAPGTQANQDYFETWRNSPEYRAVQNELHRLEEMPGLASGEKEPDTNQAYAASFWKQYIFVVHRLFQQYWRTPSYIYSKFAMAVLCSLFNGFTYYKSQNSMQGLKNQMLSIFSMFVVLTTLAQQYVPLFVTQRDLYEARERPSKTFSWLAFIAAQITAEIPYQVLAATISFFSWYYPVGLYRNAVYSGAVTHRGVLMWLIMTLMFIYSSTLAQFCISWNQLADYAANWISLLLTISMIFCGVIATKDSMPKFWVFLYRCTPLTYLTSAMMSIGLGDSFVKCAPTEILTFPPQTPGVQKCQDYMGAYISIAGGYLLNPEATDNCKFCIMDKTNQFLDFMNISIHNFGRDTGIFIVFIVFNMAATVFSYWLFRVPKGNREKGSFFDKLPFLNGGGDTNHENV

SEQ ID NO: 84990 - protein, 1490 aa, Candida albicans
MADADTSSNSSKTNEDRSQEGFGTYQGYTDRVASEVQELARIISHASIQQLKLKRQHSRQESQKSNEQESELSGKLGVIPVDENGNFVDQRLNPNSPEFNAAYWIQNAHKLVSSDIDYFKPVTIGVAYKNLRAYGSASDADYQSTLVNLIPKYLSLFFREYILRHTGPTFDILKPMDGLIKPGELTVVLGRPGAGCSTFLKTIASQTYGYHIDKDSVIRYNSLTPHEIKKHYRGEVVYCAETENHFPQLTVGDTLEFAAKMRTPQNRPLGVSRDAYARHLAAVVMAVYGLSHTRNTKVGNDFIRGVSGGERKRVSIAEITLNNAMVQCWDNSTRGLDSATALEFIRALKASADIVHTTPLVAIYQCSQDAYDLFDKVVLMYQGYQIYFGSAKKAKQYFIDMGYECPQRQTTADFLTSLTNPAERIVRQGFEGKVPQTPQEFYEYWKKSPEGQQIVADVDQYLTEHSSAAEKEAIKEAHQARQSDHLKPASPYTVSFFMQVRYIAHRNILRIKGNPSIHLFQIFGNIGMSFILSSIFYNLPTATSSFYHRTAALFFAVLFNAFSCLLEIFSLYEARSIVEKHKKYALYHPAADAFASIVTELPTKFIIAIGFNLVYYFMVNFRRTPGNFFFYLLINFSATLAMSHIFRTIGAATKTLQEAMTPAAILLLALTIFTGFVIPTPNMHGWCRWINYLDPLAYAFESLIANEFHNRDFECSQYVPSGGSYPTAGPNRICTPVGSVPGQDFVDGTRYMEMSFDYRNSHKWRNFGIVIGFIVFFFCTYILLCEINKGAMQKGEILLFQQRALKKRKKANNDIESGEIEKVTPEFDNEYENNQDKMLQSGGDTFFWRDLTYQVKIKSEDRVILDHVSGWVKPGQVTALMGASGAGKTTLLNALSDRLTTGVVTEGIRLVNGRPLDSSFQRSIGYVQQQDLHLETSTVREALEFAAYLRQPKSVSRKEKNEYVDYIIRLLEMEQYADAVVGVSGEGLNVEQRKRLSIGVELVAKPKLLVFLDEPTSGLDSQTAWSICKLIRKLADNGQAILCTIHQPSAILLAEFDRLLFLQRGGQTVYFGDLGKNFTTLINYFEKYGAPKCPPEANPAEWMLEVIGAAPGSKANQDYYDVWLKSSEFQEMNSELDLMSEELVKKPLDDDPDRLKPYAAPYWEQYLFVTKRVFEQNWRTPSYLYSKFLLVVTSSLFNGFSFYKADRSLQGLQNQMFSVFMFLVILHTLIQQYLPTFVSQRDLYEVRERPSKTFSWITFIAAQVTAEIPWNIICGTLGYFCWYYPVGLYQNATYTNTVHQRGAFMWFAIVLFFIYTSTLAQLCISFLEIDDNAANLSVLLFTMCLAFCGVLVTKEQLPGFWVFMYRCSPFTYLVSVMLSVGLVDAPVTCAAKEYLRFSPPQGYTCMQYMEPYMKVAGGYLLNENSTTECEFCTMKVTNVFLKMIGSDYSKRGRDIGIYIAFIGINIIGTFILYWFARVPKNFDIKLRRKR

SEQ ID NO: 84991 - protein, 342 aa, Trichodesmium erythraeum IMS101
MPLKVAINGFGRIGRLVFRAGLNYPDLIEFVGINDLVPPQNLAYLLKYDSTHGRFQGEVTASDDGIKINGKLIPCVSVKNPAELPWKEKDAHYVVESTGLFTTFDSASNHLAAGAKRVIISAPTKDPDKVKTLLMGVNHDLFDPAVDTIVSNASCTTNCLAPIAKVIDDNFGLTEGLMTTVHAMTATQPTVDGPSKKDFRGGRSAAQNIIPAATGAAKAVTLVLPHLKGKLTGMAFRVPTPDVSVVDLTFKTEKSTNYKDICAAMKTAAENSMKGILSYTEDPVVSTDFTGNSHSSIFDAGAGIELNSNFFKVVSWYDNEWGYSNRVLDLMLSMAEKEGKPK

SEQ ID NO: 84992 - protein, 167 aa, Brassica napus
AEKRGELLLDRPELLLLANSNGSPEPTTMSPRRRGRSSVSRKSLSLENIYVPDSVFGLSDKPFCSFHGHLDDVLDLAWSKSQDLLSASMDKTVRLWSLSTHTCLKVFSHSDYVTCIQFNPVDDRYFISGSLDAKVRVWSIPDRQVVDWYDLHEMVTSACYTPDGQVN

SEQ ID NO: 84993 - protein, 292 aa, Desulfovibrio vulgaris subsp. vulgaris str. Hildenborough
MPVNIRKVVIPVAGWGTRSLPATKNIPKEMLPVYNKPVVQYVVEEAQKSGIGDVVFVTNRDKKIIEDHFDYNLQLESVLERAGKTEMLRQVREVAEMVNIISVRQKKQLGLGHAVLCAREIVRDEPFAVMVGDDLMFGMTPGIQQLIDVAVAEHLPVIGVMEVPADKVSRYGIIAGEETAPGIYKVSRLVEKPSIAEAPSRLAIVGRYVLTPDIFDSLEKVKPGHGGEIQLTDALQNLADDRGLLAVKIRGMRFDAGDWAEYLTANIYFALQEEGLRDDLISQLRPLLPFRC

SEQ ID NO: 84994 - protein, 559 aa, Gibberella zeae PH-1
MTQVTPAMLSARASSLSLRQQAMSSSAMLNNNNAPAPASVEDKESSKSFILSDMKGRDTRDNRACASCISKLAPGEVGQVNWHLEAGQACRLCQVEKLEPEAFTKPFCDFLQENPTIFHTVDYFEKKLKALGYEHLSPRDSWAGKIQPGGKYWVTRNGSSLIAFKVGKAYKPGNGVAMIGGHIDALTAKLKPVSTKPVKAGFVQLGVAPYAGALNATWWDRDLSIGGRVVVRDEESGKTTTKLVKLDWPIARIPTLAPHFGVGMMGENNKETQAVPIIGLESSQRGAAKVLGPVGSFVNTQPPRLVELIANELKIQSYSSIINWELELYDSQPAQTGGMDREFIFAGRIDDKLCSWSALTALLASNENSDDGVIKLVALFDDEEIGSLLRQGARGNFLPSVVERTVEALNPDTYGPELISRTFSSSFFCSSDVSHSGNPNFLEKYLSQHVPELNVGVVIAADSNGHMTTDSISTAIMQRTGELGDCRTQTFQIRNDSRSGGTIGPALSSMMGVRSADVGLPQLSMHSIRATTGSLDPGLGVKFFKSFLDNWEKIDAEWH

SEQ ID NO: 84995 - protein, 333 aa, Oceanicola granulosus HTCC2516
MDHTAMTMTRTMRAIEITRPGGPEALVASNRPVPAPGYGQVLIRIAHAGVNRPDALQRAGLYKPPPNASDLPGLEAAGEVVEVGPGVETPEVGERVCALLPGGGYAEYAVTPAAHCLPVPEGMSLKEAACLPETYFTVWSNLFMRGRLQGGERVLIHGGSSGIGTTAIQLANHFGARVFTTAGSAEKCAACKRLGAARAINYREEDFVSVLREAGGAHVILDMVGGDYIARNLEALADEGRLVQIAFLQGAKAEVNFAEIMMRRLIVTGSTLRPQSDLAKARIAAELRERVWPLLAARRVGPVLDEEFELEAAARAHARMESSQHIGKIVLNV

SEQ ID NO: 84996 - protein, 338 aa, Oryza sativa Japonica Group
MVLPGSKESQNYDSNNQKVHPQPIDENMNQNLLKTYEVMVKKFQSQIQTRDTEITHLQQQIDEAKLRKSKLEKKLKQRGLLNKESEESDDEDNYFSIELTPSLFTSAVDNAYQSIHDFSKPLINMMKAAGWDLDAAANAIEPAVVYTRRAHKKYAFESYICQRMFGGFQEESFSVKAANITVSNEAFFHQFLAVRAMDPLDVLSQNPDSVFGKFCRSKYLLLVHPKMEGSFFGNMDQRNYVMSGGHPRTPFYQAFLKLAKSIWLLHRLAYSFDPKVKVFQVKKGSDFSEIHMESVVKNIILDEGAERPKVGLMVMPGFLIGTSVIQSRVYLSGVKSAD

SEQ ID NO: 84997 - protein, 208 aa, Xanthomonas axonopodis pv. citri str. 306
MSIVTKALNLVPMVVEQTSRGERAYDIYSRLLKERLIFLVGPIDDHMANVIVAQLLFLEADNPEKDISIYINSPGGVVTAGMAIYDTMQYIKPDVSTICVGQAASMGALLLASGAAGKRYALPNSRVMIHQPLGGFQGQATDIDIHAREILTLRSRLNEILAKHTGQSLETIARDTERDNFKSAVDAQAYGLVDQVLERRPEESIQPS

SEQ ID NO: 84998 - protein, 388 aa, Alkalilimnicola ehrlichei MLHE-1
MAKGRTWRVAVCPGDGIGPEVMAPTVAALRAVAGREGLALELQHYDWPSHDWHRRHGEMMPGDWREQLAAHDAILLGALGDPGPTNDPDRYLLSDGVSLAPLLQLRKGFDLWACERPAVRLPGTPQYLADPRAEELDMLVIRENSEGEYVAQGGRLAPGTAREVATQVEVFTRLATERIIRHAFERALQRAHLRQTGERPPRPFPRTGGGEANAQVCLITKRNAQAYWGEMWTEIFAEVAPDYPEIATHHELVDAACMKFVTRPWVFDVVVASNLHGDILTDLAAVLCGGMGVAPSCNINPQDRRVPPLFEPTHGSAPDIAGQGLAGPEAMLLTAAMMLDWMGEEDPAAARAGERLRLAVAADLQTGSGEARGTEAVGAAILDRLDQQ

SEQ ID NO: 84999 - protein, 471 aa, Silicibacter sp. TM1040
MASIKCDLLIIGAGSGGLSLAAGASQMGADVVLLEGHKMGGDCLNYGCVPSKALLASGHIAHTQAHAQAFGIADQAAEVDYAAAKGHVQQVIDTIAPVDSQERFEGFGVRVIREMGRFISANEVAAGDTTITARRIVVATGSSPFVPPIPGLQDVPYLTNETLWALNERPEHLIVIGGGPIGMEMAQAHRRLGSKVTVLEAQAALGRDDPEAAAFVLERLRNEGIEIREHTAAQAVRQEAGRIVVQTSAGTVSGSHLLVAVGRKPNLDGLNLEAAGVEVGRAGIKVGPDLRSSNPKVYAIGDVAGQGQFTHLAGYHASVVIRSLLFGLPAKTKTNHIPRATYTDPEIAQVGLTEAEAQETYAAKLEIARFDYSHNDRAIATRQAEGFIKVMVVKGRPVGATIAGPQAGELISTWSLAIANGMKMSQIAAMVAPYPTISELNKRVAGAYFSPRLFENSAVKRVVRLVQRWLP

SEQ ID NO: 85000 - protein, 116 aa, Glycine max
  misc_feature (49)..(49): Xaa can be any naturally occurring amino acid
ELLSGFRDNFVQQLDNSVVGIRATITRLSQLLREHDEELWRHLEVTSKXHIWDTLLSDPDGPQETLLRVCCAMLVLVRKRLLAGDFTSNLKLLQNYPTTNISHLLYVANKFRVQSV

SEQ ID NO: 85001 - protein, 427 aa, Alkalilimnicola ehrlichei MLHE-1
MSAAQETTDRQGMLSPLLKQSSGVVAERGEGAYLFDRDGTRYLDFTSGIGVTATGHAHPKVVAAIKAQADKLLHGQYAIVRHPGIMELAERLGAYMPGPIDALFFSNAGTEACEAALRLARHATGRPNIIVFHGGFHGRTMGSLSMTTSSVGLRAGLQPMMGGVVVAPFPNTYRYGWDEEAATDFCLRELDYIFATYSTPAETAGVFIEPVQGESGYVPANTRFMQGLRERCDQHDMLMILDEVQAGYGRTGRFWAHSHFEVQPDVVVTAKGLASGMPLSGVGAPSELMERGWAGSQGGTYGGNAVACAAALATLDVIEEEGLVHNAAEQGAYLKQRLKEVQAEFPEVADVRGMGLMIGTEMVDAEGRPDGDRAARILKAMEKRKVLMIRCGAFGGQVVRWLPPLIVSRQQVDTAVDTFIEALRETA

SEQ ID NO: 85002 - protein, 521 aa, Aspergillus nidulans FGSC A4
MSNAEELLRDFEDDEDFEGADGVEAIEEDRDEEQLLQEPAKAVTNEFEVALSTADELTRLHKSLRDHYSIRFPELETLVTNSIDYAKTVAILKNGPLTDIKALSTSADNMVGVPLKSILDGPTLMVVAVEGTTTRGREMTEAELKVVMDTCERILKLDRERTALTQSIQANMNQIAPNLAALVGPETAAQFLNQTGGLRELAKIPACNLGAQGSKRKDGLGFATNTSIRSQGFLYNSELIQDIPNDLKRQAIRIVSAKMVLAVRADVSKYSPDGSLGEDLKQQCFQRLEKLTEPPPNSGTKALPAPDDKPSRKRGGRRARKAKEAVAMTELRKAQNRVAFGKEEAEVGYGTGEGTVGLGMLGQQNDGRIRATQIDQRTRAKLSKSNKGWGAATPISGTASSLRTFGQGPSGTASVLQAKGLRSSGIGTSFGGAAGTASTIAFTPVQGLELVDPKVQAELSRKRKAEEDRWFKSGTFTQVGAQNTSKNSSETANGGFKVPALPTKKVDTGAGKMGPPPPPAK

SEQ ID NO: 85003 - protein, 1147 aa, Vitis vinifera
  misc_feature (717)..(717): Xaa can be any naturally occurring amino acid
  misc_feature (739)..(739): Xaa can be any naturally occurring amino acid
  misc_feature (808)..(808): Xaa can be any naturally occurring amino acid
  misc_feature (820)..(820): Xaa can be any naturally occurring amino acid
  misc_feature (1001)..(1001): Xaa can be any naturally occurring amino acid
  misc_feature (1042)..(1042): Xaa can be any naturally occurring amino acid
  misc_feature (1058)..(1058): Xaa can be any naturally occurring amino acid
  misc_feature (1075)..(1075): Xaa can be any naturally occurring amino acid
  misc_feature (1090)..(1090): Xaa can be any naturally occurring amino acid
MAAKKVIAICQSGGEFVTNKDGSLSYNGGEAYAIDVDQQTQLSDFKLEVAEMFNCSIDTMSIKYFLPDNKKTLITISKDKDLKRMVKFLGDSVTVDIFIMTEEAVPRNQSIMPASRLMLFRMLTFRVQFGAQLQSSRTTVSEAVVPAVAPVDAVVDMTHAIDKVDMDMANYTHSDNAPVISNDDKHQKAAQQWENTITGVDQRFNSFNEFREALHKYSIAHGFAYKYKKNDSHRVTVKCKSQGCPWRIYASRLSTTQLICIKKMHTTHTCEGAIVKAGYRATRGWVGTIIKEKLKVSPNYKPKDIADDIKREYGIQLNYSQAWRAKEIAREQLQGSYKEAYSQLPFFCEKIKETNPGSFATFETKEDSSFHRLFISFHAAISGFQQGCRPLLFLDSTPLNSKYQGMLLTATAADGDDGVFPVAFAVVDAETDDNWSWFLLELKSAVSTARPITFVADFQKGLKKSLAEIFDNGYHSYCLRYLTEKLNKDLKGQFSHEARRFMINDFYAAAYASRLETFQRCTENIKGISPEAYNWVIQSEPDHWSNAFFGGARYSHMASNFGQLFYNWVSEANDLPITQMVDVLRGKMMELIYKRRVDSSQWITKLTPSKEEKLLKDTSTARSLQVLLSHGSTFEVRGESIDIVDIDHWDCSCKDWQLSGLPCCHAIAVFEWIGRNPYDYCSRYFTVESYRLTYAESIHPVPNVDRPVKTESTQVGXIVTPPPTKRPPGRPKMKQAGSXETIKRQLQCSKKLSSLLAPDLEKFLTGWKMPTVVPRRCTLSNLPSMDPSPSISFSMSTPSTPQNFPEKXIFRPFSLSIVTXIQHVQFGFAFTFSTHNMVGRSYVDSAKSFVSDHQSQSTARKLDPMKTAITSLVFRQPLNFLVAVCWLTAGQCTIYSYYYDVLEYEVHELQRTPKLVLTRGCSCSHVTEEVKGQVEKAQEKAAEAEEEAKEASESWAEWAKDKISQNLRLKQEKQASDSATETADKSQDTAEEAASGAGQYXAEKADEVKKVLKEKTEETKGAASQKACDEAKEKAAEAKETXSQKVGEAKEKAGGVTXKAAEAKEKRRRLQKAEXAKEKAYHKTEEAKEXAKEKGAKAEESVSWAKEKAKESFDAGKAKAGETLEKAKERIEAAKENIGGRGGDEEL

SEQ ID NO: 85004 - protein, 194 aa, Glycine max
  misc_feature (148)..(148): Xaa can be any naturally occurring amino acid
  misc_feature (185)..(185): Xaa can be any naturally occurring amino acid
MASIFLSSPPSFSSAHHNASTHLILHTPNSLNLRTMSHSLPIRAITLTWDYLKRLAANKAVEFVKRGMVLDPGTGTGSTATFVIAKLGTLLASGQLIDIVGVPTSKRTEDKVLFLGIPLFVLGLTIDDADEVDPNLNLIKGCGGALFXKKMVEAASNKFVTDKDDTKLVDGLGGSGLAMPVEVVXFCWKYNLDQ

SEQ ID NO: 85005 - protein, 431 aa, Flavobacteria bacterium BBFL7
MTVIAKGKTKKLPLRGMMDNVMEQFNSAADHINLHLNIRKILSITNNEIIVHFPVKMDNGDVEIFTGYRVQHNNALGPYKGGLRYHPTVDIDAARALAMWMTWKTSLAGLPYGGGKGGIQLDPSKYSPSELERITRRFTFALADNIGPEHDIPAPDVNTNSQTMAWMADTYMSTRPPAERTANQHVVTGKPDGSGGLEGRDRATGYGVFLTIKFWAHKSAESLKDKRFIVQGFGNVGYWAAHFLEKEGAHLVAVQDAYGTLHNDDGIKVEDLYNYSIANKGSIVDFPEAKAIPKADFYTTDCDICIPAALGNQITSENAPYIKARLIAEGANGPTNVDGEKILLEKGVTIIPDILCNSGGVIGSYFEWLQNRNGELWQLDEVMIKLEKKMRESFNKVYTFSESEAMDMRTAAYCIAIKRIEKAYVQRGIFP

SEQ ID NO: 85006 - protein, 418 aa, Brassica napus
MEHLVGKKFRLGRKIGSGSFGEIHLGTHIQTNEEVAIKLENAKTKHPQLLYESKLYKLLQGGTGVPNIKWFGGRSDRPVLVIDLLGPSLEDLFNFCSRKLSLKSVLMLADQMITRVEYFHSKSFLHRDLKPDNFLMGLGRRANQVYIIDFGLAKKYRDNTTHQHIPYRENKNLTGTARYASMNTHLGIEQSRRDDLESLGYILMYFLKGSLPWQGLKAGTKKQKYERISEKKVSTSIESLCRGYPSELASYFHYCRSLRFDDKPDYNYLKRIFRDLFVREGFQLDYVFDWTILKYQKSQLTAPPSRGVVTPAAGTSAGEEERVRPTMDSSRRRASGALDNSAATRAPTMPRESLFAQSAGSSRRVTSEELHYAGGGVRNSAVVSMTEGKRSSSTRKQYDSAMKGIETLQVSDERFHHR

SEQ ID NO: 85007 - protein, 653 aa, Triticum aestivum
PPSRRSSPPSSRQRQARGKIGSLDLVPNSARGSFLDGYLATRTFLVGYGLSIADIVVWSNLTGTGQRWESLRRSKKYQSLVRWFNSVAAGYGDALDEVTSAYVGKRGIGKSPAPSLKEKMPGLKENTSGHEIDLPGAKVGEVCVRFAPEPSGYLHIGHAKAALLNKYFAERYKGRLIVRFDDTNPSKESNEFVENVLKDIETLGVKYDVVTYTSDYFPKLMEMAESLIKQGKAYIDDTPKEQMRSERMDGVESKRRNSTVEENLSLWKEMVNGTIRGTQCCVRGKLDMQDPNKSLRDPVYYRCNPDPHHRVGSKYKVYPTYDFACPFVDALEGVTHALRSSEYHDRNAQYYRILQDMGLRRVEIYEFSRLNMVYTVLSKRKLLWFVQNKMVEDWTDARFPTVQGIVRRGLKIEALIQFILEQGASKNLNLMEWDKLWTINKKIVDPICGRHTAVLKEKCVLLTLANGPEEPFVRILPRHKKYEGAGKKATTFANRIWLEYADASVISVGEEVTLMDWGNAIIREIKTDNGTITQLVGELHLEGSVKMTKLKLTWLSDIEDLVSLSLVDFDYLINKKKLEEDEDFLDNLNPCTRREALALGDPNMRNVKKGEVIQLERKGYYRCDVPFVRSSKPIVLFAIPDGRQKSTSIATGA

SEQ ID NO: 85008 - protein, 347 aa, Pseudomonas syringae pv. tomato str. DC3000
MPQPRPYKVALNGYGRIGRCVVRALCERGTKAGFEVVAINDLADMASLEYLTRFDSTHGRFPGEVRVEGQYLHINDHRIKVLRSATPEGIDWAGLEVDLVLECSGVYNTRDDGQRFLAAGAPRVLFSQPMASERDVDATVVFGINQQKMTGRELLVSAASCTTNCSVPLLRLLDQAIGLEYITITTIHSAMNDQPVIDAYHHEDLRRTRSAFQSIIPVSTGLARGIERLLPELAGRIQAKAVRVPTVNVSCLDITLQTARDTDAVEINRILREAATSGPLKGLLAYTELPHASCDFNHDPHSSIVDASQTRVSGPRLVNLLAWFDNEWGFANRMLDVADHFLRVADQ

SEQ ID NO: 85009 - protein, 556 aa, Frankia sp. CcI3
MSTTEPAAPVAPLDITATEEWAALTTHLREISEVSLRDLFAADPRRGETFAAEADGLYLDYSKNRLTARTVELLTALARRAGLADRIEAMFRGERINVTENRPVLHVALRAPAGTRIEVDGVDVVPDVHRVLDAMSQFADRVRSGDWLGATGERIRTVVNIGIGGSDLGPAMAYDALRDYADRSIEVRFVSNVDPTDIWEATADLDPASTLFIVSSKTFTTLETISNARAARSWLTGLLGEDAVSRHFVAVSTNAEKVAEFGIDTVNMFEFWDWVGGRYSVDCAIGLSLMIAIGPPNFREFLAGFAAMDTHFRTAPFERNLPVLLGLIGLWYRDFFGTATHAVLPYSHYLGRFPAYLQQLDMESNGKSVDLTGRPVSTPTGPIVWGTPGTNGQHAYYQLLHQGTTIVPADFIGFVRPNHPGVGTADGAGVDQHALLLANFLAQTEALAFGRTAAEVAAEGVTPDLVAHRTFPGNRPSNTLLAQKLTPFALGQLIALYEHKVFTQGVIWGINSFDQWGVELGKVLAGRIIPELGSEQEPELGHDSSTNALIKRLRAG

SEQ ID NO: 85010 - protein, 387 aa, Pseudomonas syringae pv. tomato str. DC3000
MTVLKMTDLDLQGKRVLIREDLNVPIKDGVVSSDARILASLPTIRLALEKGAAVMVCSHLGRPTEGEFSAENSLKPVAEYLSKALGRDVPLVADYLDGVDVKAGDIVLFENVRFNKGEKKNADELAQKYAALCDVFVMDAFGTAHRAEGSTHGVAKYAKVAAAGPLLAAELEALGKALGAPAQPMAAIVAGSKVSTKLDVLNSLSAICDQLIVGGGIANTFLAAAGHKVGKSLYEPDLLDTARAIAAKVSVPLPTDVVVAKEFAESATATVKLIADVADDDMILDIGPQTAAHFAELLKSSGTILWNGPVGVFEFDQFGEGTKTLAKAIAESKAFSIAGGGDTLAAIDKYGVADQISYISTGGGAFLEFVEGKVLPAVEMLEQRARA

SEQ ID NO: 85011 - protein, 237 aa, Brassica napus
MVKIAIGSLGDSFSVASLKAYLSEFIATLLFVFAGVGSAIAFGKLTSNAALDPAGLVAVAVAHAFALFVGVSIAANISGGHLNPAVTLGLAVGGNITVITSFFYWIAQCLGSIVACLLLVFVTIGESVPTHGVAAGLGAAEGIVMEIVVTFALVYTVYATAADPKKGSLGTIAPIAIGFIVGANILAAGPFSGGSMNPARSFGPAVVSGDFSQIWIHWVGPLVGGALAGLIYGDVFI

SEQ ID NO: 85012 - protein, 237 aa, Callistephus chinensis
EFPTPLTTGLQVESIVFPSSVKPPGSTNSLFLGGAGVRGMEIQGNFVKFTGIGVYLEDKAIPLLAAKRKGKTVAELLDSVEFFRDIVTGPFEKFTQVTMILPLTGKQYSEKVSEMCVGVWKALGTYTDADGTTIEKFLEVFKDENFLPGSSILFTTSPLGSLTISFSKDGTIPEAANVVLENEKLAQAVIESVIGKNGVSPATKQSLASRLSDLMKQFDEESNGSVEVEDLSKNSCK

SEQ ID NO: 85013 - protein, 299 aa, Oryza sativa Japonica Group
MGKIPGSAVAMATPPEPSSWLSLKVFFLRVSRCEVNESMLDSVTVTHAPLTPDTVLEVSGGSVASNGHVSLRLDRAGGVGAAATEGGDSCTFVSTADVRVSGSARFDVQCRGERLVVGILDTRDAGAGGGGWVMKCQVAAQRGSGLVRRGSKEAKPPVVEVYVAGLARGAPVVFTRAMQLRFRRRRHVKAFMEPIPEHGEPAEDSKETLPPKHETEVSEYRCYKPEQDAGDADYDGFYVKPAGEEDDDGDFSWFTAGVRVGVGISVGICLGIGIGAGLLARSYHSTSRSLRSRLISSLF

SEQ ID NO: 85014 - protein, 256 aa, Elaeagnus umbellata
MAPFTKSVTEVQVESVIFPPEVKPPGSSKTLFLGGAGVRGIEIQGKFIKFTAIGVYLEDNAVPSLAVKWKGKSAQELTESVEFFRDIVTGPMEKFTRVTTILPLTGQQYSEKVSENCVAAWKSLGIYSDAEAKAIEKFIEIFKDQTFPPAASNLFTQSPLGSLTMSFSKDGSIPEVGNAVLENKLLSEAVLESIIGKHGVSPEAKQNLATRLVQLLNENSTTDLNESENEKLNSNEVSKEEKPLQVEKSAFKEVEV

SEQ ID NO: 85015 - protein, 241 aa, Ipomoea purpurea
MSAPPCVAEVKVESYVFPATVKPPGTAKTLILGGAGARGLNIDGKFVKFTAIGVYLEADAVPSLAVKWNGKSVEELTDSVQFFRDIVTGPFEKLTRITMILPLSGKQYSEKVTENCVAFWKAAGMYGDAESKAIDKFNDVFSDQMFPPGASIFFTQSPLGSLTVSFSKDGSMPEIASAVIENKPLSEAVLESIIGSKGVSPEAKQSLAVRLSEMFINGGDAISGKVGVENDVIPQTVVVSK

SEQ ID NO: 85016 - protein, 224 aa, Pueraria montana var. lobata
MAAAAAVATISAVQVEFLEFPAVVTSPASGRTYFLGGAGERGLTIEGKFIKFTGIGVYLEDKAVSSLAAKWKGKPSEELVETLDFYRDIISGPFEKLIRGSKILPLSGVEYSKKVMENCVAHMKSVGTYGDAEAAAIEKFAEAFKNVNFQPGATVFYRQSPDGVLGLSFSEDVTIPDNEAAVIENKAVSAAVLETMIGEHAVSPDLKRSLASRLPAVLSHGIIV

SEQ ID NO: 85017 - protein, 647 aa, Oryza sativa Indica Group
MGEVATTTLLLTSHEAKPAKAPSIHDAIEVYIGATGARQLLKAMLLAFAWAFDAQQVFMSVFTDAEPPWHCTGVVDAVAAVAGDSGSSCSSPATSASPCALPLGTWEWDRLAKTSVVSDWALNCSGGGPALVSLPASSFFTGNLVVVLPYSLISATTTPLLTSHEAEPSIDDVIEAYIGATGARQLLKAMLLAFAWAFDAQQVFMSVFTDAEPPWHCTGVVDAAAAAAADSGSSCSPPAASASPCALPPGTWEWDRPAETSVVSDWALNCGPALVSLPASSFFAGNLAGGFLLATLADTHLGRRKMLLLSLVTMSVAAELTAFSPNVWVYSALRFVSGFGRSMVGTSAMVLSTELVGKRWLRGIRLLLRRESPRWLLVRGRKQEAIEAVRQIASLNGGGGGITTSSFSMLDACAVELGDGGEGMFATLHSIWERRWALRRLAAITAASFGVGMVYYGMPLNVGSLSPSNLYLSVAYNAVAELPSSILAWLLMGRWFNRRGSVVALTTASGLCSLAACVPAVVLPDGARLAAEVASFFASCTAYDMMLMYTIELFPTSVRNSAVGLVRQAVALGGVVAPVLVAVGRETTSYWSSSFGLFGLAVGCLGLLVTCLPETRGRRLSDTMEEEEAAILSSSGASDMENNGELV

SEQ ID NO: 85018 - protein, 247 aa, Raphanus sativus
MSSSDCPSPLPTAPKLQVDSVTFPPSVISPASSNTLFLGGAGVRGLEIQGKFVIFTVIGVYLDPVSVPSLSVKWEGKTTEELTESVPFFREIVIGAFEKFIKVTMKLPLTGQQYSEKVTENCVAIWKSLGIYTDSEAKAVERFLEVFKDETFPPGASILFALSPEGSLTVAFSKDDSIPETGKAVIENKLLAEAVLESIIGKNRVSPGARLRVAERLAQLMKENKVEEDATKTDQEEANDLSLAKEN

SEQ ID NO: 85019 - protein, 404 aa, Vibrio parahaemolyticus RIMD 2210633
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLIPAPDYPLWTASVALSGGNPVHYLCDEQSDWYPDLDDIKKKITPKTRGIVLINPNNPTGAVYSRDFLLEVIEIARQHKLIIFADEIYDKVLYDGATHTSVATLTEDVLVMTFNGLSKAYRVCGFRGGWMFLTGPKHLAQGYVNGLELLSSMRLCANVPMQHAIQTALGGYQSINELILPGGRLLEQRNRAFELINQIPGVSCVKPKGAMYLFPKIDTKMYNIKNDQQMVLDFLKQEKVLLVQGSGFNWPKPDHFRIVTLPHVEDLETAIGRFERFLSTYSQ

SEQ ID NO: 85020 - protein, 127 aa, Candida albicans SC5314
MISMTNIFTPIEEALEAYKNGEFLIVMDDEDRENEGDLIMAAELITQEKMAFLVRYSSGYVCVPLSEERANQLELPPMLANRSDRHGTAYTITCDFAEGTTTGISAHDRALTTRSLANPIFKTTRFH

SEQ ID NO: 85021 - protein, 110 aa, Magnetospirillum magnetotacticum MS-1
MALADTTILEGLETPDRLRLLPESELQRVADAVRAEMIDAVSVTGGHLGSGLGVVELTVALHYVFDTPDDRIVWDVGHQCYPHKILTGRRDRIRTLRQGGGLSGFTKRSE

SEQ ID NO: 85022 - protein, 404 aa, Bacillus clausii KSM-K16
MAIEKSDHIIEQTNAYGAHNYHPLPVVIAEAEGVWVKDPEGNKYMDMLSAYSALNQGHRHPKIIQALKEQADKVTLTSRAFHNDQLGPWTKRVAELTGKDKVLPMNTGVEAVETAIKAARRWAYEVKGVEENKAEIIAAKGNFHGRTLNAVSLSNDPGATKHYGPFVPGIKKVAYGNVEVIREAITPNTAAMIIEPIQGEAGIIIPPEGYLQAVRDLCTENDILFIADEVQTGFARTGKMFACEWENVVPDIYVMGKAMGGGVFPVSAIAADKDIMDVFTPGSHGSTFGGNPLACAVSLAAIEVIEEENLVKKSLELGEYFTTALRAIDNDDLTAIRARGLFIGVEFNHPVRKYCEQLKEAGVLCKETHENTIRFAPPLVITKEELDWAIEKINYVLSKEKPVK

SEQ ID NO: 85023 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVVVLVGVPHKDAEFKTHPMNFLNERTLKGTFFGNYKPRTDLPNVVELYMKKELEVEKFITHSVPFAEINKAFNLMAKGEGIRCIIRMEN

SEQ ID NO: 85024 - protein, 125 aa, Rhizobium leguminosarum
  misc_feature (100)..(100): Xaa can be any naturally occurring amino acid
MNIHEYQAKALLKGYGAPVAEGVAILKVEEAEAAAKSLPGPLYVVKSQIHAGGRGKGKFKELSPEAKGGVRLAKSIDEVVAHAKEMLGNTLVTAQTGEAXKQVNRLYIEDGADIARELYCSLLVD

SEQ ID NO: 85025 - protein, 220 aa, Triticum aestivum
MDPFYTSFSDSFLSIPDHRSPVSDSSECSPKLASSCPKKLAGRKKFRETRHPIYRGVRQRNSGKWVCEVREPNKKSRIWLGTFPTVEMAARAHDVAALALRGRSACLNFADSAWRLRIPESTCPKEIQRAAAEAAMAFQNKTATTETTMVEAVKPAEETVGQTGGETMEENGVFYMAEEAVLGMPRFLENMGEEMLLPPPELGWNHNDLAGDADVSLWSF

SEQ ID NO: 85026 - protein, 388 aa, Phytophthora nemorosa
LGEYRAAVPSGASTGEFEALEMRDGGKAYMGKGVLNAVKNVNEIIAPALVGKDVTKQTELDRYMVEQLDGTQNEWGWCKKKLGANAILGVSLALCRAGAAAKKQPLWQYIADLAGNPSPCLPVPSFNIINGGSHAGNKLAMQEFMILPVGATSFTEAMQIGSEVYHNLKKVIKGRYGLDATAVGDEGGFAPNIQSNGEAIDLIEEAIKTAGYTNQVRLGMDVAASEFFTGAKDARYNLDFKNENAPESEKIPAEKLQEVYEGFIAKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 85027 - protein, 78 aa, Agrobacterium tumefaciens str. C58
MSDIAERVKKIVIDHLGVDADKVVEGASFIDDLGADSLDTVELVMAFEEEFGVEIPDDAADSILTVGDAVKFIEKAQA

SEQ ID NO: 85028 - protein, 392 aa, Phytophthora europaea
LVTEIGEYRAAVPSGASTGEFEALEMRDGGKAYMGKGVLNAVKNVNDIIAPALIGKDVTKQAELDRYMVEELDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKNRYGLDATAVGDEGGFAPNIQSNGEAINLIEEAIKAAGYTNQVRLGMDVAASEFYTGAEDARYNLDFKNENAPESEKISADKLQEVYEGFIAKCADSSKIVSIEDPFDQDDWASWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 85029 - protein, 127 aa, Medicago truncatula
MASNFYSQLFLVICATLLMTTMMSSSPTVDAAGGFELGGMEWIHQTKTATCEGSIADCMLQQGEEEFQFDNEINRRILATTKYISYGALQRNTVPCSRRGASYYNCRPGAQANPYSRGCSAITRCRG

SEQ ID NO: 85030 - protein, 342 aa, Methanosarcina barkeri str. Fusaro
MSKTAAVIKGDGVGPELVDAMLKVTEAAGTDVEFVMCEAGAGWWEKHGGNSLIPNETWDVLDSSDACFKGPTTTPGGIGSPRSVAVSIRSKYNLYANVRPIKTFPNSSAPLGDVEMICVREGTEGLYIGEEIQLTDDVSIAIRKITRTASHKIASYAFEEAKRRGYDAVVPIHKSNILKLTCGSFLEEVEKVGQNYPDIEIWPYHIDNIAQQLIKNPQIFNKKVLLSTNLFMDVISEECSALVGSIGLIYSANIGDSFAMFEPAHGSAPKYAGQDKVNPVATVLAGAWMLDYLDEKEKSEAIFKATKRVISEGKYVTYDLGGNAKLSQMAGEIAKYTAEILK

SEQ ID NO: 85031 - protein, 223 aa, Arabidopsis thaliana
MTKQHANWSPYDNNGGTCVAIAGSDYCVIAADTRMSTGYSILSRDYSKIHKLADRAVLSSSGFQADVKALQKVLKSRHLIYQHQHNKQMSCPAMAQLLSNTLYFKRFFPYYAFNVLGGLDEEGKGCVFTYDAVGSYERVGYGAQGSGSTLIMPFLDNQLKSPSPLLLPKQDSNTPLSEAEAVDLVKTVFASATERDIYTVNKLEIMILKADGIKTELMDLRKD

SEQ ID NO: 85032 - protein, 261 aa, Agrobacterium tumefaciens str. C58
MEDQPKTVLVTGSTSGIGLAIAKRFAEAGFLVAVHGVETAAEGAQALEAVATVARHRPVYFSANLAHYDESAHLPEKVIAEFGHIDVLVNNAGIQKVAPIDEFDFADFSRIVAISLDSAFHTIHAALPGMKERGWGRIVNIASAHGLRASPFKAPYVATKHAVVGLTKSVALEVAEQGITCNAICPGYVWTPLVAAQVADQARVHGMSEDDVVKKVMLAPQPTRRFVQPEEVAEMALYLAGDMARSITGTTISIDGGWTAK

SEQ ID NO: 85033 - protein, 236 aa, Thermobifida fusca YX
MIRAELDKDPRDVAAMFDSIADRYDLLNRVLSLGRERYWRQATVAAVDAYSGELVLDLAAGTGTSSESFTRRGARVIACDFSFGMLRVGAERRGGASRKGVTVVAGDALHLPFADQTFDAVTISFGLRNVHDVDRALAELLRVTKVGGRLVICEFSHLPVQPLDRMLGWGMKIGLPWVARQFSDNPDAYAYLSESIAAWPDQAGLARKISAAGWSRVAWRNLTFGVVALHRAYRER

SEQ ID NO: 85034 - protein, 417 aa, Medicago sativa
ARENITPSPTASSDSVFAHLVRAPEDPILGVTVAYNKDPSPIKLNLGVGAYRTEEGKPLVLDVVRRVERQLLNDMSRNKEYIPIVGLADFNKLSAKLIFGADSPAIQENRVTTVQGLSGTGSLRVGGEFLAKHYHQRIIYLPTPTWGNHTKVFNLAGLTVKTYRYYAPATRGLDFQGLLEDLGSAPSGSVVLLHACAHNPTGVDPTLEQWEQIRQLIRSKSLLPFFDSAYQGFASGSLDADAQPVRLFVADGGELLVAQSYAKNMGLYGERVGALSIVSKSADVSSRVESQLKLVIRPMYSSPPIHGASIVAAILKDRDLYNDWTIELKAMADRIINMRQQLFDALRARGTPGDWSHIIKQIGMFTFTGLNPEQVSILTKEYHIYLTSDGRISMAGLSSKTVPHLADAIHAVVTRVA

SEQ ID NO: 85035 - protein, 524 aa, Frankia sp. CcI3
MTQRQFRLPDLGEGLTEADIVRWLAQVGDTVTVNQPLVEVETAKAVVEVPSPFAGILVETHGAEGTTLAVGAPLLTIQTADTDTYVDTDTNADGTGGNGTGANSLPTSRDAGSIERTPVLVGYGPRTAESRRRRPRRPPTPAGPVHTAGPVHTAGPVHTAGPVHTAGPVHTAGPVHTAGPVHTAGPVHTAGPVHTAGPVHTAGPVLAKPPVRKLARDLGVDLASLAGTGPDGTISRADVEAAVRAAARTAPLAAPPTRDAPPIGVIPAGATFSAETRTWHVPVTGIRRSMAQAMVASVSAAPHVTEFLTVDATATMAARDRIAALPEFTGIKITPLLFVARALLIAVRRHPMINSSWVEDAGGGRPENGGRPENGGRPEIHVYDRVNLGIAVAGPRGLVVPTIPDAGRLDVVGLAHALAGLTTAARADRLSPADLRGGTITITNVGVLGVDIGTPILNPGEAAILALGSIRPMPWVHEGQLTVRTVVQLALSFDHRIVDGALGSAVLADVGAVITDPTVALAWS

SEQ ID NO: 85036 - protein, 621 aa, Oryza sativa Indica Group
MGLAAAAAAAVRPCRRRLLSSATAAAAATVATATPLFPRCPHPHHHLHGRRLPFLASAASQQQQQSGQTAASPATPPIPSDPRAAVSGNLPFFDRVLFPDTFPVETPPPSSAAASAAAAADEEVASALKVREETEAEREAWRLLRRAVVSYCGEPVGTVAAEDPECTETLNYDQVFIRDFVPSALAFLMRGETEIVRNFLLHTLQLQSWEKTVDCYSPGQGLMPASFKIRAVPLDDNNEAFEEVLDPDFGESAIGRVAPVDSGLWWIILLRAYCKITGDNALQERVDVQTGIKLILSLCLSDGFDMFPTLLVTDGSCMIDRRMGIHGHPLEIQALFYSALRCSREMLVMNDGSKNLLRAINNRLSALSFHIREYYWVDMKKINEIYRYKTEEYSHDATNKFNIYPEQIPSWLVDWIPEKGGYLIGNLQPAHMDFRFFSLGNLWAITSSLTTPKQAEGILSLIDEKWDDLIANMPLKICYPAMEDDEWRIITGSDPKNTPWSYHNGGSWPTLLWQFTLACIKMGRPELARRAIAVAEEKLAADKWPEYYDTRSGRFIGKQSRSYQTWTIAGFLTSKMLLENPELASILTCNEDLELLEGCACCLSKKRTRCSRRAAKSHVVE

SEQ ID NO: 85037 - protein, 338 aa, Streptococcus mutans UA159
MTKILVTGGAGYLGSHTCVELLNQDYRLVVVDNLLHSSFKSLTAIKEITGKDFTFYQADIRDKKSLEAIFEKEAITAVIHFAGLKIVNESTSIPLDYYANNFSGTITLLQVMQQFSCKNFIFSSSASVYGNKAPAPVSEEAPRSVMTPYGRTKMMIEDVLMDVSVSDSAWNIVILRYFNPIGAHSSGELGEDPQGLPTNLLPYISQVALGKLDRVRVFGGDYDTKDGTGIRDYIHVVDLARGHVAALQKLVAGSGLSIYNLGTGKGTSVLELIQEMGEIVGHPIPYKIVGRRAGDIAVSYADVSKAEKELNWHARYDLKRMCQDSWRWQKKYPNGFRE

SEQ ID NO: 85038 - protein, 572 aa, Raphanus sativus
MMPKATVVLLLLVVAAVGNATAEKRQPRIVKHNGVVATDDERCSEIGTRVLRQGGNAVDASVAAALCLGVVSPASSGLGGGAFMVVKLADGDEIAYDSREVAPLRATENMYGGHVDLKRKGALSVDVPGELAGLFTAWKQHGKLPWKQLVYPAEKLAKGFKITKYLHMQMNATRGGILQDKGLSELFVSNGELKTPGTICHNPILASTLRKIAEYGPKAFYNGTVAFDIVKDVSNLGGILTLEDLRRYRVKVKRPLSTEILGYRVLGMPPPSSGGPAMMLVLNMLSPYGIPSGVSGSLGVHRLVEALKHAFAVRMNLGDPDFVDVTKVVSDMLSIEFAESLKKKINDNTTFDPKYYGGRWNQIEDHGTSHLSIIDSERNAVSMTTTINGYFGALILSPSTGIVMNNEMDDFSIPMKSDGNESVPPPAPANFIRPGKRPLSSMTPTIVLKDGKVKAAVGASGGVNIIAGTIEVYLNYFFLKRDPLSAVLAPRIYHQLVPNIVWYENWTTVFSDHFEIRKETRVVLEKKGHLLRPSPGGTIAQFVVQESGANSGGLSELVAVSDPRKGGFPSGY

SEQ ID NO: 85039 - protein, 232 aa, Bifidobacterium longum DJO10A
MDKAQQDALKKAAGIEAAKLVENGMIAGLGTGSTVKFLVDELGRRHQEEGLEFTGVTTSRRTQVQAESYGIKIVDIDDVDHIDVTIDGADEVDKNFNGIKGGGAALLWEKIVATNSNQIVWIVDESKVVDTIGKFPLPVEVIPFGAGQVIKKFEARGYKPVLRLDADGKEVRTDENNFVVDLHLERIDHPQELAEDLINTVGVVEHGLFLNMVDKVIVGDPNGPRVMTNANK

SEQ ID NO: 85040 - protein, 913 aa, Rhodopseudomonas palustris CGA009
MAKSAAKPAKKPAANAVAAPKAGKWVYTFGDGKAEGRANMRDLLGGKGANLAEMANLGLPVPPGFTIPTSVCTYFYANGKTYPKELQSQVERALDHVGKLTNKKFGDAKNPLLVSVRSGARASMPGMMDTVLNLGLNDQTVEALAEKSGDRRFAYDSYRRFITMYSDVVLGFEHHHFEEILDAYKDAKGFTLDTDLDADDWVDLVGQYKEAVARETGEDFPQDPHAQLWGAIGAVFSSWMNARAVTYRRLHDIPESWGTAVNVQAMVFGNMGETSATGVAFTRNPSTGESRLYGEFLINAQGEDVVAGIRTPQDITEHARIESGSDKLSMEMAMPEAFKELTRIYTLLEKHYRDMQDMEFTIEQGKLWMLQTRGGKRTAKAALRIAVELANEGLINRKDAVTRIEPGSLDQLLHPTIDPNAKRDVIATGLPASPGAASGEIVFSSDEAAKLHADGRKVVLVRIETSPEDIHGMHASEGILTTRGGMTSHAAVVARGMGKPCVSGCGAIRVDYGRGTMMIGNRTFKAGDIITIDGGTGQVLAGKMPMIEPELSGDFNTLMGWADEVRKLKVRVNADTPADARTAIKFGAEGIGLCRTEHMFFEETRIRTVREMILAEDEQSRRSALAKLLPMQRADFVELFEIMKGLPVTVRLLDPPLHEFLPHTQAEIEEVARAMNADPRRLADRARELAEFNPMLGFRGCRLAIAYPEIAEMQARAIFEAAVEAEKRTGEQVGLEVMVPLIATRAEFELVKARIDATAQAVNRDTGSNLKYQVGTMIELPRACLMAGDIAESAEFFSFGTNDLTQTTFGISRDDAASFLGTYIEKGIFTVDPFVSVDRDGVGELVRIGVERGRKTRAKLKVGICGEHGGDPALVAFCHEVGLDYVSCSPYRVPIARLAAAQAALGKGIASQA

SEQ ID NO: 85041 - protein, 398 aa, Methanosarcina mazei Go1
MNEQGLSEREIFSYLENAKSEDTDYYRVFSSMCTRPHKIAIEANRLFIEANLGDLGLFAGAHKLEQEVVRMLGNLLHASSIDVPSGGLCQSSVCGYLTTGGTESNIQAVRGMKNLVTAGKKEFKGTPNIVIPASAHFSFDKVADMMGIEVRRASLDSEFRVDMASVEKLINENTIGLVGIAGNTEFGQIDPIDKLSEVALENELFLHVDAAFGGFVIPFLEKPQPFDFKVPGVTSIAIDPHKMGLSTIPSGALLFRSPSFLDSLKVSTPYLTTKSQFTLTGTRSGASAAATCAVMKYLGYEGYRKNVQYCMELTSKIVEEARKLGFEPLIEPVMNVVALKVPNPDLVRERLLKKFGWNVSITRTPRALRLVLMPHNSPEDIELFLEDLKKVTAEIKSP

SEQ ID NO: 85042 - protein, 393 aa, Phytophthora multivesiculata
LVTELGEYRAAVPSGASTGEFEALEMRDGGKEYMGKGVLNAVKNVNDIIAPALVGKDVTKQAELDRFMVEELDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGTKDARYNLDFKNENAPDSEKISAEKLQEVYEGFIAKCAGSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSEA

SEQ ID NO: 85043 - protein, 402 aa, Bradyrhizobium japonicum USDA 110
MQRSQSPAGRAHQESGMSRHYDVGAVRKEFPAVERITYLDAGFQTPLARPVKAAIDLFLREGLETAGPKSVWLDRVELTREKLARFLGVAADEIAFTKNTSESMNIAANALPLRAGDKVLMIHGDHPNNAYAFLNLRRKGVTVEFVPMTEIVNADSLRPHIDASTRAISMSQVTFHAGHRFDVESVGALCDEQGLYFVVDVMQAIGVVPIDAKAMRATFIGSGSHKGLLVPQGLGLLYWDKSRIELEPAYLAAASLAEVPADLIARPDQLELAPSARRFELGNFNLPAIHALGASLDMIEALGVQNIQNHCLDLGDHLIAGLDALDVRLVGPRDRQHRAPHIYVIALPAAEWLGHFEQNGVRVSPERDGIRVSFGMFNTFADVDRLIDIIKRRGVKPSSRAA

SEQ ID NO: 85044 - protein, 393 aa, Phytophthora drechsleri
  misc_feature (235)..(235): Xaa can be any naturally occurring amino acid
LVTELGEYRAAVPSGASTGEFEALEMRDGGKDYMGKGVLNAVKNVNEIIAPALVGKDVTKQEELDRYMVETLDGTQNEWGWCKKKLGANAILGVSLALCRGGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTNQVRLGMDVAASEFYTGXKDARYNLDFKNANAPESEKIPADKLQEMYEGFISKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSER

SEQ ID NO: 85045 - protein, 340 aa, Xanthomonas oryzae pv. oryzae KACC10331
MSRARILCFGELLLRLGAPGHELLLQQPRLDVHCGGAEANVGVSLAHFGHEVAMVSTVADNPLGAAVLGELRRHDVDTRHVRRVDGRMGLYFLTTGAIHRPSEVIYDRADSAFALAPADAYDWPHLLAGVQWLHVSGVSPALGADVAQATLAAARAARAAGVKVSFDGNYRPTLWQRWQGDARGILHQLFACADVVFADYRDIGVVLGGEFAQDTPEARVEAAAQQAFAAFPQLQLMACTQRVAHHVDHHSLGAMLVPREGAVARAPSEELTPIIDRIGGGDAFAAGVLHGLIEGWSLDDTVRFGLAAGCLKHSIPGDFNPLSVADVQACVGDARFDVKR

SEQ ID NO: 85046 - protein, 627 aa, Agrobacterium tumefaciens str. C58
MITITDLSARIAGRLLLDHASVALPAGVKAGLVGRNGAGKSTLFRIITGDLAAEGGSVTIPKLARIGQVAQEAPGTEESLISIVLAADKERSALLAEAETATDPHRIAEIQMRLVDIDAHSAEARASSILAGLGFDHEAQLRPASSFSGGWRMRVALASVLFAEPDLLLLDEPTNYLDLEGTLWLEDYIRRYPHTVIIISHDRDLLNNAVNSIVHLDQKKLTFYRGGYDQFERQKAEADELQMKAKVKNDAARKHLQSFIDRFRAKATKARQAQSRIKALERMGTVAAVIEDHVQPITFPEPEKQPASPIVAINGGAVGYEPGKSILKQLNLRIDNDDRIALLGSNGNGKSTFAKFISGRLAPQAGDLRVASGLKIGFFAQHQLDDLVPDETPVEHVRKLMPLAPEAQVRARVAQMGLATEKMSTAAKDLSGGEKARLLMGLAAFHAPNLLILDEPTNHLDIDSRRALIEALNDYSGAVILISHDRHLIEATVDRLWLVADGTVKTFEGDMEEYRDLVISSGRKKDDKTEAAADQTSKADQRKANAEKRAQLAPLKKKINEIESLTAKLEKLIQALDKELADPALYEKAPAKAALKVKERGEAASKLSDAEEQWLMLSSEYEDAMAQ

SEQ ID NO: 85047 - protein, 390 aa, Phytophthora hibernalis
ELGEYRAAVPSGASTGEFEALEMRDGGADYMGKGVLNAVKNVNEIIAPALVGKDVTQQVELDRYMVETLDGTQNEWGWCKKKLGANAILGVSLALCRGGAAAKKQPLWQYIADLAGNPSPCLPVPSFNIINGGSHAGNKLAMQEFMILPVGATSFTEAMKIGSEVYHNLKSVIKGRYGLDATAVGDEGGFAPNIQANAEAIDLIEEAIKKAGYTDKVRLGMDVAASEFFTGAKDARYNLDFKNDNAPESEKISADKLLEVYEGFISKCAASSKIVSIEDPFDQDDWESWVKITGKVGKDVQIVGDDLTVTNPTRVKKAIELKACNALLLKVNQIGSITESIEAVTMAKKAGWAIMASHRSGETEDTFIADLAVGLSAGQIKTGAPCRSER

SEQ ID NO: 85048 - protein, 1109 aa, Ipomoea nil
MKVAVNTFLLFLCSTSSIYAAFALNSDGAALLSLTRHWTSIPSDITQSWNASDSTPCSWLGVECDRRQFVDTLNLSSYGISGEFGPEISHLKHLKKVVLSGNGFFGSIPSQLGNCSLLEHIDLSSNSFTGNIPDTLGALQNLRNLSLFFNSLIGPFPESLLSIPHLETVYFTGNGLNGSIPSNIGNMSELTTLWLDDNQFSGPVPSSLGNITTLQELYLNDNNLVGTLPVTLNNLENLVYLDVRNNSLVGAIPLDFVSCKQIDTISLSNNQFTGGLPPGLGNCTSLREFGAFSCALSGPIPSCFGQLTKLDTLYLAGNHFSGRIPPELGKCKSMIDLQLQQNQLEGEIPGELGMLSQLQYLHLYTNNLSGEVPLSIWKIQSLQSLQLYQNNLSGELPVDMTELKQLVSLALYENHFTGVIPQDLGANSSLEVLDLTRNMFTGHIPPNLCSQKKLKRLLLGYNYLEGSVPSDLGGCSTLERLILEENNLRGGLPDFVEKQNLLFFDLSGNNFTGPIPPSLGNLKNVTAIYLSSNQLSGSIPPELGSLVKLEHLNLSHNILKGILPSELSNCHKLSELDASHNLLNGSIPSTLGSLTELTKLSLGENSFSGGIPTSLFQSNKLLNLQLGGNLLAGDIPPVGALQALRSLNLSSNKLNGQLPIDLGKLKMLEELDVSHNNLSGTLRVLSTIQSLTFINISHNLFSGPVPPSLTKFLNSSPTSFSGNSDLCINCPADGLACPESSILRPCNMQSNTGKGGLSTLGIAMIVLGALLFIICLFLFSAFLFLHCKKSVQEIAISAQEGDGSLLNKVLEATENLNDKYVIGKGAHGTIYKATLSPDKVYAVKKLVFTGIKNGSVSMVREIETIGKVRHRNLIKLEEFWLRKEYGLILYTYMENGSLHDILHETNPPKPLDWSTRHNIAVGTAHGLAYLHFDCDPAIVHRDIKPMNILLDSDLEPHISDFGIAKLLDQSATSIPSNTVQGTIGYMAPENAFTTVKSRESDVYSYGVVLLELITRKKALDPSFNGETDIVGWVRSVWTQTGEIQKIVDPSLLDELIDSSVMEQVTEALSLALRCAEKEVDKRPTMRDVVKQLTRWSIRSYSSSVRNKSK

SEQ ID NO: 85049 - protein, 390 aa, Phytophthora citricola
TEIGEYRAAVPSGASTGEFEALEMRDGGKDYMGKGVLNAVKNVNEIIAPALVGKDVTKQAELDRYMVEQLDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTDQVRLGMDVAASEFYTGAKDARYNLDFKNENAPESEKIPADKLQEVYEGFIAKCAGSSKIVSIEDPFDQDDWESWVKFTAKVGKDVQIVGDDLTVTNPTRVQKAIDQKACNALLLKVNQIGSITESIEAVTMAKKAGWAIMASHRSGETEDTFIADLAVGLSAGQIKTGAPCRSE

SEQ ID NO: 85050 - protein, 280 aa, Methanosarcina barkeri str. Fusaro
MTDKVQPLEGLSKKPEEPKIVVNLRRIKRKIMIMSGKGGVGKSTVAANLAAGLALRGYKVGLLDCDIHGPTIPTIFGLESQRPDINEEGILPISVLPNLSMMSIGFLLGDKDSPIIWRGPAKMGAIKQFLEDVVWGVLDFLIIDLPPGTGDEPLSVAQLIPNCDGSVLVTTPQDVALISVRKSIIFSEKLNVPIIGLVDNMHGLICPHCGKPIEVFGTGGVEKASKDFDIPILASLPIEPKVAEMEDKGTIVQGLLDHSTEWQNNFEAVVTAVEKTLEEE

SEQ ID NO: 85051 - protein, 392 aa, Phytophthora ramorum
LVTELGEYRAAVPSGASTGEFEALEMRDGGSDYMGKGVLNAVKNVNEIIAPALVGKDVTQQVELDRYMVETLDGTQNEWGWCKKKLGANAILGVSLALCRGGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTDKVRLGMDVAASEFYTGAKDARYNLDFKNANAPESEKISADKLQEMYEGFISKCASSSKIVSIEDPFDQDDWESWVKITGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 85052 - protein, 364 aa, Aspergillus nidulans FGSC A4
MAEKEVTPLTAVKVEALVVMKIIKHCSQVFPTTATGSIVGMDVDGVLEITNTFPFPVVEVPPESHFDNAAPNPAAAAPRAKANTVYQAEMIRMLREVNVDANNVGWYTSANMGNFVNMNVIENQFFYQKEMNERTVALVHDPSRSAQGSLSLRAFRLSPKFMAAFKDNKFTSDELQKSNLKYQDILVELPVEIHNSHLITSFIHQLQNQTQATPAEIPTSLATLESSPFAKQTILAPNFDNLSLSIDPFLEKNCDLLLDSIETHHTETSNFQYYQRSLAREQAKITAWQAKRKAENATRATLKQPPLPEDEWQRLFKLPQEPSRLDSMLNSRQVEQYARQIDSFVSSTTGIRQRSSLSLSSSPE

SEQ ID NO: 85053 - protein, 639 aa, Triticum aestivum
  misc_feature (513)..(513): Xaa can be any naturally occurring amino acid
  misc_feature (561)..(561): Xaa can be any naturally occurring amino acid
  misc_feature (581)..(581): Xaa can be any naturally occurring amino acid
MSKLLAIALLLLHLINHKINMATAWDDQDFFKYCPPSHCSQHGPEIRYPFCLESNNTSSCGCSGKSIRKIACSGQDTILVHPVLCPYSVSAIDYKRSSMKITPLVDPCLVLQQKLAISRSSSSPQVDVINDEKPSLDRYLFWSSTISLVRCSREFAPGAADGIAGPVSCLSNITHFFYLVNGYEDMSILPLDCKVVPLSDGVGGGQITMYMFDDPMSDTLSLSFKERTERILGFAETTVYWYNYYCKECERSGGRCAFSSQRDRKFCMPGPHGSRIKVIAATSSVAAFVVLLLTVATVLYLSLKTRYNAEIHLKVEMFLKTYGTSKPTRYTFSEVKKMARRFKEKVGQGGFGSVYKGELPNGVPVAVKMLENSTGEGEAFINEVATIGLIHHANIVRLLGFCSEGMRRALIYEFMPNESLEKYIFSDDSNIFQNLLVPDKLLDIALGIARGMEYLHQGCNQRILHFDIKPHNILLDYNFNPKISDFGLAKLCARDQSIVTLTAARGTMGYIAXPELYSRNFGGVSYKSDVYSFGMLVLEMVSGRRNPDPRIGSQDDVYLPXEWIYEKVINGEELALTLETXQEEKDKVRQLAMVALWCIQWNPRNRPSMTKVVNMLTGRLQSLQMPPKPFVSYENEPMP

SEQ ID NO: 85054 - protein, 339 aa, Vibrio angustum S14
MRVLVTGGMGYIGSHTCVQMIEAAMTPIIVDNLYNSKETVLGRIENLTGVKPAFYHGDIRDRAFLDKVFAENEIDAVIHFAGLKAVGESVEKPLEYYDNNVHGTLVLVEAMRAAGVNALIFSSSATVYGDPASVPITEDFPTSATNPYGRSKLMVEECLADIQHAHPEMSITLLRYFNPVGSHKSGTMGEDPQGIPNNLMPFISQVAVGRREFLSVFGNDYPTIDGTGVRDYIHVVDLADGHLAALNHKGSEAGLHIYNLGTGNGNSVLQMVDAFSKASGVEVAYRIAPRRPGDIAECWADPAKAKAELHWEAKLTLDDMTQDTWRWQSTNPNGYPDAE

SEQ ID NO: 85055 - protein, 200 aa, Flavobacteria bacterium BBFL7
MKITSSEFVISNQDVKRCPDSKLAEYAFIGRSNVGKSSLINMLTNKKSLAKTSGRPGKTQLINHFLINKSWHLVDLPGYGYARVSKSSKAKFQKFITNYFQQRRQLVCAFVLVDVRHEPQPIDTEFMEWLGENGIPFGIVFTKADKLKPNALERNVEVYKKQLLDGVWEEVPPYFITSSSNGTGQEELLNYIGEINASLD

SEQ ID NO: 85056 - protein, 611 aa, Lactobacillus acidophilus NCFM
MAQLSLFLVVLLALVIPIFMARFQISTVPTAVAEIIVGIIMGSSGFNLIISTHDLTFLSNLGVTLLMFLSGMEIDFDILQRKDSSKSKSHAGKTVNPIKIAVTAFGGIMVMAVVLAFALRAMGLFSEVMLAAIILMTVALGVVIATLKEKDILNRPIGQTVLLTAVLGEVIPLLLLTIYASINGGNAEQLWLIILLFLAAIFLLRRFKQPYVWFANVTKATTQLDIRLAFFLIFALVTVAQTVGAENILGAFLAGMVMKLLEPSEATKDKLTSIGYGFFIPIFFIMTGVGLNLRSLFGKPSSLMLLPVLVIFLLIAKLPVVLTYMRYFQKRNAFAGGFLTATTITIVLPTLQVARKLHAITSTQSDAFILAAVIVCILSPIVFNSNFVLLPEDKIKKTVSIVGANAMTVPVAHDLHDNWYSVKMFTGDQDRYETYDSRVENLTFLSDLNQKTLEKDGVFDCDIFVASTHIDEVNIKLARMAQEVGVERVIARLGQVNSNTVDEFRQKNIEIFNFTNVRAALMRALIETPTVYKIITDTKNVLYSVKVENTHYTGKPLADLDFIDKITVSRIRRGDEWLIPHGWTVIEPGDILVFSGEFKVADHVRDLLSHE

SEQ ID NO: 85057 - protein, 267 aa, Brassica napus
  misc_feature (19)..(19): Xaa can be any naturally occurring amino acid
SSPRYLPTPSNIHIWKLEXRKMKNSVKKVVDSRLASKQDYGDDLLGIMLKSCESERNETKLSIEEIIDECKTFFFGGYETNSNLLTWTTMLLSLHQDWQEKLRDEIFQECGKDKTPDSDTFSKLKLMNMVFLESLRLYGPVSYFSRDATKDLTLGHLKIPKGTTIVFPLMKMHSDKAVWGSDADKFNPLRFENGVSRAAKHPNALLAFSMGPRVCIGQNFAMIEAKVVLTMILQRFRLSLSSEYKHAPVDHLTLTPQYGLPVMLQPL

SEQ ID NO: 85058 - protein, 222 aa, Oryza sativa Indica Group
MKPAVEVEEGDERAAELARKKAAAAAAAAAKKAEEAAVEEEEVVNGEEEVEEEAVDGEEGDGDEEGDGEEEGDDEEEDAEEGEKGAAGHTVVEISDEEDEEDGEEGDGGDDDDDDDDDDDDDDDDEEEEEEVEGDEQEELGTEYLVKPLGDAEDEEHSSDFEPDENGEGAEDEEIDEDDDGDDDSAKAQSSSKRKRSGGDDEDDDDDDDDGDDDDDGRPSKR

SEQ ID NO: 85059 - protein, 415 aa, Frankia sp. CcI3
MEFTQSDKLADVCYDVRGPVLDEATRLEAAGSRILKLNIGNPAPFGFSAPPEVLEAVVANLADAQGYSDSKGLLAAREAVVRYHLRKGVTGIDPGGVYLGNGVSELIMMSLQALLNNGDEVLLPAPDYPLWTAVVSLCGGRPVHYLCDESAGWAPDLDDIAAKVTPRTRAIVVINPNNPTGAVYDRQVLENIVEVARRHHLMLLSDEIYDRILYEDAEHIATAALAPDLVCMTFNGLSKSYRLAGFRAGWMVMSGPRGHASSYIEGVNILANMRLCANAPGQFATVAALTEDGGAGDLVLPGGRLREQRDTVVKLLNDIPGVSCVPPRGALYAFPRLDPAVYPIRDDERFVLDLLLAEKILLVQGSGFNWPHPDHVRIVTLPAVDDLTDAIGRIDRFLASYKRPSQQQCPSQRRN

SEQ ID NO: 85060 - protein, 494 aa, Oryza sativa Japonica Group
MTSARPAPVSAGEASLGRHLARRLVQVGVSDVFAVPGDFNLTLLDHLIAEPGLRLVGCCNELQRRAVVTNLEDAHEQIDTAIATALRESKPVYLSISCNLPGLPHPTFSRDPVPFFLAPRLSNKMGLEAAVEATVEFLNKAVKPVLVGGPKLRVAKAGKAFVDLVDASGYAYAVMPSAKGLVPETHPHFIGTYWGAVSTAFCAEIVESADAYLFAGPIFNDYSSVGYSFLLKKDKAIIVQPERVIVGNGPAFGCVMMKEFLSELAKRVNKNTTAYENYKRIFVPEGQPLESEPNEPLRVNVLFKHVQKMLNSDSAVIAETGDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKDCLCFIEVIAHKDDTSKELLEWGSRVSAANSRPPNPQ

SEQ ID NO: 85061 - protein, 212 aa, Arabidopsis thaliana
FTIESLGSLCVCKSDAEYFAKAAASRDSEMATEDVQDPRIAKIASSIRVIPDFPKPGIMFQDITTLLLDTEAFKDTIALFVDRYKDKGISVVAGVEARGFIFGPPIALAIGAKFVPMRKPKKLPGKVISEEYSLEYGTDTIEMHVGAVEPGERAIIIDDLIATGGTLAAAIRLLERVGVKIVECACVIELPELKGKEKLGETSLFVLVKSAA

SEQ ID NO: 85062 - protein, 573 aa, Cryptococcus neoformans var. neoformans JEC21
MSFAEYIPKADDPISVPRPQLESSFQSLPDTAGPTAELQTRTSPVKISFGQPSGGAVKKGWKSISPKKKARVSLFDEDEEEIQGAKGEKEDKKEVMPEKEQDIMGEALPHPDTLIHRLTLASTRYTTLLTSLSAPLRAAFDSFSTLPSSPPPPPIDLFLDEYLGRKARDDEVKRVEEVWDAKKEWEREEEMGRRYLEEVGKGGRVEGVNVAPAEPGGARVSPAAVVVAPKPEPELAPIPVSGTELQAPAPGAEPHPQTQKVPIPLPPAATLVYQKLAAVGEGTYGKVYKALSLITHQPVALKRIRMENEKDGFPVTAMREIKLLQMLQHENVLRLVEMVVERGGVYMVLEYMEFDLTGLLAHPEIKFSPANIKSLSHQMLSGLSYLHRQSILHRDMKGSNILVNSRGELKLADFGLARVYAKKRREDYTNRVITLWYRSPELLMGETIYGPEVDMWSAGCIILELYTTKPIFQGSDELNQLEVIYALLGTPTEAEWPSVKELPWYELVKPKEEIGSKFRTSFAKWLSPAALDLVEGLLFYDPSQRLLADSALQTDYFLMEEPKMEKPTQYVPF

SEQ ID NO: 85063 - protein, 230 aa, Lactobacillus acidophilus NCFM
MSKLVLIRHGQSEWNLSNQFTGWVDVNLSEKGVEEAKKAGRLIKEHGLEFDQAYTSLLTRAIKTLHYALEESDQLWIPETKTWRLNERHYGALQGLNKKATAEKYGDEQVHIWRRSYDVLPPAIDDDNEFSQAHDRRYANLDPHIVPKAENLHVTLDRVMPFWEDNIAPDLLDGKNVIIAAHGNSLRALTKYIENISDDDIMDLEMKTGEPVVYTFDENLDVVNKEKLDD

SEQ ID NO: 85064 - protein, 355 aa, Chlamydia trachomatis
  misc_feature (17)..(17): Xaa can be any naturally occurring amino acid
ACLQVDSRGSPQIGIKXSELGPKAMYFAMQGSCPSDKRIFFVSNIDPDNAAEVLLEIDLEQTLVVVVSKSGTTLEPAANEELFRQAYQNKGLSIAEHFVAVTSQGSPMDDKSAYLEVFHLWDSIGGRFSATSMVGGVVLGFAFGYEAFIEFLQGAAAIDAHALTPKMRENLPLLSAMLGVWNRNLLGYPTTAVIPYSTGLKYFTAHLQQCGMESNGKSISREGKEISFRTSPIIWGDVGTNCQHSFFSLHQGTDIVPVEFIGFLHNQRGLDCVLSGTSSSQKLFANLVAQSLALAQGRDNANPNKRFKGNSPSSILVAQQLSPRIAGSLLAFYSINLHFKGFAGESILLTKKGFH

SEQ ID NO: 85065 - protein, 252 aa, Wolinella succinogenes DSM 1740
MAIAIRKPEEIKALASANRIVAQTLSLLREHAKPGISLLELDKIAEDFIRSQGARPSFKGLYGFPGAICTSVNEVIIHGIPNGYQLKEGDILGVDIGTEYKGWFGDGAATFGIGAVTQNDEALMACSRDALLYAIDSIRVDMRFKELSHLIEQFILKRGMVPLRGFCGHGIGRKPHEEPEIPNYLEGGNPKQGPKIREGMVFCIEPMICQKSGEAKILSDKWAVVSHDGLNGSHHEHTVAIVNGRAEILSKE

SEQ ID NO: 85066 - protein, 157 aa, Malus sp.
VDALKWKGKTAEELSESVEFFRDIVTGPFEKFIQVTMILPLTGQQYSEKVSENCVFFWKSVGIYTDLEGKAIEQFIDVFKDQNFPPGASILFTQSPKGSLTISFSKDASMPEATNAVIENKLLSETVLESIVGKHGVSPATKQSLAARLSQLLNGCK

SEQ ID NO: 85067 - protein, 156 aa, Malus sp.
DAAKWKGKTAEELSESVEFFRDIVTGPFEKFIQVTMILPLTGQQYSEKVSENCVFFWKSVGIYTDLEGKAIEQFIDAFKDQNFPPGASILFTQSPKGSLTISFSKDASMPEATNAVIENKLLSETVLESIVGKHGVSPATKQSLAARLSQLLNGCK

SEQ ID NO: 85068 - protein, 168 aa, Zea mays
  misc_feature (17)..(17): Xaa can be any naturally occurring amino acid
  misc_feature (59)..(59): Xaa can be any naturally occurring amino acid
  misc_feature (76)..(76): Xaa can be any naturally occurring amino acid
MKVNIPNPSTGCQKKLXIDDYHRLPAYYDRKISHEDRRDALGEEFKAHVFQIMSGWDKXGFPMNRGVLTSDRARLXLLRRGTPCFRDYDKRNDERTKKSDRVWIANHDLSDIHLLLVTKVENDLPVLTETDNPKMIEPKRDSNIRNVFNLVKDDHLLKDVNTYRRTFT

SEQ ID NO: 85069 - protein, 182 aa, Pyrococcus woesei
MVDMSKVKLRIENIVASVDLFAQLDLEKVLDLCPNSKYNPEEFPGIICHLDDPKVALLIFSSGKLVVTGAKSVQDIERAVAKLAQKLKSIGVKFKRAPQIDVQNMVFSGDIGREFNLDVVALTLPNCEYEPEQFPGVIYRVKEPKSVILLFSSGKIVCSGAKSEADAWEAVRKLLRELDKYL

SEQ ID NO: 85070 - protein, 2113 aa, Gibberella zeae PH-1
MGLNEDFDDRQIQTEAEQQPYVPYEYQTENNDSWAGALPVKQGLYDPSYEKDACGVGFACHIKGKPSHKIVSDARNLLCNMTHRGAVGSDARDGDGAGVMTSIPHRFFIKNFEKEEDIKLPPLGQYAVGNLFFKPDEETLQESKRQLEDVAESLGLRVLGWRRPPVDSTLLGPAAKSREPIIAQPFVVLASAYGTGNAPEMTDPEKFDERLFERQLYILRKRATQSIGLHNWFYLCSLSNKNIVYKGQLAPVQVYSYYHDLVNADYEAHFALVHSRFSTNTFPSWDRAQPLRWAAHNGEINTLRGNKNWMRAREGVMQSDVFKDELEQMYPVVEDGGSDSAAFDNVLELLTINGVLSLPEAVMLMVPEAWQGNQHMDPKKAAFYEWAACQMEPWDGPALFTFADGRYCGANLDRNGLRPCRFYVMDDDRIICASEVGTIPVEPESVIQKGRLQPGRMLLVDTQAGRIIDDKELKEAVSSRYDFRAWLDSELITLPKVVEIMERALDLAPKLDDKTIQSDPLLHSYGYTHEQVSLLLAPMAADEKEALGSMGNDAPLACLTQSPRLLYDYFRQLFAQVTNPPIDPIRESIVMSLECYVGPQGNLLEMDASQCGRLLLPSPVLSIEEFNAIKNMSNKYSEWTVKTIDLTFPKNQGVQGYIKHLDEICNEASAAIEARDRVIILSDRNTSADRVPVSAVLASAMVHHHLVSNKWRSMAALVVETAEAREVHHMCVLLGYGADAVNPYLAMECILKLNREGLIKKKTTNETLIRNYKHSCDGGILKVMSKMGISTLASYKGAQIFEILGLDETVVERCFRGTASRIQGMTFELIAEDAFRFHERGFPSRASIGPPGLPESGEYHWRDGGEPHVNDPTSIANIQDAVRTKNDKSYEAYSRSEYEQIKNCTLRGLLDFKFEDCTPVPIDQVEPWTDIVRRFCTGAMSYGSISMESHSTLAVAMNRLGGKSNTGEGGEDPERSQRMPNGDTMRSAIKQVASGRFGVTSAYLADSDELQIKMAQGAKPGEGGELPGHKVSKSIARTRHSTPGVGLISPPPHHDIYSIEDLKQLIYDLKCSSPRSRVSVKLVSEVGVGIVASGVAKAKADHILISGHDGGTGASRWTGIKYAGLPWELGLAETHQTLVLNDLRGRVVVQTDGQLKTGRDVALACLLGAEEWGFATAPLIAMGCVFMRKCHLNTCPVGIATQDPELRKKFTGTPEHVINFFYYVANELRAIMAQLGFRTINEMVGHVEVLKMRDDLRTNKTANIDLSLLLTPAHKLRPGVATFNVRKQDHKLHVRLDNKLISESELTLDKGLPSRIECDIVNTDRAMGTSLSYHISKRYGEAGLPMDTVHVNIKGSAGQSFGAFLAPGVTLELEGDSNDYVGKGLSGGRLIIYPPRSAVFKSEENILIGNTCLYGATTGTCFFRGVAAERFAVRNSGATAVVEGVGDHGCEYMTGGRVVVLGSTGRNFAAGMSGGIAYVLDVHGDFHSKLNGEMVETSGLEDPAEIAFVRGLIEDHHHYTGSERAARILVDFNRALPRFVKILPVDYKRVLLEEAAKAAEAKRAEYNLPAVSGVQHKKSEKAAKLQDLEEAVGDNAAEKKRALVLDKTRGFKMYKRRQEKYRPVNSRLKDWAELSSRLDEDELKYQSARCMDCGVPFCQSETGCPISNIIPKWNELVFQNQWKDALNRLLMTNNFPEFTGRVCPAPCEGACVLGINEDPVGIKSIECAIIDRGFEKGWMVPQPPKVRTGKTVAIIGSGPAGLAAADQLNRAGHLVTVYERADRLGGLLMYGIPNMKLDKRIVKRRTDFMADEGIIFKTGVAVGEEGHPSLSDLRASHNVVVIATGATVARDLPIKGRQLEGIHYAMEFLHKNTKSLLDSELGDNAYISAKDKHVVVIGGGDTGNDCIGTSLRHGAKSVTNFELLPQPPPERANDNPWPQWPRIYRVDYGHTEVRQHTGKDPREYCIMSEEFMDDGSGKVKGINTIRVEWTKSPSGGWDMKKVEGSQQFFPADLVLLAMGFLGPEARVLGDEIEKDARKNVKTAPGKYSTNLEGVFAAGDARRGQSLIVWGINEGRQAAREIDLYLEKYTNLPVTGGITKRTAQEIFSQIQVEA

SEQ ID NO: 85071 - protein, 391 aa, Zea mays
TVNGHRGPKIHLDSGERRPQNRSARKRRSNPPTRHHRPRARRRPMAPLVPMSQPWVEKYRPRQVKDVAHQEEVIRVLNNTLQTADLPHMLFYGPPGTGKTTTALAIAYQLYGPELYKSRVLELNASDDRGINVVRTKIKNFAAVAVGTARKAFLVVMDFSGYPCPPYKIIILDEADSMTEDAQNALRRTTETYSKVTRFFFICNYISRIIEPLASRCAKFRFKPLSEEVMSSRIMHICNEEGLNLNAQAMSTLSVISQGDLRRAITYLQSAARLFGSSISSSDLISVSGVIPEDVVKSLLAACRSGEFDVANKEVSSIIADGYPVSQLMAQFLDVIVSADDIPDDQKARICKKLGETDKCLVDGADEYLQLLDVASETIRSLFNMPRTLVF

SEQ ID NO: 85072 - protein, 61 aa, Triticum aestivum
MVRVATYFAMTFGAFLFWQSMDRVHVWIALHQDEKKERMERELEIKRMQAELMAQAKENES

SEQ ID NO: 85073 - protein, 392 aa, Phytophthora richardiae
LVTKIGEYRAAVPSGASTGEFEALEMRDGGKDYMGKGVLNAVKNVNEIIAPALVGKDVTKQVELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTNQVRLGMDVAASEFYTGAKDARYNLDFKNANAPESEKIPADKLQEMYEGFISKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 85074 - protein, 689 aa, Xanthomonas axonopodis pv. citri str. 306
MSYLVLARKWRPKRFAELVGQEHVVRALSNALDSGRVHHAFLFTGTRGVGKTTIARIFAKSLNCETGTSADPCGTCPACLDIDAGRYIDLLEIDAASNTGVDDVREVIENAQYMPSRGKFKVYLIDEVHMLSKAAFNALLKTLEEPPEHVKFLLATTDPQKLPVTVLSRCLQFNLKRLDEDQIQGQMTRILAAEPIESDPSAIVQLSKAADGSLRDGLSLLDQAIAYAGGALREDVVRTMLGTVDRTQVGAMLHALTDGDGARLLQVVAALAEFSPDWSGVLEALAEALHRVQVQQLVPSVAFVGDGIDPTPFAAQLRPEVVQLWYQMALNGRRDLYLAPSPRAGFEMAVLRMLAFRPAAAVPAGGSDDGRGATAGGGARSAAAGGQLAAPVAAAPVTSAPAVVAAPTAVTDTMPVAAAEASLPASGTRATPAPLVVLSPQESSPASRASAANARNDDTPPWAVDDAPVRARATPTPDTMGVLAPEAAMAPPSAPVELAQPDGIASDAAVEAPASVVVPSPAALVEPSSPEEPAVVASAATAGAASDAATDAAALLDDGRIADAEQWLELVTRSGLNGPSRQLAANAAFIGHRDGVLRLALAPGFEYLNSERSIANLAQALAPVLGNAPRIVVETGSADVETLHERASRQKGERQSAAETAFMNDPTVQLLVQQQGARIVPDSIRPYDE

SEQ ID NO: 85075 - protein, 93 aa, Helicobacter hepaticus
GDPLVLHNEIEQIKQLIQSDIPIFGICLGHQLLSIAHGFPTYKLKFGHQGSNHPIKNLQSGAVEITAQNHNYCVPESIAQIATITHRNLFDIR

SEQ ID NO: 85076 - protein, 393 aa, Phytophthora capsici
LVTEIGEYRAAVPSGASTGEFEALEMRDGGKDYMGKGVLNAVKNVNEIIAPALVGKDVTKQAELDRFMVEELDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTNQVRLGMDVAASEFYTGASDARYNLDFKNENAPESEKIPADKLQEVYEGFIAKCADSSKIVSIEDPFDQDDWASWVKFTAKVGKDVQIVGDDLTVTNPTRVKKAIEQKACNALLLKVNQIGSITESIEAVTMAKKAGWAIMASHRSGETEDTFIADLAVGLSAGQIKTGAPCRSER

SEQ ID NO: 85077 - protein, 389 aa, Phytophthora nicotianae
ELGEYRAAVPSGASTGEFEALEMRDGGKDYMGKGVLNAVRNVNEIIAPALVGKDVTKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKISADKLQEVYEGFIAKCANSSKIVSIEDPFDQDDWASWVKFTGKVGKDVQIVGDDLTVTNPTRVKKAIEQKACNALLLKVNQIGSITESIEAVTMAKKAGWGIMASHRSGETEDTFIASLAVGLSAGQIKTGAPCRSE

SEQ ID NO: 85078 - protein, 392 aa, Phytophthora pseudosyringae
LVTELGEYRAAVPSGASTGEFEALEMRDGGKAYMGKGVLNAVKNVNEIIAPALVGKDVTKQTELDRYMVEQLDGTQNEWGWCKKKLGANAILGVSLALCRAGAAAKKQPLWQYIADLAGNPSPCLPVPSFNIINGGSHAGNKLAMQEFMILPVGATSFTEAMQIGSEVYHNLKKVIKGRYGLDATAVGDEGGFAPNIQSNGEAIDLIEEAIKTAGYTNQVRLGMDVAASEFFTGAKDARYNLDFKNENAPESEKIPAEKLQEVYEGFIAKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSE

SEQ ID NO: 85079 - protein, 718 aa, Aspergillus nidulans FGSC A4
MSLEHTKKVYTLNTGDKIPAIGLGTWQSKPNEVREAVKNALLKGYRHIDTALAYGNEAEVGQGIKDSGVPREEIWITTKLDNTWHHRVTDGINSSLKDLGVDYVDLYLMHWPSSTDPNDLKKHLPDWDFIKTWQEMQKLPATGKVRNIGVSNFGIRNLEKLLNDPSCKIVPAVNQIELHPNNPSPKLVAYNSSKGIHSTGYSCLGSTNSPLYKDPTLLKLAEKKGKTPQQVLLVWGIQKGWSVIPKSVSKSRIDANFEIDGWSLTDEEINELDNLKDRFKSILRFAYAKAYKAVRAKIPEPAQQVSLRVQPVYARITPQQPVNRAAAIRQARSRYFSTRASGPFASYFKAAVQGDKTAYRSSRIAGNISRLTSRAPFASTLRPNLTGGTLGRTAGGYVIGAGRIGGARYFSHGPAAPAQVIHNVSVGVRAFFLSGQKARFDGIDPITGNKKFKVVSALQDEAERKMTAISRAAPGSFIDFKISPTITAFGLQKQFAPAGDESDTLNTEGLLDFLSADFARAVKDFAAILNDLKRLAALGDLPISLQDRSTIRVRFPGCDAETVERLCDEVGVQRGKVGQDADFDINTGAELALLFPFAPSVAPSSDTDIFFFHKEAQPQQPEEVDWQAMLSSEDVTQTSLGYAKLSNHDLSFDDMTMFGSNPWARSPSGYSSIGVSELGDRAFFPDTVSYSIPESLSGCEGSDGIRRFIAECDQAAAH

SEQ ID NO: 85080 - protein, 451 aa, Colwellia psychrerythraea 34H
MKSEFQQKNTAHHFQPFSDNKELAEKGIKLISKAEGVYIYEDNGKKYLDGMAGLWCVNIGYGRKELVEAASQQMTELPYYNLFFKTTTAPATNLAAKIASLAPAHMNKVFFTGSGSDANDTNFRMVRRYWDLKGKPTKKTFISRKNAYHGSTVAAASLGGMGYMHEQGDLPIDGIVHVDQPYWFAEGGDLSQDEFGLKAAQSLEAKILEVGEENVAAFIAEPFQGAGGVITPPDSYWPEIKRILAKYDILFILDEVISGFGRTGEWFASEYFDLKPDMITIAKGMSSGYLPIGGVIISDKVADVVIGEGADFNHGYTYSGHPVAAAVALKNIEILESEGIVDQVKSEISPYLQQRWQELADHPIVGEARGLGMVAAIELVKDKATKERLAPNAAGGGVCRDYSMDNGLIMRSCGDIMVISPPLVITKAEIDELIEKAKKTLDDTARFYNLI

SEQ ID NO: 85081 - protein, 600 aa, Synechocystis sp. PCC 6803
MALIVQKFGGTSVGTVERIQAVAQRIKRTVQGGNSLVVVVSAMGKSTDVLVDLAQQISPNPCRREMDMLLSTGEQVSIALLSLALQEIDQPAISLTGAQVGIVTEAEHSRARILEIRPDRLEHHLREGKVVVVAGFQGISSVEHLEITTLGRGGSDTSAVALAAALKADFCEIYTDVPGILTTDPRLVPEAQLMAEITCDEMLELASLGAKVLHPRAVEIARNYGIPLVVRSSWSDEPGTKVVAPPVQNRSLVGLEIAKAVDGVEYDADQAKVALLRVPDRPGVASKLFRDIAQQQVDIDLIIQSIHDGNSNDIAFTVVKDLLNTAEAVTSAIAPALRSYPEADQEAEIIVEKGIAKIAIAGAGMIGRPGIAAKMFKTLADVGVNIEMISTSEVKVSCVIDQRDADRAIAALSNAFGVTLSPPKNQTDTSHLPAVRGVALDQDQAQIAIRHVPDRPGMAAQLFTALAEANISVDMIIQSQRCRINQGTPCRDIAFMVAEGDSSQAEAILQPLIKDWLDAAIVVNKAIAKVSIVGSGMIGHPGVAAHFFAALAQENINIEMIATSEIKISCVVPQDRGVDALKAAHSAFNLAGTKTVTVPA

SEQ ID NO: 85082 - protein, 2237 aa, Coprinopsis cinerea okayama7#130
MSSSSTQKEATEPVQQRPELSRSPSLFAHVPASPVTGPVQDDANAVDGVLELADGTAYRGISFGAEGKSVAGECVFQTGMVGYTESLTDPSYEGQILVLTYPLLGNYGVPARPASWDDLPEHFESSRIHVAALIVGNYTEDYSHFLASSSLGAWLKENGVPALFGVDTRALTKRIREKGSMLGRVLARADGPRVSRPQASLISSVPSTPYPWREEYIDIPFSNPYEKNLVAQVSIAAPRVYAPTSTPRLHPSGRPLRVLAIDVGMKFNQIRCFINRGVELKVVPWDYDFLAESEPYDGLFVSNGPGDPTKVPITVERIRKAMEGDMPIFGICLGHQLISLAAGAKTSKMKYGNRGENIPCTDVLSGRCYITSQNHGYQVDASTLPIGWKELFRNANDESNEGIYCETKPFFSVQFHPESNPGPRDTEFLFDVFIQNVADSAATGYVGPLQLPGGKKEDNEKRVPRVNVSKVIILGSGGLSIGQAGEFDYSGSQAIKALKEEGIYTIMVNPNIATIATSKGLADKVYFLPVTPDFVRKIIKYEKPDGIYVTFGGQTALNVGIKLKDEFEELGVKVLGTPIETIITTEDRQLFADAMAEIGEKCAESCTATNYDEALAAAKNIGFPVIVRAAYALGGLGSGFAQDENQLKTLCDKAFATSPQVLVEKSMKGWKEIEYEVVRDCRDNCITVCNMERVAHDLKQNFDPLGIHTGDSIVVAPSQTLSDADYNMLRTTAINVIRHLGVVGECNIQYALNPTSQEYCIIEASRMSFICMIVVLINNQLATGYPLAFIAAKLGLGIPLNEIKNSVTKVTSACFEPSLDYVVVKIPRWDLKKFSRVSRLLSSSMKSVGEVMAIGRTFEETFQKAIRSIDDQFLGFAKNALVEDIDEELVNPTDKRVFAISTAFHRGYSVDKVWQMTNIDKWFLNKLHDIFKIEQKLSACNISSLSVDLLRRSKQYGFSDRQIAACISSTELAVRRVRQENGIAPFVKQIDTVAAEFPAFTNYLYTTYNAVEHDIKFEDRGIMVLGSGVYRIGSSVEFDWCAVRAIRTLRDQGIPTVMVNYNPETVSTDYDEADRLYFENISLETILDIYEIEHSRGVILSMGGQTPNNIALPLHRQNVKIYGTSPEMIDTAENRYKFSRLLDEIGVDQPQWKELSSFEAAVAFCDSVGYPVLVRPSYVLSGAAMNVVSTKDDLANYLTQAAEVSREHPVVISKYIEQAKEIEMDAIAKDGKMVMHYISEHVENAGVHSGDATLIHPPQDLDPQTVRQIEEATAKIGNALNVTGPYNIQFIAKNNEIKVIECNLRAARSFPFVSKVTGIDAIEMATKVMLGLPVEAYPDPGLPSDYVGVKVPQFSFSRLSGADPVLGVEMASTGEVACFGRDKYEAYLKALISTGIHPPKKNILFSVGSYREKLEILPSVQKLSAAGYNIFATSGTADFLTEHNVPCKYLETLGSDGGEQKSEYSLTQHLANNLIDMYINLPSKNHYRRPATYASKGYRTRRMAVDFAIPLITNVKNAKMLAEALIRNLPLDVSNVDAKSSHHTHTFPGLVNVAAFVPQLITPGSKELAAATEASIRSGFTTALISPVGADGSITTRQTLEQVRGEIAGSAHCNIAFSITATPDNVEAIDEEVQAEVKSLFVPASTPVSAVAAHFTSWIVEKPVVTDAKGAELASILLLASLNNCSVHVTNVQSTDDLLLISLSKAKGLKVTCDVSIFSLFFTKDEFDGASILPSAADQKALWDKLDIIDAFSVGPTPYQLAKASSEAGSVFSGTEEALPLLLTAVVEGRLTLNDIRKRLHDNPVSIFGIPDQTQTTVDVVLGRKAPFRKHSEAWSPLELRPVSAFVHRVVVQGQTLFLDGSLVASHQGRDISAFTLPPVIPAKEQEIIAPPVATSTASVTSPVPSTSLQLQQQQHLPPVSTHSLTHLQPHPSFHRRHILSVKQFTQRDLYDLFALAHEMQLQVERNGTLDILKGKVLCTAFYEPSTRTSSSFDAAMKRCGGQVVQITAETSSIQKGETLADTVRTLACYGDAIVLRHPDVGSAQMAAKFSPVPIINAGDGIGEHPTQALLDVYTIRSELGTVNGRTITLLGDLKNGRTVHSLVTLLCHYSVRLNFVSPPSLAMPSSVVSAARKAGIPVTICETLDEVLSDTDVLYVTRVQKERFESETEWLQVKDAYRVDHAVLSRAKEDMIVMHPLPRVNEIDPEVDFDSRRAVYFRQMRYGLFIRMALLASVLA

SEQ ID NO: 85083 - protein, 267 aa, Synechocystis sp. PCC 6803
MSIQLGIIGGGVMAEAILARLIAEKTYAPEEIIVGEPHGARRDYLQKTYQVRVSPDNQEAANVSEVLLLAVKPQVLDRVLASLAGGANRPLVISILAGVSLQRIQKGFPDHAIIRAMPNTPATVGAGMTAIAANKMVEPDQLAKAKAIFSAVGNVVEVPENLMDAVTGVSGSGPAYVALMIEALADGGVLAGLPRAIAQKLALQTVLGTAELIKETEEHPAQIKDKVTSPGGTTIAGVAVLEKMGFRSAIIEAVRAAYRRSQELGKK

SEQ ID NO: 85084 - protein, 396 aa, Oryza sativa Japonica Group
MDEEQLRALLRDLDALKQRPDPAAIDRMRERVAGMVTPAAAARSKIKDMSSEVVDSNPYSRLMALQRMGIVDNYERIRDYSIAIVGIGGVGSVAAEMLTRCGIGRLLLYDYDTVELANMNRLFFRPDQVGMTKTDAAVQTLSGINPDVTLESYSLNITTVKGFETFLGSLKARSSDGRNTGVDLVLSCVDNYEARMVVNQACNELGQTWMESGVSEDAVSGHIQLLVPGETACFACAPPLVVASGVDERTLKREGVCAASLPTTMGVVAGLLVQNALKYLLKFGQVSPYLGYNSLKDYFPTMEMKPNPQCSNPACVQRQKEYMQSKPARDAAAKAKMEAEASAADECPVHLDNDWNIRFSCHTNGADKIVDLDRTLYPMLKPTSFLKHPACRIACV

SEQ ID NO: 85085 - protein, 216 aa, Triticum aestivum
  misc_feature (113)..(113): Xaa can be any naturally occurring amino acid
SEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEFILTHPNIKIPNKGKXYSVNEGNARNWDAPTAKYAERCKFPQDGSSPKSLRYIGSMVADVHRTLLYGGIFLYPADKKSPSGKALEIVPSEIHQRSPIFLGSYDDVEEIKSLYASESSTA

SEQ ID NO: 85086 - protein, 232 aa, Candidatus Blochmannia floridanus
MHIIKTVLIRHGESQWNKDNRFTGWIDVDLSNQGYSEAKRAGQLLKKYKFIFDYGYTSVLKRTIHTLWVILDQLNQTWLPIQKVWQLNERHYGALQGLNKNEAIKTYGYDTIQKWRRSFKDIPPKNNKNDLFLGTNDIRYKNIETNTLPNGESLELTANRVIPYWQKYIEPKIYNNNCIIIVAHGNSIRAILKFLNQLDDSEIFNIEIPTGIPLIYEFDNNIKPIRYYYLSE

SEQ ID NO: 85087 - protein, 112 aa, Glycine max
MNIILSESRMSKEVIATQSPTPFEYEILDSDAEVLRTVRASSNCANPWIEPERLKLRHRIGRGPFGDVWLATHHQSTEDFDEYHEDAAKMLHPIREDHVKIVLEKFNELYFK

SEQ ID NO: 85088 - protein, 256 aa, Zea mays
  misc_feature (180)..(180): Xaa can be any naturally occurring amino acid
MAKLMNKLVDSFEHDEIPDVGCVRAVLAELVLTFLFVFTGVSAAMAAGSDGKPGDAMPMATLAAVAIAHALAAGVLVTAGFHVSGGHLNPAVTVGLMVRGHITKLRAVLYVAAQLLASSAACVLLRFLSGGMVTPVHALGRGISPMQGLVMEVILTFSLLFVTYAMILDPRSQVRAIGPXLLTGLIVGANSLAGGNFTGASMNPARSFGPALATGDWTNHWVYWIGPLLGGPLAGFVYESLFLVQKMHEPLLNGEI

SEQ ID NO: 85089 - protein, 348 aa, Candidatus Blochmannia floridanus
MKISCSIIGLPNVGKSTLFSLLTNIVVKISNFPFCTIQPNIAIIKIPDVRLYQLNDIVQSRTVVHEKIKFIDVAGLIPGAYQGVGLGMQILNHIQTTQIFIHVVRCFDNDGILHIKNNINPSRDIDILNIELILFDIEQCEKHIDFLKKNRMININKDQNLFILEKCLNYLNDGISLRNINFSQSERKNILNFNFLTYKPVIYIANVDRHYKNNIYVQKLNEIGFRENSPVILHCFMNNGEFIANSQRTILHALIDNIMFFLKLNTFFTTNINMTRSWIYESETIALDAAYNIHSDFKKGFIRAQIIKFNDFIANHGESGAKKSGRIRYEGKNYLIEEGDIIKFLFKN

SEQ ID NO: 85090 - protein, 519 aa, Zea mays
  misc_feature (195)..(195): Xaa can be any naturally occurring amino acid
METANVVILSFFFIFAIHRLFNRLHSRSTKMKPLPPGPLAIPVLGHLYLLLEKNIHHMFTRLAARYGPVLYLRLGSRNAVIVSSVDCARECFTEHDVTFANRPTFPTLHLMTYGGTTVGTCAYGPYWRHIRRVITVHLLSALRVRSMVPAIEAEVRAMARSMYRAAVTAPGGAGAAKVELGGMLFELGLSALMEXTVAKTKTSRSSMGGAADTGLSPEGREFKESMDVMMPLLGTANMWDFLPVLQRFDVFGVKNKMAAAVSGRDAFFRRLIDEERRRLDDGVESENKSMMAVLLTLQKSEPENYSDDMIMSLCFSMFSAGTETTATTAEWAMSLLLNNPEVLKKAQGEIDAHVGNSRLLGADDMPHLPYLQCVLTETLRLYPVFPMLIAHESTADCKVGGHHVPSGTMLLTNAYAIHRDPAAWTEPDAFRPERFEDGSAEGKLLIPFGMGRRKCPGETMALRTLGLVLGTLIQCFDWATVGGVPKVDMTEASGLTLPRAVPLEAMCKPRQAMLDVLQK

SEQ ID NO: 85091 - protein, 314 aa, Candidatus Blochmannia floridanus
MKLFTGNAIPELAQRIADKLYITLGNASVGRFSDGEVSVQINENVRGGDIFIIQSTCAPTNDNLIELIVMVDALRRASAARITAVIPYFGYARQDRRVRSARVPITSRVVANFLSSVGVDRILTVDLHAEQIQGFFDVPVDNVFGSPILLEDMLQQKFNNPIVVSPDIGGVMRARAIAKLFNDTDMAIIDKRRPRSNVSQIMNIIGDVYNRDCILIDDMIDTGGTLCKAADVLKDKGACRVFAYATHPIFSGNAYENIQKSMIDEIIICDTIPLKSKIRTLPNIRILTLSGMLAETIRRISNEESISAMFDYSI

SEQ ID NO: 85092 - protein, 149 aa, Methylobacillus flagellatus KT
MKKITVDLNGKDLRIGIVLSRFNSNIGEGLLKACVDQLHKLGVADDDITLATVPGALEAPAILLQMADSEQFDGLIALGAVIRGETYHFEVVSNESARGISDVQLSTGIPIANAILTTENDEQAEARVAVKGAEAADVVVEMINLLKQL

SEQ ID NO: 85093 - protein, 266 aa, Mycoplasma penetrans HF-2
MKKRIGYGSFEVNDVPTLKKCIKQAVLSGYDFVDTAYYYQNEEAIGKAIKELREEGFDKPILVQTKIWPEHYGNVRDAVLLSCQKLQTNKLDMCLLHRRHFNLNMDLSAWEQLIECQKEGLVGEIGVSNFDRDALEIMRQRTGVYPLSNQIELSVNNLREDRVVYNHSKGIEVQAWSPLGDLENNLKNPVLIEMAKKYNTDVAGVLIAYVGSLNCSIIVKTSNPDRVVSNYKAFQIILEESDVEKLKKLNTYKIKYSESFIYDIDN

SEQ ID NO: 85094 - protein, 475 aa, Pseudomonas syringae pv. tomato str. DC3000
MLAETMPQHTDPSIEAMHRAFALQRAAFRANPMPSAAQRLQWLKSLGEVLSLHRQDLIDAIGADFGQRSADETLLAELLPSLLGIADARKHVKRWMKPSRRRVGLMFQPASAKVVYQPLGVIGVIVPWNYPLFLAIGPLIGALAAGNRVMLKLSESTPATGALLKRLLANVFPEDLVAVVLGEAETGMAFSRLPFDHLLFTGASSIGKHVMRAAAENLTPVTLELGGKSPAIVSQDVPLQDAAERIAFGKTLNAGQTCIAPDYVLVPKDRLTGFVDAYTAAVKRFYPTLIDNPDYTAIINQRQLLRLNHCLEDAENKGATIITLYEQGQDRRMPFSVLLDVSDDMLVMQDEIFGPLLPVVPYHRIEDAYAYINQRPRPLALYYFGYDKAEQRQVLERTHSGGVSINDTLMHAAQDDLPFGGVGPSGMGNYHGREGFLTFSQAKAVFTKQRLNTARLIYPPYGKAIQRLVYKLFMR

SEQ ID NO: 85095 - protein, 148 aa, Hyacinthus orientalis
AGGSCCCLLKSLISLFLAGISGAPQDNNIMLWNAVIFGPDDTPWDGGTFKLTLQFTEDYPNKPPTVRFVSRMFHPNIYADGSICLDILQNQWSPIYDVAAILTSIQSLLCDPNPNSPANSEAARMFSENKREYNRRVREIVEQSWTAD

SEQ ID NO: 85096 - protein, 703 aa, Oryza sativa Indica Group
MEFVSEFFFTINRVTNDSCLHSGANSFLFTQYKYLAAFTAVFAVVIFLFLGSVHRFSTESQPCQYTRGKACKPALANAVFSTIAFLLGAATSVASGFLGMRIATAANARTTVEARRGIGPAFAAAFRSGAVMGFLLASLGLLVLYVAIKVFGLYYGDDWEGLYESITGYGLGGSSMALFGRVGGGIYTKAADVGADLVGKVERNIPEDDPRNPAVIADNVGDNVGDIAGMGSDLFGSYAESTCAALFVASISSFGADHNFAAVSYPLLISSAGLIVCLITTLFATDLYRVKTVDGVAPALKLQLLISTVLMTVGVLVVTFTALPHEFTMFDFGEVKRVKNWHLFFCVTIGLWAGLAIGFTTEYFTSNAYSPVRDVADSCRTGAATNVIFGLALGYKSVIVPVFAIAVSIYVSFTLASIYGISVAALGMLSTVATGLAIDAYGPISDNAGGIAEMAGMSHRIRQRTDALDAAGNTTAAIGKGFAIGSAALVSLALFGAFVSRAGMAVINVLSPKVFVGLVVGAMLPYWFSAMTMKSVGSAALKMVEEVRRQFAAIPGLMEGRATPDYASCVRISTDASLREMMPPGALVLLAPLVAGTFFGVQTLAGLLAGALVSGVQVAISASNSGGAWDNAKKYIEAGASDHAKALGPKGSDAHKAAVIGDTIGDPLKDTSGPSLNILIKLMAVESLVFAPFFAAHGGLIFK

SEQ ID NO: 85097 - protein, 255 aa, Magnetococcus sp. MC-1
MIIIKTPEQIEKMRVTCRLAAETLDMIAPHIKPGVSTETLNTICHDFIVRNHAIPAPLNYRGFPKSICTSVNHQVCHGIPSDRVLRDGDIINVDITTIVDGWHGDTSRTFQVGTPTKKGLKIAEIAKKCLDLGIAAVRPGIHLGDIGAIIEDYARQNRCTVVREYCGHGIGEKFHEEPAVLHFGNYGEGVKLLPGMIFTIEPMVNLGKPYIKLMPDQWTVVTKDHSLSAQYEHTVLVTESGHDVLTDINGEYPPC

SEQ ID NO: 85098 - protein, 225 aa, Oryza sativa Japonica Group
MAAPTAAALSTLSTASVTSGKRFITSSFSLSFSSRPLATGVRAAGARAARRSAASASTVVATIAVGDKLPDATLSYFDPADGELKTVTVAELTAGRKAVLFAVPGAFTPTCSQKHLPGFIEKAGELHAKGVDAIACVSVNDAFVMRAWKESLGLGDADVLLLSDGNLELTRALGVEMDLSDKPMGLGVRSRRYALLADDGVVKVLNLEEGGAFTTSSAEEMLKAL

SEQ ID NO: 85099 - protein, 241 aa, Pasteurella multocida subsp. multocida str. Pm70
MTLMEGKKVPQVTFHTRQGDQWVDVTSAELFDNKTVVLFSLPGAFTPTCSSTHLPRYNELACEFKALGVDSIICMSVNDTFVMNAWKADQECENVIVIPDGNGEFTEGMGMLVGKEDLGFGKRSWRYSMLVRNGIVEKMFVEPQEPGDPFKVSDADTMIKYLKPEWQAKPSVSVITKPGCPYCAKAKALLKAKDYTFEEIVLGRDASTISVRAITGKTSVPQVFIGGKYIGGSEELEKYFA

SEQ ID NO: 85100 - protein, 489 aa, Synechocystis sp. PCC 6803
MKSPQAQQILDQARRLLYEKAMVKINGQYVGTVAAIPQSDHHDLNYTEVFIRDNVPVMIFLLLQNETEIVQNFLEICLTLQSKGFPTYGIFPTSFVETENHELKADYGQRAIGRVCSVDASLWWPILAYYYVQRTGNEAWARQTHVQLGLQKFLNLILHPVFRDAPTLFVPDGAFMIDRPMDVWGAPLEIQTLLYGALKSAAGLLLIDLKAKGYCSNKDHPFDSFTMEQSHQFNLSVDWLKKLRTYLLKHYWINCNIVQALRRRPTEQYGEEASNEHNVHTETIPNWLQDWLGDRGGYLIGNIRTGRPDFRFFSLGNCLGAIFDVTSLAQQRSFFRLVLNNQRELCAQMPLRICHPPLKDDDWRSKTGFDRKNLPWCYHNAGHWPCLFWFLVVAVLRHSCHSNYGTVEYAEMGNLIRNNYEVLLRRLPKHKWAEYFDGPTGFWVGQQSRSYQTWTIVGLLLVHHFTEVNPDDALMFDLPSLKSLHQALH

SEQ ID NO: 85101 - protein, 393 aa, Phytophthora citricola
LVTEIGEYRAAVPSGASTGEFEALEMRDGGKDYMGKGVLNAVRNVNEIIAPALVGKDVTKQAELDRYMVEQLDGTQNEWGWCKKKLGANAILGVSLALCRGGAAAKKQPLWQYIADLAGNPSPCLPVPSFNIINGGSHAGNKLAMQEFMILPVGATSFSESMKIGSEVYHNLKKVIKGRYGLDATAVGDEGGFAPNIQSNGEAIDLIEEAIKAAGYTNQVRLGMDVAASEFYTGATDARYNLDFKNENAPESEKIPADKLQEVYEGFIAKCAGSSKIVSIEDPFDQDDWESWVKFTAKVGKDVQIVGDDLTVTNPTRVQKAIDQKACNALLLKVNQIGSITESIEAVTMAKKAGWAIMASHRSGETEDTFIADLAVGLSAGQIKTGAPCRSER

SEQ ID NO: 85102 - protein, 493 aa, Agrobacterium tumefaciens str. C58
MNRFQTYRREWFSNIRGDVLSGIVVALALIPEAIGFSVIAGVDPKVGLFASFAIACVSAFTGGRPGMISAATAATAVLMVTLVKEHGLQYLFAATILMGVLQIAAGFAKLGRVMRFVSRSVMTGFVNALAILIFMAQLPELIGVPVETYVMIAAGLAIIYLFPLVTKIIPSPLVAIVALTCVAVFSGMDIRTVGDLGELPSTLPIFALPQVPLTFETLQIIFPYSIALAAVGLLESLLTAQIVDDMTDTGSNKSQECIGQGTSNIASALIGGMGGCAMIGQSVINVRSGGRGRLSTFVAGAFLLFLILVLDDLVRIIPMAALVAVMIMVSIGTFSWRSILDLTRNPPSSSIVMLVTVGTVLATHDLAKGVLAGVLLSGVFFAGKVSKLFHVRPELSADGRERIYRVDGQIFFASTESFIAAFDFAEEVEAVTIDVTQAHLWDISAVGALDKVVLKFRKTGKRVEVIGVNEASAHMIDRFALHDKPDAAAAPLH

SEQ ID NO: 85103 - protein, 306 aa, Bradyrhizobium japonicum USDA 110
MSMIAFQTLPFGTEAAKRLAARLGLASDEMTLHRFPDGELRVTVAPAADTTILYAALDQPNDKLIALLFAAEALRRGGAKRLVLVAPYLCYMRQDIAFHAGEAISQRAMGTLLATIVDRVVTVDAHLHRTPDIAAVFPGIEAENLSAMPAIANALVAAGIDPATVVIGPDAESEPWVRDLAGRLDLQHTVARKLRRGDRSVEIDFADAALLAGRPALMVDDIVSSGTTLMVAAKTLRAMGASAVDSVVTHALFPPAMSAAFADAGIRSIRSSDSVPHPTNAIALDEILAAALKRELNTILPPETTT

SEQ ID NO: 85104 - protein, 393 aa, Phytophthora multivesiculata
LVTELGEYRAAVPSGASTGEFEALEMRDGGKEYMGKGVLNAVKNVNDIIAPALVGKDVTKQAELDRFMVEELDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGTKDARYNLDFKNENAPDSEKISAEKLQEVYEGFIAKCAGSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSER

SEQ ID NO: 85105 - protein, 637 aa, Medicago truncatula
MHISFIPGELQDLWDLWGLEILMLMSFTIQVILTVYGSRRKDIPGMGIRLTVWFTYLLSASLAKIIIGKLTIIPESDPDERNIRRELKALFAPLLLVQIGNPDAITAYSIEDNRLGLRQLLTLVLQVAVVIWIIVRSWTHSHLSYLYLPLLVSGLIKYGEVVWTLKSALTKTSGIITVQEIDDQEANMPALFRFLPDDIPNIELILKAYYRFISLKPHRENWLYQPLYDSLPWMSIDEYSPEDIFHITDAELSFMYDVLYTKAPIIYTKAGCILRVVSFSHLVMTLCGFSILFREDFSRHWKACFIVGMLGGAVLLEAYQIAQLPFSDWAIVQMIKHQHRPFMIPCLRILGPRATNWKRWSNTLAQFNLMSFCIHHDIPLKCGRILKFRGIDMMLKKNKNRKRVPFPKELKVLMVEEMKDIDRDRGLKPFNHRGDWSLGRYDCLNDLKWSVKRDFDKSITIWHIATDICYYSDSETNAQYCTKIQMAKSLSDYMMYLLALRPHMLSMTTTGIIFRHACDKLKSLLLQQEESVKDEKEACRILRMERLPHYSNSERKSETVVTSKWHILRDAQRLARNLMVRENRWEIICSVWVEMLCYAAANCNVDYHSEQIRRGGGLITHVWILLAHKTDKYHISD

SEQ ID NO: 85106 - protein, 760 aa, Gibberella zeae PH-1
MGLKTAGDLQSPMIKLVRQRNPSYAGDTTTVNTSLRIVSLQSLEMVWPGTFCNDKHSLPNSIETIYLYVCTIAEMNMNALKNFQSDVKNDVTWNRAARLSVKGAKALPSGTVQYISDKVPIVGWLPRYNLRWLINDLIAGLTLGLMLIPQGLSYAKIANIPVEYGLMSSWLPAVIYAFMGSTKDVSTGPTSLIGLLTSENVHALQDRWTPSEIASATAFMMGIYGMILGFLKLGFLLEFISLPVLSGFITAIAITIILNQMDSLLGEDNVRDGAAKQIHDIFSELPNANGWACLIGFTGILFLTILEKSGKRWSKDNKVIWLLSTTRAFLALVLFTGISYGVNKNREEYLFEVVKVQSEGQQVPTMPKADLIPEVAGRSIAVFIGSAVEHLAIARAFAVKNSYTSDQSQELCYLGITNFFNSFFHAMGVGGAMSRTAVNSSCNVKSPLSGVVTMAVVLVCVYELVGALFWIPKATLAAIIITAVWGLISPPSTFYRYWKTSLADFISSMLALWVTLFHSSEVGIGCAVGFNIVYILLRQVFTRLTSTGADVESNRRPTWALENNHTSPPTIPEDARIFTFNESIIFPNAFANTTKVLDEIQTYHAAYYSGSHGPETERNWSVVGGKRVARLRKKANINDPSSLPGIGLVVLDFSRVNMLDTTAVTYLKNLVSNIKSYGGDGTEVRFANMNAVCRERVARAGWRVIEVGGNGELQGDLEDDGEPIYLYWDTRAAVVAPRRRGSVLTDDGKVHAVHDEKAEV

SEQ ID NO: 85107 - protein, 393 aa, Phytophthora alni
  misc_feature (297)..(297): Xaa can be any naturally occurring amino acid
LVTEIGEYRAAVPSGASTGEFEALEMRDGGKAYMGKGVLNAVKNVNDIIAPALIGKDVTKQAELDRYMVEELDGTQNEWGWCKKKLGANAILGVSLALCRAGAAAKKQPLWQYIADLAGNPTPCLPVPSFNIINGGSHAGNKLAMQEFMILPVGATSFTEAMKIGSEVYHNLKKVIKNRYGLDATAVGDEGGFAPNIQSNGEAINLIEEAIKAAGYTNQVRLGMDVAASEFYTGAEDARYNLDFKNENAAESEKISADKLQEVYEGFIAKCADSSKIVSIEDPFDQDDWASWVKITXKVGKDVQIVGDDLTVTNPTRVKKAIELKACNALLLKVNQIGSITESIEAVTMAKKAGWAIMASHRSGETEDTFIADLAVGLSAGQIKTGAPCRSER

SEQ ID NO: 85108 - protein, 185 aa, Oryza sativa Japonica Group
MEHHHHHVRPDGELRLLLLPATAPTTPRDDDGAAATLFPPAQPPRDHPQLDLSLSIRIGPPPPPPSHTRTATATAQAQAGQQKKASAAAGFDDGDGDDVRALKQQAAEQARLASAERAYAERVMELARRELEVAEREFARARAIWERARGEVHKVERMKEVAAARRIGAAALEITCHACMQRFHS

SEQ ID NO: 85109 - protein, 394 aa, Phytophthora nemorosa
LVTELGEYRAAVPSGASTGEFEALEMRDGGKAYMGKGVLNAVKNVNEIIAPALVGKDVTKQTELDRYMVEQLDGTQNEWGWCKKKLGANAILGVSLALCRAGAAAKKQPLWQYIADLAGNPSPCLPVPSFNIINGGSHAGNKLAMQEFMILPVGATSFTEAMQIGSEVYHNLKKVIKGRYGLDATAVGDEGGFAPNIQSNGEAIDLIEEAIKTAGYTNQVRLGMDVAASEFFTGAKDARYNLDFKNENAPESEKIPAEKLQEVYEGFIAKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSERR

SEQ ID NO: 85110 - protein, 712 aa, Agrobacterium tumefaciens str. C58
MTVIPIVILCGVLSVVYAVWTTKSVLDADQGNERMREIAGYIREGAQAYLTRQYLTIAIVGLIVAVLAWYLLSAIAAIGFVIGAVLSGVAGFVGMHVSVRANLRTAQAASHSLGAGLDIAFKSGAITGMLVAGLALLGVSIYYFVLTSVLGHPPGSRAVIDALVSLGFGASLISIFARLGGGIFTKGADVGGDLVGKVEAGIPEDDPRNPATIADNVGDNVGDCAGMAADLFETYAVSVVATMVLAAIFFAGTPILESAMVYPLAICGACILTSIAGTFFVKLGTNNSIMGALYKGLIATGVFSVAGLAVATYATVGWGTIGTVAGMEITGTNLFFCGLVGLVVTALIVVITEYYTGTNKRPVNSIAQASVTGHGTNVIQGLAVSLESTALPAIVIVGGIIGTYQLGGLFGTGIAVTAMLGLAGMIVALDAFGPVTDNAGGIAEMAGLDPDVRKATDALDAVGNTTKAVTKGYAIGSAGLGALVLFAAYANDLSYFAANGDTYPYFKDIGEISFSLANPYVVAGLLFGGLIPYLFGGIAMTAVGKAASAIVEEVRRQFREKPGIMAGTEKPDYGRAVDLLTKAAIREMVIPSLLPVLAPLVVYFGVLLISGSKASAFAALGASLLGVIINGLFVAISMTSGGGAWDNAKKSFEDGFIDKDGVRHVKGSEAHKASVTGDTVGDPYKDTAGPAVNPAIKITNIVALLLLAVLAH

SEQ ID NO: 85111 - protein, 283 aa, Alkalilimnicola ehrlichei MLHE-1
MQSNEHVLIAGCGQLGTALGQQLAEAGHRVTGLRRRADAIPPPLEPLAADLQRPETLAKLPADIGLVYCILTPDEYSDDGYWRAYHDGLLGLLHGLERAGAQPRRLIFVSSTSVYGHDDGRWVDEWTEPTPATRRAEALLASEQLARESGLETTVVRFSGIYGPGREYLVRLAREGRPCRPNHWTNRIHHEDCVRALAHLRLRDVEATTYIATDCEPVRQCEVLDWLADRVGADRPPRADSDAPVTGKRLSNSFLLASGFRFLYPDYRSGYSFVRRCPEPPAP

SEQ ID NO: 85112 - protein, 647 aa, Medicago truncatula
MACVKLGSKADAFQRQGQAWFCTTGLPSDIVVEVGEMSFHLHKFPLLSRSGVLERSIAKASESEEECAIHLHDIPGGAKTFELVAKFCYGVKLELTASNVVCLWCAAEHLEMTEEYGEGNLISQAETFFNQVVLRSWKDSMRALQTCDDVLDQAEELHIVKRCIESLAAKASTDPNLFGWPVLERGGPLQSPGGSVLWNGISTGARPKNTSLDWWYEDVANLSLPIYKRLIAVMESRGIRQEIIAGSLAFYAKTYLPGLNRRKVSGESSTRLTQAALLSPPSEEDQKILLEEIDQLLPMQKGLVQTKFLFGLLRTAMILRVNPSCISSLEKRIGMQLDQAALEDLLMPNFSYSMETLYNVDCVQRILDHFLAMDQITGGASPCSIDEDGQLIGSPSLTPITMVAKLIDGYLAEVAPDVNLKLPKFQALAAAVPEYARPLDDGLYRAIDIYLKSHPWLVESEREQLCRLMDCQKLSLEACTHAAQNERLPIRIIVQVLFFEQLQLRTSIAGCFLVSDNLDGSRNLRSGLVGSNEGGWASAVKENQVLKVGMDNMRMRVSELEKECSNMRQEIEKLGGKAKGSSTSAWGVVSKKLGFKIKSQMCSAQEGSVSKQNNGHHNVEKLKDRNVKHNRSSSISDKGSVSSIIPS

SEQ ID NO: 85113 - protein, 561 aa, Oryza sativa Indica Group
MYSTAISLSAAATAAAAVGGARPCAIRPAELRFCGLRREALGLRSLRAPPRAAATPRKAAAATGNGAAGSGGFDYDLVIIGAGVGGHGAALHAVEKGLKTAIIEGDVVGGTCVNRGCVPSKALLAVSGRMRELQDEHHMKSLGLQVSTAGYDRQAVADHANNLASKIRSNLTNSMKALGVDILTGFGTIVGKQKVRYGKVGFPDNEITARNIIIATGSVPFVPNGIEIDGKTVFTSDHALKLESVPDWIAIVGSGYIGLEFSDVYTALGSEVTFVEALDQLMPGFDPEIAKLAQRILINPRKIDYHTGVFASKITPAKDGKPVLIELIDAKTKEHKETLEVDAALIATGRAPFTKGLGLENVNVVTQRGFVPVDERMQVMDADGNAVPNLYCIGDANGKLMLAHAASAQGISVVERISGKDNILNHLSIPAACFTHPEISMVGLTEPQAREKADKEGFEISVVKTSFKANTKALAENEGDGLAKMIYRPDTGEILGVHILGLHAADLIHEASNAIALGTRVQDIKFAVHAHPTLSEVLDELFKAAKVNAGVPHSVNEPVAA

SEQ ID NO: 85114 - protein, 321 aa, Arabidopsis thaliana
MVSDLPLDEDDIALLKSPYCDDGGDEDVNSAPNIFTYDNVPLKKRHYLGTSDTFRSFEPLNEHACIVCDIADDGVVPCSGNECPLAVHRKCVELDCEDPATFYCPYCWFKEQATRSTALRTRGVAAAKTLVQYGCSELRSGDIVMTRENSQLENGSDNSLPMQLHENLHQLQELVKHLKARNSQLDESTDQFIDMEKSCGEAYAVVNDQPKRVLWTVNEEKMLREGVEKFSDTINKNMPWKKILEMGKGIFHTTRNSSDLKDKWRNMVRIIILIWLRSRLTSSSSSQRSEIKMERERNAGVMKKMSPTGTIQRLEFVGWYL

SEQ ID NO: 85115 - protein, 161 aa, Oryza sativa Indica Group
MQNPGGHHASPASAAKSKSSTAAAASASGQGSSHHHHHHHSGGGGGGGADASATTLKRKRGVFQKDLQHMMYGFGDDPNPLPETVALVEDIVVEYVTDLVHKAQNVASKRGKLLTEDFLYLIRKDVRKLHRATELLSMNEELKQARKAFDVNEETLATNNE

SEQ ID NO: 85116 - protein, 488 aa, Bordetella bronchiseptica RB50
MGKITGFMEFQRLQEAAEAPQKRLKHWREFVLHLNDEQAKQQAARCMDCGIPFCSNGCPVNNIIPDWNDLVYRQDWRRALDVLHSTNNFPEFTGRICPAPCEAACTLNINSDAVGIKSIEHAIIDKGWAEGWVTPQVPVRKTGKKVAVVGSGPAGLACSQQLARAGHSVTLFEKSDRIGGLLRYGIPDFKLEKSQIDRRIAQMEAEGVEFAPSTYIGNPDDAAADGLTVRTPQSLLADFDAVVMTGGSETPRDLPVPGRELSGVYYAMDFLRQQNKAVAGDRLSGQTLAKDKHVVVIGGGDTGSDCVGTSNRHGAASVTQFELLPQPPECEDKPMVWPYWPLKLRTSSSHDEGCERDWSVATKALAGSDGQVEKLVGVRVEWFKDEATGQMKMREVEDSEFEIPADLVLLAMGFVSPVATVLDAFGVDRDARGNVRANTDDYRTNVDKVFAAGDMRRGQSLVVWAIREGRQCARSVDEYLMGTSELPR

SEQ ID NO: 85117 - protein, 187 aa, Azospirillum brasilense
MSLINTEIKPFKATAFKGGKFIDVSDADLKGKWSVVFFYPADFTFVCPTELEDLADNYSEFQKLGVEIYSVFTDTHFCHKAWHDTSPAIGKIAYTMVGDPTGTICRNFEILIEEKGLADRGTFVVDPDGKIQIIEITAGGIGRDARELLRKVKAAQYVASHPGEVCPAKWEEGEKTLAPSLDLVGKI

SEQ ID NO: 85118 - protein, 370 aa, Bacillus pumilus SAFR-032
MEIQAMVTTNEKDFEKQTLLLDDPKADEVLVKIVASGVCHTDATVLDGTLPVPRPALLGHEGSGIVVKAGSNVTTVQEGDHVVLGFAYCGHCHNCLDGNAGGCENMIPLNFSGRNKHNETPIHTHDHEDVSQFFGQSSFGTYATVDEKNVVKVDKETDLRYLGPFGCGLMTGSGTVLNSLAPAPGTSFVVFGTGAVGLSGLMAAKIAGCDPIIAVDIHDSRLELAKELGATHIINSKHENPAKKIKEITEGKGAHYSFETTGVPEVTLAALHCLRVKGTCATVAVGKRDLTFNVTNDLMLNALTLKGVIEGDAVPQLFIPKLVKFFKNGQFPVEKLAKFYELEDIEQAFEDSKNGSTIKPILILDKEYRV

SEQ ID NO: 85119 - protein, 907 aa, Gibberella zeae PH-1
MSSGAPRPSGRTSANDYRDERPRGSAANLKSDRSDPRKGPSPQPNFSSAHKRSASVNPRATSRHDEERRFESRRVTERTFEAQLERLVPRTTSPERAHRRNAASESRNTSKAPKNDIPDARQSRAGAETPQVPWNPEATLLPHTTAPLASRISIPPLASTIPQAPQPKPLGELSLELQEAAIVEDLLFVFMGYEGQYIRFAKGYNPNEERDRLSGPSFRTLPGLDPSLQDLTQSMLRMATYYVALEAFVDVQSREEFGSVNHALCASIRKFLQDYLVMIAQLETQFLTSDTFTVHVLNIHTMSTSQMMLQLYSLAHELLKKNALLDDETDESEDSGGDDFENILETLRDGGELVPGNMTGKKICKGGVVLGLITRRLESLSGDPSARALLTTLLRDASKPYMNMLNGWLHHGSIHDPHSEFLIKEQKSIRRERLEQDYTDEYWERRYTIRDHDVPPQLEGVKDKVLLAGKYLNVVRECGGVDVSKVAKDVPASFDDNRFLENVNNAYAHANESLMQLLLTAHSLPARLRSLKHYFFLDPSDYFSYFLELGASELRKPVKSVNTGKLQSLLDLVLRQPGSLVSLDPFKEDVKVEMNETILTKALQRVVNITGIEQGEALQPLANQPVDNDKNAVGFTSLQLDYSVPFPVSLVISRKTVWRYQALFRYLLSLRYLESQLSTTWQTQTRGVSWAHKGGSRKLEIWKRRVWTLRAPEVIEPNWNKFMSRLKTKDESLDTSLGVSTRTVDELMQDHVDFLDTCLKECMLTNSKLLRIHSKLMQTCTIFAAYTNWLTRELEKSDPDLSGTNKPSTMTADQWKRFQMTKAVQRGSTSAQGDSSGSSEADARIDNLFEIIRKWESNFSRHLQILLDALNHYAATETVVLLSLCARLSTANQGTEYAGLRQEEEST

SEQ ID NO: 85120 - protein, 230 aa, Arabidopsis thaliana
MSEETKDNQRLQRPAPRLNERILSSLSRRSVAAHPWHDLEIGPGAPQIFNVVVEITKGSKVKYELDKKTGLIKVDRILYSSVVYPHNYGFVPRTLCEDNDPIDVLVIMQEPVLPGCFLRARAIGLMPMIDQGEKDDKIIAVCVDDPEYKHYTDIKELPPHRLSEIRRFFEDCILFLQCSSLFISIDLSTNKKNENKEVAVNDFLPSESAVEAIQYSMDLYAEYILHTLRR

SEQ ID NO: 85121 - protein, 129 aa, Helicosporidium sp. ex Simulium jonesii
MAFLQRGFAGLRQGVLAKVRLAPGSSVFQGLAASQCQAVRGFAESSYLSKSDVTARVLDIVKNFEKVDAGKVTESAAFQKDLGLDSLDTVELVMALEEEFAIEIPDAEADKILSVSEAVSYITSNPLAK

SEQ ID NO: 85122 - protein, 259 aa, Rubrobacter xylanophilus DSM 9941
MIVRKSRAELEAMREGGRITAACLRLLAENARPGTTTRELDALAEEFIYSSGGKPEFKGYQGFPASICASPNSMIVHGIPGPYRLREGDIISLDVGVRFEGFVTDSATTVPVGEVSEEARRLLEVTRRCLEAAIPQVRVGRRLGDIGHAIQSVAEPEGYGVVRDLVSHGVGRRMHEDPQIPNYGRPGTGPRLLPGMTFAIEPMITLGTHEIRIDERDGWSIYTADGSLAAHFEHTVAVTEEGPWVLTLEEEGLGEAASA

SEQ ID NO: 85123 - protein, 393 aa, Phytophthora kelmania
LVTEIGEYRAAVPSGASTGEFEALEMRDGGKDYMGKGVLNAVKNVNEIIAPALVGKDVTKQVELDRYMVETLDGTQNEWGWCKKKLGANAILGVSLALCRAGAAAKKQPLWQYIADLAGNPSPCLPVPSFNIINGGSHAGNKLAMQEFMILPVGATSFTEAMKIGSEVYHNLKKVIKGRYGLDATAVGDEGGFAPNIQANAEAIDLIEEAIKAAGYTNQVRLGMDVAASEFYTGAKDARYNLDFKNANAPESEKIPADKLQEMYEGFISKCADSSKIVSIEDPFDQDDWESWVKFTGKVGKDVQIVGDDLTVTNPTRVKKAIELKACNALLLKVNQIGSITESIEAVTMAKKAGWAIMASHRSGETEDTFIADLAVGLSAGQIKTGAPCRSER

SEQ ID NO: 85124 - protein, 439 aa, Yersinia pseudotuberculosis
MLSLDQIPHHIRHGIVGSRLIQIRGRVTQVTGTLLKAVVPGVRIGELCYLRNPDNSLSLQAEVIGFAQHQALLIPLGEMYGISSNTEVSPTGTMHQVGVGEHLLGQVLDGLGQPFDGGHLPEPAAWYPVYQDAPAPMSRKLITTPLSLGIRVIDGLLTCGEGQRMGIFAAAGGGKSTLLASLIRSAEVDVTVLALIGERGPEVREFIESDLGEEGLRKAFLVVATSDRPSMERAKAGFVATSIAEYFRDQGKRVLLLMDSVTRFARAQREIGLAAGEPPTRRGYPPSVFAALPRLMERAGQSSKGSITALYTVLVEGDDMTEPVADETRSILDGHIILSRKLAAANHYPAIDVLRSASRVMNQIVSKEHKTWAGHLRRLLAKYEEVELLLQIGEYQKGQDKEADQAIERMGAIRGWLCQGTHELSHFNETLNLLETLTQ

SEQ ID NO: 85125 - protein, 601 aa, Oryza sativa Japonica Group
MAQIPNLDNAPLNLAALREQSQKDLLNILKSIRGKKCVVIDPKLAGTLSLILQTSLLKEYGAELRLLSAEPLQTECAKILYLVRSELKFMKLIASQIKNDEPKGLQREFFLYFVPRRTVACEKILEEEKVHQKLTLGEYPLYLVPLDEDVICFELDHSLQECLIEGDTSSVWHVAKAIHKLEFAFGVIPNVRAKGVASTKAAELLNSMQQEDPVNMDDMGTPEINTVILLDREVDLVTPMCSQLTYEGLLDEMLQINNGSVEVDATIMGAQQDGKKVKVPLNSSDKLYKEIRDLNFEVVVQVLRQKATSIQQDYAEVKSTNTQSVSELKDFVKRLHSLPEIARHVHLAQHLQSFTGKPSFHARLDIEQTILEVQNFEICFEYIEEMIHKQEPIENVLRLLVLLSLTNAGLPKKNFDYLRREILHSYGFEHMPLLYNLEKAGLFKRQESRSNWIGITRALQLIVDVNDTANPSDISYIFSGYAPLSIRLVQHAVRSGWRSIEELLKLLPGPHLDLKRGSSAINSSLDVHQGLGLQQSIDRVGHRSLVLVVFIGGVTFAEIAALRFLSSQEGMGYDFLVATTKVVNGNTILRPIITNSKEVMI

SEQ ID NO: 85126 - protein, 394 aa, Phytophthora infestans
  misc_feature (297)..(297): Xaa can be any naturally occurring amino acid
LVTELGEYRAAVPSGASTGEFEALEMRDGGKDYMGKGVLNAVKNVNEIIAPALIGKDVTKQAEIDRFMVEKLDGTQNEWGWCKKKLGANAILGVSLALCRAGAAAKKQPLWQHIADLAGNPTPCLPVPSFNIINGGSHAGNKLAMQEFMILPVGAKNFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKCADSSKIVSIEDPFDQDDWESWVKITXKVGKDVQIVGDDLTVTNPTRVKKAIEQKACNALLLKVNQIGSITESIEAVTMAKKAGWGIMASHRSGETEDTFIADLAVGLSAGQIKTGAPCRSERR

SEQ ID NO: 85127 - protein, 389 aa, Phytophthora capsici
EIGEYRAAVPSGASTGEFEALEMRDGGKDYMGKGVLNAVKNVNEIIAPALVGKDVTKQAELDRFMVEELDGTQNEWGWCKKKLGANAILGVSLALCRGGAAAKKQPLWQYIADLAGNPSPCLPVPSFNIINGGSHAGNKLAMQEFMILPVGATSFTESMKIGSEVYHNLKKVIKGRYGLDATAVGDEGGFAPNIQSNGEAIDLIEEAIKAAGYTNQVRLGMDVAASEFYTGASDARYNLDFKNENAPESEKIPADKLQEVYEGFIAKCADSSKIVSIEDPFDQDDWASWVKFTAKVGKDVQIVGDDLTVTNPTRVKKAIEQKACNALLLKVNQIGSITESIEAVTMAKKAGWAIMASHRSGETEDTFIASLAVGLSAGQIKTGAPCRSE

SEQ ID NO: 85128 - protein, 223 aa, Oryza sativa Indica Group
MAAAGSIGVYKAVFAALGALMLGTLVYTCVTDGSPFRLELLTPWLVATLIDFYVNVTAISTWVIYKEVNWISSFFWVVLLYCFGSIATCAYVVVKLFEIKTSGPSQDPLDLLFLRQGNLSQRKSSFVIIGRIIFSFLGAMMAAVVIYTVITDGLPFRKDLLTPWMAATLLDFYINVFAISGTGMGCSQGVKLDIYCYLDMLVNMLWKEDLKNSLKVYAILGVQ

SEQ ID NO: 85129 - protein, 390 aa, Phytophthora infestans
  misc_feature (269)..(269): Xaa can be any naturally occurring amino acid
TELGEYRAAVPSGASTGEFEALEMRDGGKDYMGKGVLNAVKNVNEIIAPALIGKDVTKQAEIDRFMVEKLDGTQNEWGWCKKKLGANAILGVSLALCRAGAAAKKQPLWQHIADLAGNPTPCLPVPSFNIINGGSHAGNKLAMQEFMILPVGAKNFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKXADSSKIVSIEDPFDQDDWESWVKITSKVGKDVQIVGDDLTVTNPTRVKKAIEQKACNALLLKVNQIGSITESIEAVTMAKKAGWGIMASHRSGETEDTFIADLAVGLSAGQIKTGAPCRSE

SEQ ID NO: 85130 - protein, 79 aa, Arabidopsis thaliana
  misc_feature (46)..(47): Xaa can be any naturally occurring amino acid
  misc_feature (51)..(51): Xaa can be any naturally occurring amino acid
  misc_feature (58)..(60): Xaa can be any naturally occurring amino acid
  misc_feature (73)..(73): Xaa can be any naturally occurring amino acid
MASFMFLSTAVVTYPAQAGGVTPYTGLKSYSTFPDTRIANIYITKXXSNGXRVSCINXXXPILKNNYDTLSDXLDLTDL

SEQ ID NO: 85131 - protein, 392 aa, Phytophthora infestans
LVTELGEYRAAVPSGASTGEFEALEMRDGGKDYMGKGVLNAVKNVNEIIAPALIGKDVTKQAEIDRFMVEKLDGTQNEWGWCKKKLGANAILGVSLALCRAGAAAKKQPLWQHIADLAGNPTPCLPVPSFNIINGGSHAGNKLAMQEFMILPVGAKNFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKCADSSKIVSIEDPFDQDDWESWVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSE

SEQ ID NO: 85132 - protein, 128 aa, Zea mays
GGGEPGRGTPPQRGGRERGGAPQKPPPGGGFCSPPPKGGVPPGADLDPKWGGGLDLSIRRVAFSSPGGAFGGLPLFRSPNTRWGSVALGTGVGIGAASPEGPYLFNGAPKCSPKVSPFPFAPFDGGDK

SEQ ID NO: 85133 - protein, 843 aa, Synechocystis sp. PCC 6803
MRAVLMAGGAGTRLRPLTCDLPKPMVPIVNQPIAAHIIHLLRRHNITEVVATLHYLPDAMRDYFLDGSEFGVQMTYAVEDEHPLGTAGCVKNIEELLDDTFLVISGDSITDFNLTQAIAFHKQKQAKATLILTKVPNPLEFGVVITDENQRVQRFLEKPSTSEVFSDTVNTGTYILEPEVLAYLPPKEEMDFSKDLFPLLLENDEPMYGFVADGYWCDVGNLDAYREAQYDALEKKVTLELGNLPRHSDIWIGENTTIDPTAILTPPLAIGDNCNIGSGTKLEAGTIIGDNVTIGAGAELKRAIVWNGVLIGDEAYLAACVVGRGCRIERRVQVLEGAVIGPLSIIGEEAQINSNVKVWPSKRVEPGAILNINLIWGSTGHRNLFGQRGVSGIVNIDMTPEFAVKLGAAYGSSLRPGAEIVVSRDQRNVSRMVTRSLIAGLMSVGVNIQNLEATAIPIARTMTPKLKVAGGIHVRIHPDRPDYLLIEFLDSQGINISKKTEKKIEGAYFKEDLRRVSIPQIGDMSYPAQVLETYCHTFEKLLDMDIINNDGAKIVIDYAYGVSGAILPLLLTKFGCDAVVLNASLRQTAVSNEEKEVLLSQLGQVVSALQANLGVQVSANGEQLTLVDEGGLPIRGELLTALMVHMVLTASPRGTIVVPVQASSAVEHLARRHGGKVLRTKANPTALMAAAQSSHNVVLGGSGETGFIFPRLHPGFDAMFCIAKVMEMLTVQKRTLGEIRSELPTVYHNSCSVRCSWKIKGALMRHLVEIHRDQHIELVDGVKMTFPHGDNWVLILPDAGEPLVHIYANSEDRHWVDEKLRYYQAQVLNFISDAQEESYQHFS

SEQ ID NO: 85134 - protein, 411 aa, Candidatus Blochmannia floridanus
MILYPIKKIRLDFPILSTLMNSYPLAYLDNAATTQKPNIVIDSQSYYYKNECSAAHRSVHSLSSISTNHIETVRTYIAKFINTSIPEEIIFVKGVTDAINFIANSWGRNFINYGDNILISAMEHHANILPWQNLAKEKKIELNYIPLLPDGSLNLSKLSELINRRTKLLSISHISNVLGIINPLTEIIDIVRTKSNARILIDGAQGIAHQKVDVQKLDCDFYVFSGHKIYATYGVGIMYGKYELLNTMDPWVVGGGIVKNVSLTQEPTFVDIPWKFEPGSPDVSGIVALGNAVKYINTIGIKNIYNYENQLISYAINTLKQQNLHLTLYGSDCNKSSIIAFNLKSYDSYDVGMLLNQYGVAIRTGHHCAIPLMNHFQVPGMCRASIAMYTNKDDIDQFIHGLNQIKHLFHA

SEQ ID NO: 85135 - protein, 475 aa, Glycine max
MAVSLAMRLVRRRSPPLLWRRSFSMSAVDAEKEVVVVPELPPFDYSPPPYVGPTAEEILAKRREYLSPSILHSYKNPVNIVEGKKQYLFDEKGRRYVDAFGGIATVCCGHCHHDVVEAIVNQTKKLQHSTVLYLNHVITDFAQALASKLPSDLKVVFFTNSGTEANELAMLIARLYTGCHDIISLRNAYHGNATGTMAATAQSIWKFNVVQSGVHHAVNPDPYRGIFGSDGEKYARDVQDIINFGTSGNVAAFISEAIQGVGGIIELAPGYLPVVYNTIKKAGGLFIADEVQAGFGRTGSHFWGFEAHNVVPDIVTIAKGIGNGIPLGAVVTTPEIAEVLTRRSYFNTFGGNPVCTAAGLAVLKVIEKEQLQQNAFVVGSHLKERLTALKDKYELIGDVRGRGLMLGVELVTDRELKTPAKNETLHVMDQMKELGVLIGKGGYYGNVFRITPPLCFTKEDADFVADAMDLTLSRM

SEQ ID NO: 85136 - protein, 499 aa, Aspergillus nidulans FGSC A4
MAQQYKLPFELDNPDLLHFDSYVGNAWVTAKSGARFEVVDPGTDLPWASCPTNSAEDVDSAVQIAHDAFEKFKKVNPRQRAQWLLKWDSLIREARSDLAKILTHETGKPIAESYGEIDYATGFTWWFAGEAERIQGSIAVPAAPNRRVFTVKQPIGVAAALVPWNFPIAMVLRKAGAALAAGCTMIVKPSPETPLTALVLAHLAEKAGFPAGVFNVLTTDLENTPPLSEALCKHPLVKKVTFTGSTRVGKLIASHCAHGLKKVTLELGGNCPFLVFDDADLDQALDQLMALKWRHAGQACITANRIYVQAGIYDKFAQLLKERTAKLVIGHGAKEGTTLGPLTTPRSIDKAISQVEDARRLGADVILGGSRVQGTQGYFFEPTILKNMTKDMLVSREESFAPIAALYRFETEEEAVKLANDTSMGLASYAFSKNIDRMWRLLENLEAGMIGMNTGNSSAAESPFGGIKESGYGKESGKEVAVNEYLITKTGTLTIDGQY

SEQ ID NO: 85137 - protein, 224 aa, Solanum habrochaites
FLMQKELDYLVGAVSNPQKPFAAIVGGSKVSSKIGVIESLLEKVDVLLLGGGMIFTFYKAQGYAVGSSLVEEDKLELATSLMEKAKTKGVSLLLPTDVVIADKFAADANSKIVPASEIPDGWMGLDIGPDAIKSFGSALDTTKTIIWNGPMGVFEFDKFAAGTEAIAKKLAELSGKGVTTIIGGGDSVAAVEKVGLAEKMSHISTGGGASLELLEGKQLPGVLA

SEQ ID NO: 85138 - protein, 96 aa, Medicago truncatula
MAARCNGSILVVMSLLLLVTFSNVAEAYGRAKLRPQDCKPRCTYRCSATSHKKPCMFFCQKCCATCLCVPPGVYGNKQVCPCYNSWKTQEGKPKCP

SEQ ID NO: 85139 - protein, 196 aa, Hyacinthus orientalis
MSPDSSRSPPRTRRFRSERDRPSHRVTPYRRDPREHRGFRQDVICKNCKRPGHFARDCSHIAVCNNCGLPGHIAAECTAKTLCWNCKEPGHMANECSNEAVCHNCNKTGHLARDCSASGLSSFDTRLCNNCHRPGHIAADCTNDKTCNNCRKPGHLARECTNDPVCNVCNVSGHVARQCPKSNLPSEIHGRARSVI

SEQ ID NO: 85140 - protein, 257 aa, Wolinella succinogenes DSM 1740
MEKKPLRAYCNATRYDFNALREFLENRHRVMLVRDCLQIELKEGLVFLFEYGGVVFWDCDYETQKALLDSIAPFSVGILSEVVVDDFEYILEPEASSRIHNDTIRLSEETPLQKLAFSHGIIQSTKLASFENLIQSTIDETRHLPESLAQSGKILLSRREIAKLRGKLFLAKADIHLHFELLDTPEFFWEYPTLEPYYQEIRQYLDIPSRIEVLGQKLSVIEELLTMLADEQNHKHSANLEWIIIILIAIEILLYLH

SEQ ID NO: 85141 - protein, 347 aa, Zea mays
  misc_feature (274)..(274): Xaa can be any naturally occurring amino acid
MKKLHWLVRVLFGPESGQHSALLDLDNDTASFGVFDGHGGKVVAKFCAKYLHIEVLHTEAYAAGDLGAAVHRAYLRMDEMMRGQRGWQELQALGDKINQFTGITEGLIWSPKASDSNDRHDDWAFEEGPHSDFTGPNCGSTACVALVRNRQLVVANAGDSRCVISRNGQAYNLSRDHKPELEAERERIQSAGGYIKMGHVNGSLNLSRAIGDMELKQNKFLSPDKQILTANPDINIVELCDDDEFIVLACDGIWDCMSSQQLVDFIREHINTCXEESLSAVCEGVLDRCLAPSTMGGEGCDNMTMILVQFKKPFAQVKDASDAEQLTGDAGCSETHGAEENDSDKQI

SEQ ID NO: 85142 - protein, 471 aa, Mycoplasma penetrans HF-2
MEYNKKIVTDLTDLKGKKVILRCDFNVPINKTSGEITDYTRIDAALQTINYLLDKGVKLIVLSHLSRVKTLEDISSGKKSLKVVHKALKNRLLGKTVLFEENNRNKDLPKIIDGMEEGSLLLLENTRYADVNEKGEVVKLESKNDPSLGKFWASLADIFVNDAFGTSHRAHASNVGIAKNIKESAIGFLVNKELAKLSKAVVNPRKPVVAIFGGAKVSDKVPSIKNIGKFADKILIGGGMAFIFLKAKGFEIGKSLYEDDQLELTKELLSEFGNKIVLPVDAVVADSIKAAKGKRYDMEQFPADLAGFDVGKKTIKLFKKELKLAETVIWNGPLGVFENDAFNKGTLKVCKYIAKITAKKGCYSVIGGGDSAAAAAKCGVTHSFSHISTGGGASLEFFSGVELPGVACIKNKGEEGKVEAVKEKTTTTTESASKEKSSTAKTASKPATSKTTAAKKPAEKKPAAKKPAAKK

SEQ ID NO: 85143 - protein, 357 aa, Aspergillus nidulans FGSC A4
MAKTYRIATIPADGIGPEVIDAGVIVLKALADKLQSFSLDFTHLDWSSETFKATGKYIPDGGLEVLKKNDAILFGAVGAPDVPDHISLWGLRLAICQPFQQYANVRPTRVLRGTQSPLRKCNTGDLDWVIVRENSEGEYAGQGGRSHRGHPWEVATEVAIFSRQGVERIMRFAFETAAKRPRKLLTVVTKSNAQRNGMVLWDEVANIVAKDFPEVTMDKMLVDAMTTRMVLKPESLDTIVASNLHADILSDLAAALAGSIGIAPTSNLDPTRQNPSMFEPIHGSAFDITGKGIANPVATFWTAAEMLEWLGEKDAADKLMQCVESVCESGILTADLGGTATTKEVTSAVVEEINRLN

SEQ ID NO: 85144 - protein, 98 aa, Hyacinthus orientalis
DAIPDPKAVQYVRNDRGTPMKLDNNYYNNILNNKGLLLVDHQLAYDSRTKPFVKKMAKSQDYFFREFARAITLLSENNPLTGSKGEIRKQCNVVNKHD

SEQ ID NO: 85145 - protein, 333 aa, Mycoplasma penetrans HF-2
MIKVAINGFGRIGRLALRRIFDVCKNVEIVAINDLTDAKTLCHLLKYDTAHRTFKGKLSYDENNNLIIDGKKIPILAEKDPANLPWAKLGVDIVVESTGRFVDEEGASKHLKAGAKKVIISAPAKGNIPTVVYNVNHQTLKATDKIVSAASCTTNALAPVANVLSKEFGIKWGFMNTIHSYTADQRLQDAPHSDLRRARAAAMSIVPTSTGAAKAIGLVLPELNKKMHGMALRVPTITGSLVDITVELEKDTTVEEIHKAMKKAANETLEYCEDPIVSTDIIGNTHGSIFDPGLSMELETNGKKTFKLFTWYDNEYSYVAQFVRVLEYFGNLK

SEQ ID NO: 85146 - protein, 401 aa, Wolinella succinogenes DSM 1740
MLIVQKYGGTSVGDLDRIQNVANKVAKTKKEGHRLVVVVSAMSGETDKLLGYAKHFSQIPDPRELDMILSSGERVTSALLALALQAMGFKSISLSGRGAGMITDKSHSKARIDHIDTARIDSLLEDDTIVVVAGFQGITPDGEVTTLGRGGSDLSAVALAGALKADLCEIYTDVEGVYTTDPRIEPKAKKIDKISYDEMLELASMGAKVLLNRSVELAKKLNVNLITKSSFSDNPGTLITKEEEIMENPVVSGIALDKNQARVSITNVQDRPGIAAEIFGALAEANINVDMIVQTIGYDSLTDMDFTIPKTELESAKLVLKRFEGSVGGIEFDDNIAKVSIVGVGMKSHTGVASKAFKALAQDNINIMMISTSEIKISMIINLKYAELSVRTLHATYELDK

SEQ ID NO: 85147 - protein, 276 aa, Lactobacillus acidophilus NCFM
MKRSERLVDMTKYLMERPHTLIALPFFAKRYGAAKSSISEDLAILKHTLASNQDGILETVAGAAGGVRYIPFLGKSHAEDYLSDLTARIEDPSRILAGGFVYLSDILGNTQDLRRIGELVATHYAYEEIDAVMTVETKGIALAQAIARYLDVPFVTARKRSKVTEGATVSVNYISSSLSRVSKMELPTRALKKGSKVLIVDDFMKGGGTLTGMEELVKEFEGTIAGVCVLCEADFDNEKLINNYLSLVKISEIDTTQKIISAEPGNFLDETDFDRF

SEQ ID NO: 85148 - protein, 477 aa, Oryza sativa Japonica Group
MGERARQWLLVAGAGAAVGALSTAAVMRILSRSKRREGYVRSLLESNGVASGGAGSSVGTRVVATSDLLDDEVVSEQLTRNIQFFGMESQKKVTGSFVVVIGLGGVGSHAASMLLRSGVGRLLLVDFDQVSLSSLNRHAVATRDDVGTPKALCLKKHFSMIYPECQIEAKVQLYDPSCEDEILSGQPDFVLDCIDNIDTKVALLAACVRRGLRVLSAMGAGARADPTRIRVADLRESSNDPLSRAVRYRLKKDHGIEGGIPVVFSLEKPKAKLLPFQASKEEETPSDYQIVPGFRVRIIPVLGTIPAIFGQVMASYVITQLAKLDFQTEPIVNMDLDHYRILHHRLLEHEELIYGSAEQVLVDAEEVMYIVKELWRGRSARDQNLKDTGRKMWRSVNELMLVRWDKSKPAGVSNLILLKFNETPDNGKLTSNISGHAFLRGADAHESTTLDQIKEEEPEFYNMVSRVLKQAEAEFAL

SEQ ID NO: 85149 - protein, 316 aa, Gibberella zeae PH-1
MATAQETMSKTTEASTPAKVTADAKKAMIRYPFWFGGSASSMAACVTHPLDLVKVRLQMRTGNAPKNMVGTFVHILRNDGPLGLYSGISASLLRQMSYSTVRFGVYEELKTRITRRNEGRDPSFATLVGLAAGSGFVGGIAGNFADVLNVRMQHDAALPHAERRNYRHAFDGMVRMAREEGPKSMFRGWLPNSSRAMFMTAGQLASYDISKSLLLKYTPMEDNLKTHFTASFIAGFVAATITSPVDVIKTRVMSSTHDHGVLHLIRDIHRTDGLMWMFKGWVPSFLRLGPQTICTFVFLEMHRKAYRKVQGLDANL

SEQ ID NO: 85150 - protein, 284 aa, Zea mays
MAAGRELVVSFGEMLIDFVPTVAGVSLAEAPAFLKAPGGAPANVAIAVSRLGGGAAFVGKLGDDEFGRMLAAILRDNGVDDGGVVFDSGARTALAFVTLRADGEREFMFYRNPSADMLLTADELNVELIKRAAVFHYGSISLIAEPCRTAHLRAMEIAKEAGALLSYDPNLREALWPSREEARTQILSIWDQADIVKVSEVELEFLTGIDSVEDDVVMKLWRPTMKLLLVTLGDQGCKYYARDEKKLVESIKFANACGAITTTKKGAIPSLPTEAEVLQLIEKA

SEQ ID NO: 85151 - protein, 369 aa, Rhodopseudomonas palustris CGA009
MVGSCFRDPIMAHPIQEVLQAFAAGEIVVVTDDDDREGEGDLVVAASLCTAEKMAFIIRHTSGIVCAPITMEDARRLRLDPMVAHNDSNHTTAFTVSIDYKPDNGTGISADERASCCRALANPNAGAADFARPGHIFPLIAREGGVLLRSGHTEAAVDLCKLAGLPPVGVISELMNDDGTVTKGAQVVAFAKKHNLKLVTIADLIAHRQAREKLIERVATFPVESPIGVMQGYAYRSPFDEIAHIAFVFNGVGDGKNVLTRFHKPNIVKEIFTGPRRMESVLAQFKKNGSGVLIYLRDGAAGVPVSPIDEQKTAEADRHRQWREIGVGAQILRDLGVTSIRHLTTSQIDYKGLSGFGIEIVGNEHLEGT

SEQ ID NO: 85152 - protein, 429 aa, Oryza sativa
  misc_feature (105)..(105): Xaa can be any naturally occurring amino acid
  misc_feature (117)..(117): Xaa can be any naturally occurring amino acid
  misc_feature (124)..(124): Xaa can be any naturally occurring amino acid
  misc_feature (168)..(168): Xaa can be any naturally occurring amino acid
MARGAHQAPGGFWTVAAAPTRCSLPHSLPIPLHAAAAAAAWMAGVSAASAAGKIGSFLSKRPYAPPSWASHLSPAPSQTFSLGHFPTPIHKWNLPNLPNGTEVWXIKRDDISGMQLXSGNKVRXLEFLMADAVAQGADCVITVGGIQSNHCRATAVAAKYINLDCYLXILRTSKLLVDKDPGLVGNLLVERLVGAHIDLVSKEEYGKIGSVALADLLKKKLLEEGRKPYVIPVGGSNSLGTWGYIEAIREIEHQIQISGDVQFDDIVVACGSGGTIAGLALGSKLSSLKAKVHAFSVCDDPGYFHSYVQDLIDGLHSDLRSHDLVNIENAKGLGYAMNTAEELKFVKDIATATGIVLDPVYSGKAAYGMLKDMGANPAKWEGRKILFVHTGGLLGLYDKVDELSSLSGSWRRMDLEESVPRKDGTGKMF

SEQ ID NO: 85153 - protein, 309 aa, Kineococcus radiotolerans SRS30216
MPRTAPVPPELPAGVHGEAAVEVLRMSAFAARPHGGNPAGVVLDAAAWSEERMQAVAVEVGYAETAFVVDAAVGGDPRHVRVRYFSPAAEVPFCGHATIATAVALAARRGVGPFTVDTAVGPVAIETALDDGGRVAASFTSVEPAVRDLDDAVATRLLGLLGLRRADLDARWPLREAFAGNWHPVVAVRERGVFDGFTFAPAAVRALMDEQGWAGTVTVVHAPGDGSPAPGVTLVEARNLFPVGDITEDPATGAAAAALGAYLRAEELIAVPARVVVHQGHHVGRPSVLAVDVPVAGGITVSGTAVPLP

SEQ ID NO: 85154 - protein, 295 aa, Synechocystis sp. PCC 6803
MPVNSPAPWQTIAQQISQTTGQPFRIQERRSVSGGCINQGYCLVDGEQKYFVKLNQAQQWQMFQAEALGLEAMAATQTIRVPRPICHGSSAGHSYLVLEWLEFGRGNHDSWYRMGQNLAALHQAGGSAQFGWQTDNTIGATPQPNPWTDSWADFFAEHRLGYQLALARRRAGNFPDPAVVVPKVKQLLGDRQPTPALVHGDLWSGNGAILTTGEPVILDPATYYGDGEVDLAMTELFGGFPAAFYQGYHSISPAEPGYQQRKILYNLYHILNHFNLFGGGYQQQAQQMLKQCLRI

SEQ ID NO: 85155 - protein, 393 aa, Phytophthora nicotianae
LVTELGEYRAAVPSGASTGEFEALEMRDGGKDYMGKGVLNAVRNVNEIIAPALVGKDVTKQAEIDRFMVEELDGTQNEWGWCKKKLGANAILGVSLALCRAGAAAKKQPLWQHIADLAGNPTPCLPVPSFNIINGGSHAGNKLAMQEFMILPVGATSFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKISADKLQEVYEGFIAKCANSSKIVSIEDPFDQDDWASWVKFTGKVGKDVQIVGDDLTVTNPTRVKKAIEQKACNALLLKVNQIGSITESIEAVTMAKKAGWGIMASHRSGETEDTFIADLAVGLSAGQIKTGAPCRSER

SEQ ID NO: 85156 - protein, 296 aa, Xanthomonas axonopodis pv. citri str. 306
MQTEKVVVSTDIGDDIDDAFALGLLLRRPQLQVLGIASAWGDTTLRVQLLQRLLQQAGRSEIPLAVGARTTSSIAFSQAGWAAKGQVPAALPDAAAMILQQARQHPGEVTLLVLGPMTDAALAQQRDPAGFAKLKRVVAMGGSVRVGYGKSAYRPASTPVPEYNILADVPAAQRVFSSGVPIVLLPLDATQITLEEPERVALFAHGDGLTDALTQLYYQWRNTDQPWASATPTLFDVVPVAWLLRPALCPTTPLHLDVDAQGYTREGAGAPNVQACLRVDKPALIELYMRALLELP

SEQ ID NO: 85157 - protein, 546 aa, Colwellia psychrerythraea 34H
MSSRQTLASWKKLQLLAQDKKSQHMNTLFAQDSERFNKFSIELPNMLLDYSKNLIDTETLDALLALAEETQVCDWRAKMFAGEKINKTEDRAVLHTALRRQSDEAFIIEGENVTEHVKNQLAEMEVFVNKVRQGHWLGYSGKRITDIVNIGVGGSNLGPQMVTEALKHYSDGSVNVHYVSNVDGAQIAEVLRPLEPEKVLFIVSSKTFTTTETMTNARTAINWLTSASFDENSVAKHFVAVTANKENAMSFGIEEQNIFDMWDWVGGRFSLWSAIGLAIALDLGFDKFEELLAGAHDMDQHFINAPLKDNFPAILALISVWNTTFLGSQSQAILPYDQTLHMLTAYLQQAEMESNGKSVSWDGDEIDYATVPSIWGELGINGQHAFYQYLHQSNNVVPADFIGSVKSVTPVKGHHETLMANFFAQTQALMVGVNEEQVRADLKAKGRNAEYIDNVAPHKVHKGNRPTNTILLKCINPRNLGSLIAAYEHKIFVQGIILQICSFDQWGVELGKGLAAEIQTELQTDNISAQHDCSTSSLLKFYQSAK

SEQ ID NO: 85158 - protein, 251 aa, Asparagus officinalis
MKFNIANPTTGCQKKLEIDDDQKLRAFYDKRISQEVSGDALGEEFKGYVFKIMGGCDKQGFPMKQGVLTPGRVRLLLHRGTPCFRGYGRRNGERRRKSVRGCIVSPDLSVLNLVIVKKGENDLPGLTDVEKPRMRGPKRASKIRKLFNLSKEDDVRKYVNTYRRTFTNKKGKTCSKAPKIQRLVTPLTLQRKRARIAEKKKRVAKAKSEAAEYQKLLASRLKEQRDRRSESLAKKRSRLSAAAAKTASVSA

SEQ ID NO: 85159 - protein, 289 aa, Saccharomyces cerevisiae
GAMPPIFLPPPNYLFVRDVWKSNLYSEFAVIRQLVSQYNHVSISTEFVGTLARPIGTFRSKVDYHYQTMRANVDFLNPIQLGLSLSDANGNKPDNGPSTWQFNFEFDPKKEIMSTESLELLRKSGINFEKHENLGIDVFEFSQLLMDSGLMMDDSVTWITYHAAYDLGFLINILMNDSMPNNKEDFEWWVHQYMPNFYDLNLVYKIIQEFKNPQLQQSSQQQQQQQYSLTTLADELGLPRFSIFTTTGGQSLLMLLSFCQLSKLSMHKFPNGTDFAKYQGVIYGIDGDQ

SEQ ID NO: 85160 - protein, 424 aa, Agrobacterium tumefaciens str. C58
MNFNGLTIVDKQLVEAARREVREIFPETPLQLNEHLSRRYGASIWLKREDLSPVRSYKIRGAFNFLRKAVAKAGKDKVFVCASAGNHAQGFAFACRHFGVHGVVFMPVTTPQQKIEKTRIFGGEFIKIRLVGDIFDQCYAAARQHVQDHDGYMVPPFDHEDIIEGQATVAAEIMDQLPEGTKPDIVVMPVGGGGLSAGLTGFLAGTVKKENFVFCEPEGAPSLKKSLERGEPVTLNKVDNFVDGAAVARIGDLNFKALKDFPAEQVMLIPENAICVTIIEMLNLEGVVLEPAGALSIAALERLGRERLEGKTVIAVVSGGNFDFERLPDVKERAMRYTGVKKYFILRLPQRPGALRDFLNLLGPDDDIARFEYLKKSARNFGSILIGIETNAQENFAGLLERFEAAGLGYEDITENDILSNLII

SEQ ID NO: 85161 - protein, 482 aa, Prochlorococcus marinus str. AS9601
MLEILSHQYLKNFLRDQSISWEHIYSFGRIISKCIENDSTYLINSEIFSSYDWLPPILISLFLKEEDSTFILSKEKIQFISQFQIDSLRNLGFNFIFKNDQLIFANHHIRLITIQNLLNDPNSRNLRNHRIVYSGIEDIKQDLKNHFRISLVKKDWTKNFNEFELINQKFIKVYDSLKKKFLMRKVLGNSFINLNEKEISFFSNFFHENSFFSDKFFMVNKALSKGWACWVKLNETNLDWTLYLQPIDELSHIKEFFSNNKFVFLSALRKDNFFQMYFKKHSLDIDLVINFKSNFEEKKISLYIPSRQLLPNNPLFTNSILDKCKKLILFRKGLTLVLSDDIDLKTNIATELASKYGKRVLLETIPSGKNQILCSSFDWWIMNSYLIQIPEQIIIPLLPIPNMSEPINKITVAHKNKLSQDWFRDFFLPQARIKLERSISPLRRNSGKLIILDGRVNKRNWGRLLLQNIQPSKKINYVLPFD

SEQ ID NO: 85162 - protein, 510 aa, Allium cepa
MPIPVLLLLTIFLALLLYLFFFVAKKHEGKRVPGPKGWPILGNLPQLGAKPHQSLCELSRTYGPLFGLRFGYVDVVVAASADVAEQFLRVHDVNFSNRPPNSGAEHIAYNYQDLVFAPYGPRWRMLRKLCALHLFSPKALEDLSPVRSLEVATLANTLYLRAQSDQPTVNLAQMLTTCTTNALSKAMMGRRVFVNETTDTETSKFKDMVLEIMSLAGVFNVGDFVPWLRPFDLQRVVRKMKDVHARFDSFLDKVIAEHRMVDNAHDLLSLLIRSKDDVDNDGVKLTNTDIKALLLNLFTAGTDTSSSTVEWALSEMIRHPDALKRAQRELDEVVGRDRLVSETDIRSLPYIQAIVKETFRLHPSTPLSLPRISSEACTVNGYLIPKNTTLLVNVWAISRDPGVWKEPLEFRPERFLGGGGYETVDLKGNDFELIPFGAGRRVCAGLSLGLRMVQFLTATLVHGFDWKLVDGQSAEKLDMEEAYGLPLQRAVPLMVRPVPRLDEKAYHVVV

SEQ ID NO: 85163 - protein, 292 aa, Prochlorococcus marinus str. AS9601
MQKLSPIEINEICEELGETYPKSIEQVHGGDIHSAWRIEFSNKKLFLKKNIRNKKFLEFEKYCLQNLRKYINQENLVIPEVIAYKNIKNIEILLIEWIDMNNFEQKKLGKGLGELHLKSAESNPKMFGFPVEGFIGTTDQKKGLEDNWIDCFLNLRIIPQLLILKPTTLDKETINKVKEKIKTELLNHEPINALVHGDLWSGNAGMDKSGKGVIFDPASWWADNEVDIAMTKLFGGFRKEFYEEYHRIFPIKKGFEKRIIIYNFYHILNHANMFGGGYLKQVKDYVKEILNM

SEQ ID NO: 85164 - protein, 490 aa, Pseudomonas syringae pv. tomato str. DC3000
MARFELQKLYIDGGYVDASNTETFDSINPANGEVLAKIQRASKEDVERAVVAAEKGQKIWAAMTAVERSRILRRAVDILRERNDELAALETLDTGKAISETRYVDIVTGADVLEYYAGLVPAIEGEQIPLRDSSFVYTRREPLGVVAGIGAWNYPIQIALWKSAPALAAGNAMIFKPSEVTSLTTLKLAEIYTEAGVPNGVFNVLTGSGREVGTWITEHPRIEKVSFTGGTDTGKKVMASASSSSLKEVTMELGGKSPLIVFDDADLDRAADIAMMANFYSSGQVCTNGTRVFVPNALKGEFEAKILERVKRIRPGNPEDENINFGPLVSFEHMESVLGYIAKGKEQGARLLCGGDRLTGGVFDKGAFVAATVFTDCTDEMTIVREEIFGPVMSILGYDTEDEVVRRANDTDFGLAAGIVTRDLNRAHRVIHLLEAGICWINAWGESAAQMPVGGYKQSGVGRENGISSLAQYTRIKSVQIELGDYASVF

SEQ ID NO: 85165 - protein, 423 aa, Gibberella zeae PH-1
MSCFSSLPPQPTDEIFDLLGAYRKDSNPDRVNLGVGVYCTDEGKSWPLDVVTRVEKDLFEEASLTRHDYLPIEGDQQFLKLARDLVFAHQDELSVASVQTVSGTGANHIGARFVADYLRPQNIWVSDPTWANHHMIWESVGLKPKLYPYYKKSDCSLDFEGMIKTLEEEAQPRDAVLLHACAHNPTGLDPTKEQWKIIAEVCQRKQLFPFFDAAYQGFASGSPAEDAWAIRYFYQQQPRPDMIVAQSFSKNFGLYGHRTGAIHLVLAEPSKEIRDNAYSTLSYLLRSEISMAPKYGSTIVKTVLDSEELTAAWMADLQVMSSRIKSMRQALYDELVRLETPGTWNHIIDQIGMFSYTGLTPFEVKVLRERFHIYLLKSGRISISGLNKRNVNYVAKAIHDVRVNGHELNGTNGTNGTNGVNGH

SEQ ID NO: 85166 - protein, 1333 aa, Bacillus clausii
MLAGSSASIVALVASALPLQSAYASSITVKETHYNSSFDAVVDRQMGLSARPQTDKNGRWENASRSDVAYYMNANNFKQGTSSYLQFLNLSSSAGLSAGTINSQLLSDKGILQGQGQAFINASKLYGVNEIYLISHALLETGNGKSQLATGVQVNGKTVYNMYGIGAYDGNAVSAGAQYAYNQGWFTPEDAIIGGARFVSSNYFARGQNTLYKMRWNPANPGTYQYATDVGWAVKQTHHMSNLYSLVDDYEMTFDVPVYKNQPTGDAGNDKLEQLPTGTFGTTTARLNVRTGPGTSHSIVTTLDKDTKVELLAKQGNWYQIAVGNTTGFVSGDYLKLDKPSEDNVEDSDQELISYGETTARLNLRSQPNTSSNVLTTLALGQKLEILKKEGNWYRVRAGHQSGWVSADYVKISSNGVDKESPSLGSATTTARLNLRSGAGTNHSIITTLTKGQKVELLKKQGGWYQVKAGNRTGWVSADYLNVNGSGNVDNAPSSGSATTTARLNLRSGAGTNHSIITTLAKGQKVELLKKQGGWYQVKAGNRTGWVSVDYLNVSGSGNVDNAPSSGSATTTARLNLRSGAGTNHSIITTLAKGQKVELLKKQGGWYQVKAGNRTGWVSVDYLNVNGSGNVDNAPSSGSATTTARLNLRSGAGTNHSIITTLAKGQKVELLKKQGGWYQVKAGNRTGWVSVDYLNVSGSGNVDNTPSSGSATTTARLNLRSGAGTNHSIITTLAKGQKVELLKKQGGWYQVKAGNRTGWVSVDYLNVNGSGNVDNTPSNGSATTTARLNLRSGAGTNHSIITTLAKGQKVELLKKQGGWYQVKAGNRTGWVSVDYLNVSGSGTVDNAPSSGSATTTARLNLRSGAGTNHSIITTLAKGQKVELLKKQGGWYQVKVGNRTGWVSADYLNVSNNQAKTESVETVIDRGTTTARLNLRVDPNTSSKIITTLNNGQQLDILKKQGSWYYVKVGSQTGWVSSQYVKLTEAKPTVQVMARTFSFAPIAPEVEANEEANESVNEENDVADLENSQSEKQQPVDEVEKEEDKQDVSPDKERDTDEHAEEPSIDENDTVPHSDEANDQTVEEDDHVADENEQASETTDTENDAENEESNLPASEEAPSEENDSTDESSLEEPQEPETDASADEQEPETDANTDEQEPETDASTDEQEPETDASADEQEPETDASADEQDLAEQVAEEEHGDADGTSEDQESPVSDTAENNEADENSEPVQEEETDVADDEAEALPEEAEGPSEQDEEPSEATEEQQTTVGQKIQLTENTLLFSEASSDSEQLLELFEDDTIEILEEGTDFVKVKANGVEGWIAVEALAAVLP

SEQ ID NO: 85167 - protein, 575 aa, Oryza sativa Japonica Group
MVSDASKKKAAQKKAAAAAKRGDKAKAAITLSERTCTAVLTSHPLSRDIHIESLSLTFHGHDLLLDTDLELNYGRRYGLLGLNGCGKSCLLKAIGCRELPIPPHMDIYHLTHEIEASDMSALQAVISCDEQRLQLEKEAEILAAQDDGGGEALDRVYERLEAIDASTAEKRAAEILFGLGFNKHMQAKKTCDFSGGWRMRIALARALFMNPTILLLDEPTNHLDLEACVWLEETLKKFDRILVVISHSQDFLNGVCTNIIHMQNRKLKLYTGNYDQYVQTRAELEENQMKQYRWEQDQIASMKEYIARFGHGSAKLARQAQSKEKTLAKMERGGLTEKVVRDKVLTFRFTDVGTLPPPVLQFVEVTFGYTPDNLIYKNLDFGVDLDSRVALVGPNGAGKSTLLKLMTGDLIPLDGMVRRHNHLRIAQFHQHLAEKLDLDMSALQYMMKEYPGNEEERMRAAIGKFGLSGKAQVMPMRNLSDGQRSRVIFAWLAWREPHMLLLDEPTNHLDIETIDSLAEALNEWDGGLVLVSHDFRLINQVAQEIWVCEKQAVTRWEGDIMEFKEHLRSKAGVDD

SEQ ID NO: 85168 - protein, 420 aa, Agrobacterium tumefaciens str. C58
MSEKRVQPLARDAMAYVLAGGRGSRLKELTDRRAKPAVYFGGKARIIDFALSNALNSGIRRIGVATQYKAHSLIRHLQRGWDFFRPERNESFDILPASQRVSETQWYEGTADAVYQNIDIIEPYAPEYMVILAGDHIYKMDYEYMLQQHVDSGADVTIGCLEVPRMEATGFGVMHVNEKDEIIDFIEKPADPPGIPGNEGFALASMGIYVFHTKFLMEALRRDAADPTSSRDFGKDIIPYIVEHGKAVAHRFADSCVRSDFEHEPYWRDVGTIDAYWQANIDLTDVVPDLDIYDKSWPIWTYAEITPPAKFVHDDEDRRGSAVSSVVSGDCIISGAALNRSLLFTGVRANSYSRLENAVVLPSVKIGRHAQLSNVVIDHGVVIPEGLIVGEDPELDAKRFRRTESGICLITQSMIDKLDL

SEQ ID NO: 85169 - protein, 468 aa, Vibrio vulnificus YJ016
MNQFGMTIDGQTVQGEMPSSIVLNPANEQEVFTAPVASIAQLNKAVESAKAAYPLWSALSQAQRDGYINKIADVIEQNASELADIIVKEQGKPTQLAQMEVGGAVAWTRHSASIAIPVEVYEDSENKRIEGRRKSIGVVGSITPWNWPLMIAIWHIIPALRMGNTVVLKPSELTPINTLKLGQLLQDVLPVGVLNVVSGSGDVGRAMSEHRDINKLVFTGSTLTGQNIMQAAATNLKRLTLELGGNDAGIVLPGANLDAIAEGLFATAFINMGQTCAALKRLYVHESQHDELCQKLADIAEKQVVGEGSADGVTFGPVQNSQQLEKVIALVEEAKQQGATIYAGGARLDKPGYFFPPTIVGDAQSGMRVVEEEQFGPVLPVIKYSTVADAVAAANNVGVGLGGSVWGDVEQASELASKLECGSVWINGHAEVLPHAPFGGCKMSGFGVEFGLEGLLENSLLQVVNINK

SEQ ID NO: 85170 - protein, 324 aa, Lactobacillus acidophilus NCFM
MSYKDDMIIFALNSNVPLAQKIADRVGIPLSKSSVERFSDGEIQINIDETVRGKDVYLVQSTSDPVNDNLMELLIMIDAVRRASARTINIVIPYYGYARQDRKTRAREPITAKLVADMLQTAGADRILSLDLHAPQIQGFFDIPVDNLMGAPLLADYFLRNHLEEDAVVVSPDHGGVTRARKLAEFLGCHIAIVDKRRPKANVAEVMNIIGDVKGKRAIIIDDMIDTAGTITLAAQALIDAGATEVYASATHAVLSGPAIKRLNDSPIKNLVLTDSINQPAEKKLDKMLLVSVGPLMGDAIKCIQEHKALSPLFNTRYEEDKHK

SEQ ID NO: 85171 - protein, 583 aa, Bacillus pumilus SAFR-032
MKRISLTILSICLLVFSFFLPVSQVTANEPHGNKVAVGKDGMVATAHPLASEVGADVLKKGGNAVDAAVAIQYALNVTEPMMSGIGGGGFMMVYDGKTKETSIINSRERAPQGATPDMFLTDDGKVIPFAERSTHGNAVGVPGTVKGLEAALDKWGTRSMKELIKPSIQLAEDGFEIDSVLAKAIDDHQGKLKKTAAAPIFLPNDQPLKEGDLLVQPGLAKTFKLIAKKGSKAFYEGKVAKALANTVQDFGGTMTTDDIARYEVETDKPIWGDYKGYQLASMPPPSSGGVFMLQMLKILDHFNLSQYDPKSFEKYQLLAETMHLSYADRAAYAGDPEFVDVPLKGLLDDDYISERASLIQLDQKNRNPKEGDPWAYEDEKNPSPIVSQPEDKTIGETTHFTVADQWGNVVSFTTTIEQLFGTGILVPEYGFFLNNELTDFDARPGGANEVQPNKRPLSSMTPTIIFKDNEPVMTVGSPGGTTIIASVSQTILNLLEYEMELQDAVEEPRIYTNSPTSYRYEVGVPLDVRTKLNDLGHRFGNSPIDIGNVQALLIDRKAGTFTGVADSSRNGTAVGVNLKLSAQ

SEQ ID NO: 85172 - protein, 440 aa, Zymomonas mobilis subsp. mobilis ZM4
MSIEVKMPALSPTMTEGTLAKWLVKEGDAVKAGDILAEIETDKAIMEFETVDAGIIAKILVPEGSENIAVGQVIAVMAEAGEDVSQVAASASSQISEPSEKADVAQKETADSETISIDASLDKAISNAGYGNKTENMTASYQEKAGRIKASPLAKRLAKKNHVDLKQVNGSGPHGRIIKADIEAFIAEANQASSNPSVSTPEASGKITHDTPHNSIKLSNMRRVIARRLTESKQNIPHIYLTVDVQMDALLKLRSELNESLAVQNIKISVNDMLIKAQALALKATPNVNVAFDGDQMLQFSQADISVAVSVEGGLITPILKQADTKSLSALSVEMKELIARAREGRLQPQEYQGGTSSISNMGMFGIKQFNAVINPPQASILAIGSGERRPWVIDDAITIATVATITGSFDHRVIDGADAAAFMSAFKHLVEKPLGILAQ

SEQ ID NO: 85173 - protein, 298 aa, Oryza sativa Japonica Group
MTTAQPLQHEHDPSPPEPDADADDEEEESRVWSQIKAEARRDADGEPALASFVYATVLSHPTLAGSLAFHLANKLASSSTLLSSTLLYDLFAAAHAARPDLRAAAAADLLAAGARDPACAGRLSHCLLDYKGFLAVQAHRVAHALWAQGRRALALALQSRVAEVFAVDIHPAAAVGSGVLLDHATGVVIGETAVVGDGVSILHHVTLGGTGEAVGDRHPKVGDGVLIGAGATILGNVRIGAGAKIGAGSLVLADVPPGATAVGNPARLLLGGDQRGGAPAGESMDHASFMLEWSDYTI

SEQ ID NO: 85174 - protein, 466 aa, Zymomonas mobilis subsp. mobilis ZM4
MADHFDLIVLGGGPGGYVAAIRAAQLNLKVALVERVHLGGICLNWGCIPTKSLLRSAEVYHEMQNAEAYGLTSFKPDFDLDKIIARSREVATRLASGVKTLLRKNKVEVISGVGQLTGNQQMLVETTEGEEKILEAKDIIIATGARARQLPNVHSDGKHIWTYHHALKPPAMPKKLLVIGSGAIGIEFASFYADFGAEVSIVEHAPQILPMEDAEVSAYVAKAFKKRGIRILTQSALQNLTPDDEGVTAEIAGADGKVTKERFSHAIVAIGVVANVENIGLDKLGIKLDRGFIAVDGFGRTNVDHVWAIGDVAGAPCLAHKASHQGVIAAEAIAGCDHVHPLNTQNIPGCTYARPQVASVGLTEEKARQQGYNVKIGNFPFIANGKAIAQGATDGFVKTVFDADSGALLGAHMVGAEVTEMIQGYTVARTLETTEAEIMETIFPHPTLSEAMHESVLAAYGRALHF

SEQ ID NO: 85175 - protein, 87 aa, Oryza sativa
MADRGTSRGGGFASRGGDRGRGRGRGRGRGRGKNEEKEWQPVTKLGRLVKAGKINSMEEIYLHSLPIKEYQIVDNFLPKLKDEVMNI

SEQ ID NO: 85176 - protein, 476 aa, Bartonella henselae str. Houston-1
MLNKRKFYINGLWDDPSTPHDLYVIDPSTEEACAVISLGSTRDADKAINAAKKAFQTWKTTSPHERLGFVEKILEIYEKRSSDMAKTISMEMGAPIDMALNAQTATGSSHIRNFIKAYKEFSFQEALIEGNEQAILHYDAIGVVGLITPWNWPMNQVTLKVIPALLAGCTMVLKPSEIAPLSAMLFAEILDEAALPSGVFNLINGDGANVGSYLSAHPDLGMISFTGSTRAGKDISKNASNTLKRVCLELGGKGANIIFADADIDALQRGVRHCFYNSGQSCNAPTRMLVEQAIYDKAIKTAKDIAEKTQVGPGHQTGNHIGPVVSKEQYDKIQDLIQSGIDEGATLVTGGTGLPMGMERGYYVRPTVFADVKPHMRIFREEIFGPVLSLLPFNTEDEAVTLANDTEYGLTNYIQSQDRSKCRRIAAQVRSGMVEVNGHELPGGSYFGGVKFSGRAREGGLWGIKEFLDTKAISYW

SEQ ID NO: 85177 - protein, 136 aa, Brassica napus
  misc_feature (101)..(101): Xaa can be any naturally occurring amino acid
LLQNIDKISLVRCPVLVIHGTADDVVDFSHGKQLWELCQEKYEPLWLKGGNHCDLELFPEYIGHLKKFVSAVEKSASKRNSSFSRRSMEGGCEHPSRHSVXAPKKSKDGREKPRKSVDRLKFQGYKLSHIERPEKL

SEQ ID NO: 85178 - protein, 475 aa, Bartonella henselae str. Houston-1
MVVKNGKQIKSKGSKLVSDFLKNLRGVDNWEQVSQWLAFRNVEDIECITPDQAGVPRGKMMLSKKFTSKTSLALPSAVFMATISGDYPEDGHGFEYPKTDGDLRLEPDLSTLSIVPWEEAPTAQVICDLVYQNGEVVDYTPRNVLRTVIDFYTQMGLKPVVSPEIEFYLVQKNPDPDYPLVPPVGRSGRSIGGGQGYSIAGVNEFDDLIDDIYHFSEAQGLEIDTLIHEEGAGQFEINLRHGDPIELADQVFMFKRTIREAALKHNMYATFMAKPIQGQPGSAMHIHQSVVDKKTGMNIFTQKDGKESVCFRHFIGGLQKHMAGVFVMLAPYVNSYRRLVPDLSAPVNLRWGYDNRTTAFRVPRSAPKGRRVENRLPSSDANPYLALAASLVCGLIGLQQKLEPDEPTTKNVNADNIELPRGLIEAVNLFEQDTAVRAILGEVFVSTYAAIKRQEFETFMEVISPWEREYLLLNV

SEQ ID NO: 85179 - protein, 151 aa, Schizosaccharomyces pombe
MSTTARRRLMRDFKRMQQDPPAGVSASPVSDNVMLWNAVIIGPADTPFEDGTFKLVLSFDEQYPNKPPLVKFVSTMFHPNVYANGELCLDILQNRWSPTYDVAAILTSIQRLLNDPNNASPANAEAAQLHRENKKEYVRRVRKTVEDSWES

SEQ ID NO: 85180 - protein, 337 aa, Synechocystis sp. PCC 6803
MTRVAINGFGRIGRNFLRCWLGRTDSQLEVVGINDTSDPRTNAHLLRYDSMLGKLDADISADENSITVNGKTIKCVSDRNPLNLPWAEWNVDLVIEATGVFVTHEGATKHVQAGAKKVLITAPGKGPNIGTYVVGVNAHEYKHEEYEVISNASCTTNCLAPFGKVINDNFGIIKGTMTTTHSYTGDQRILDASHRDLRRARAAAVNIVPTSTGAAKAVALVIPELQGKLNGIALRVPTPNVSVVDLVVQVEKNTIAEQVNGVLKEAANTSLKGVLEYTDLELVSSDFRGTDCSSTVDGSLTMVMGGDMVKVIAWYDNEWGYSQRVVDLAEIVAKNWK

SEQ ID NO: 85181 - protein, 415 aa, Kineococcus radiotolerans SRS30216
MPLVATPNVLAIVLAGGEGKRLMPLTADRAKPAVPFGGTYRLIDFALSNLVNAGYRKVVVLTQYKSHSLDRHISQGWRMSNLFGSYIASVPAQQRVGQRWYLGSADAIYQSLNLVSDERPDIVVVVGADHVYRMDFSQMVDAHIASGSPCSVAAIRQPISLADQFGVIQTAPGSNRIAEFLEKPKDPQGLEDSPHEVLASMGNYVFDADALVDAVTRDSENEGSKHDMGGDIVPDFVSRGQASVYDFKDNEVPGATDRDRAYWRDVGTLDSYFEAQMDLISVLPVFNLYNYEWPIITAQDYYPPAKFVHGWQGTYGHAVNSIVSQGTVVSGALVEKSVVSPNVRLDSWAHVSESVLMDGVQVGRHAVVQRAIVDKFVTVPDDARIGVDPEEDRARGFHVTDSGITVVGKGQTIPT

SEQ ID NO: 85182 - protein, 142 aa, Bradyrhizobium japonicum USDA 110
MLVGDILRKKTPRVVTVRMNETVGIAAKLMRANNISALVVKDVVRSEGNTAVGMFTERDVVRAVAEHGANAINVKVSQLVSVQQLVSCTSIDTIEHVRHLMNRHHIRHLPVIDDYSLISVISMRDIAAAVDEAINGTPQAAA
